US012673078B2

(12) United States Patent
Kilcher et al.

(10) Patent No.: US 12,673,078 B2
(45) Date of Patent: Jul. 7, 2026

(54) BACTERIOPHAGES PRODUCING HETEROLOGOUS BACTERIOCINS

(71) Applicant: ETH Zurich, Zürich (CH)

(72) Inventors: Samuel Nando Kilcher, Zürich (CH); Matthew Stephen Dunne, Zürich (CH); Susanne Andrea Meile, Zürich (CH); Jiemin Du, Zürich (CH); Martin Johannes Loessner, Zürich (CH)

(73) Assignee: ETH Zurich, Zürich (CH)

( * ) Notice: Subject to any disclaimer, the term of this patent is extended or adjusted under 35 U.S.C. 154(b) by 0 days.

(21) Appl. No.: 18/344,998

(22) Filed: Jun. 30, 2023

(65) Prior Publication Data

US 2024/0148806 A1 May 9, 2024

Related U.S. Application Data

(62) Division of application No. PCT/EP2022/077385, filed on Sep. 30, 2022.

(30) Foreign Application Priority Data

Oct. 1, 2021 (EP) ..................................... 21200534

(51) Int. Cl.
| | |
|---|---|
| *A61K 35/76* | (2015.01) |
| *A61P 31/04* | (2006.01) |
| *C07K 14/195* | (2006.01) |
| *C12N 7/00* | (2006.01) |

(52) U.S. Cl.
CPC .............. *A61K 35/76* (2013.01); *A61P 31/04* (2018.01); *C07K 14/195* (2013.01); *C12N 7/00* (2013.01); *C12N 2795/00022* (2013.01); *C12N 2795/00032* (2013.01)

(58) Field of Classification Search
None
See application file for complete search history.

(56) References Cited

U.S. PATENT DOCUMENTS

| | | |
|---|---|---|
| 2014/0148379 A1 | 5/2014 | Liu et al. |
| 2015/0320829 A1 | 11/2015 | Liu et al. |

FOREIGN PATENT DOCUMENTS

EP 3584316 A1 12/2019

OTHER PUBLICATIONS

Witkowski et al, Biochemistry 38:11643-11650, 1999. (Year: 1999).*
Seffernick et al, Bacteriol. 183(8): 2405-2410, 2001. (Year: 2001).*
Prengler et al, Ann Neurol 2002; 51:543-552. (Year: 2002).*
Masuda, Y., Kawabata, S., Uedoi, T., Honjoh, K.I. and Miyamoto, T., 2021. Construction of leaderless-bacteriocin-producing bacteriophage targeting *E. coli* and neighboring gram-positive pathogens. Microbiology spectrum, 9(1), pp. e00141-e00121.
Hupfeld, M., Trasanidou, D., Ramazzini, L., Klumpp, J., Loessner, M.J. and Kilcher, S., 2018. A functional type II-A CRISPR-Cas system from Listeria enables efficient genome editing of large non-integrating bacteriophage. Nucleic acids research, 46(13), pp. 6920-6933.
Cherier, D., Patin, D., Blanot, D., Touzé, T. and Barreteau, H., 2021. The Biology of Colicin M and Its Orthologs. Antibiotics, 10(9), p. 1109.
Flores-Mireles, A.L., Walker, J.N., Caparon, M. and Hultgren, S.J., 2015. Urinary tract infections: epidemiology, mechanisms of infection and treatment options. Nature reviews microbiology, 13(5), pp. 269-284.

* cited by examiner

*Primary Examiner* — Daniel E Kolker
*Assistant Examiner* — Cheom-Gil Cheong
(74) *Attorney, Agent, or Firm* — Ipsilon USA—NLO

(57) ABSTRACT

The present invention relates to the field of medicine, specifically the field of bacterial infection and treatment thereof.

13 Claims, 23 Drawing Sheets

Specification includes a Sequence Listing.

Bacteriophage::bacteriocin

✧ Bacteriocin

Fig. 2B

| Strain | Species | Efs3::kvarM | Efs7::kvarM |
|---|---|---|---|
| A Kp3 | K. pneumoniae | ++ | ++ |
| B Kp37 | K. pneumoniae | +++ | +++ |
| C Kp31 | K. pneumoniae | + | + |
| D Kp39 | K. pneumoniae | - | - |
| E Kp5 | K. pneumoniae | - | - |
| F Kp33 | K. pneumoniae | +++ | +++ |
| G Kp21 | K. pneumoniae | - | - |
| H Kp43 | K. pneumoniae | + | - |
| J Kp16 | K. pneumoniae | (+) | - |
| K Kp34 | K. pneumoniae | - | - |
| L Kp48 | K. pneumoniae | - | - |
| M Kp45 | K. pneumoniae | ++ | ++ |
| N Kp26 | K. pneumoniae | + | + |
| O Kp8 | K. pneumoniae | - | - |
| P KpGe | K. pneumoniae | ++ | ++ |
| Q Kp22 | K. pneumoniae | (±) | (±) |
| R Kp51 | K. pneumoniae | +++ | +++ |
| S Kp36 | K. pneumoniae | ++ | ++ |
| T Kp6 | K. pneumoniae | ++ | ++ |
| U Kp53 | K. pneumoniae | - | - |
| V Kp66 | K. pneumoniae | + | - |
| Y Kp69 | K. pneumoniae | + | - |

| Strain | Species | K1::colM | K1::colE6 | CM001::colE7 | Efs3::colE7 | Efs3::colM | Efs7::colM |
|---|---|---|---|---|---|---|---|
| A Ec3 | E.coli | - | - | + | - | - | - |
| B Ec22 | E.coli | - | - | - | - | - | - |
| C Ec42 | E.coli | - | - | - | - | - | - |
| D Ec43 | E.coli | - | ++ | +++ | +++ | - | - |
| E Ec16 | E.coli | - | + | +++ | +++ | - | - |
| F Ec32 | E.coli | +++ | - | - | - | - | - |
| G Ec46 | E.coli | - | - | +++ | + | ++ | ++ |
| H Ec57 | E.coli | - | - | - | - | - | - |
| J Ec14 | E.coli | - | - | - | - | ++ | - |
| K Ec33 | E.coli | - | - | - | - | - | - |
| L Ec47 | E.coli | - | + | +++ | ++ | + | + |
| M Ec54 | E.coli | - | + | +++ | +++ | - | - |
| N Ec20 | E.coli | ++ | + | +++(host) | +++ | +++ | + |
| O Ec34 | E.coli | - | - | - | - | - | - |
| Q Ec41 | E.coli | - | ++ | +++ | +++ | - | - |
| R Ec62 | E.coli | - | - | - | - | - | - |
| S Ec21 | E.coli | + | - | ++ | ++ | + | - |
| T Ec28 | E.coli | - | ++ | ++ | ++ | + | - |
| V Ec52 | E.coli | - | - | ++ | +++ | - | - |
| W Ec63 | E.coli | - | - | - | - | - | - |
| X Ec65 | E.coli | + | - | +++ | +++ | - | - |
| Y Ec56 | E.coli | - | + | +++ | +++ | - | - |
| Z Ec79 | E.coli | - | - | - | - | - | - |
| P (BI21) | E.coli | - | - | + | - | - | - |

CAUTIphage::bacteriocin

Bacteriocin

Starting conditions: $1\times10^8$ CFU/ml + $1\times10^8$ PFU/ml

Starting conditions: $1\times10^8$ CFU/ml + $1\times10^8$ PFU/ml

Co-infection: Ratio 1:1

Co-infection: Ratio 1:10

1. HEPT treatment

2. CLB + phage production

3. Phage-mediated killing and CLB release

4. CLB-mediated killing susceptible resistant

HEPT bacteriocin

E2 hoc hoc 1 kb

K1 gp168 gp168

☐ = WT phage

▨ = colE7

▦ = kvarM

▽ = effector gene insertion site

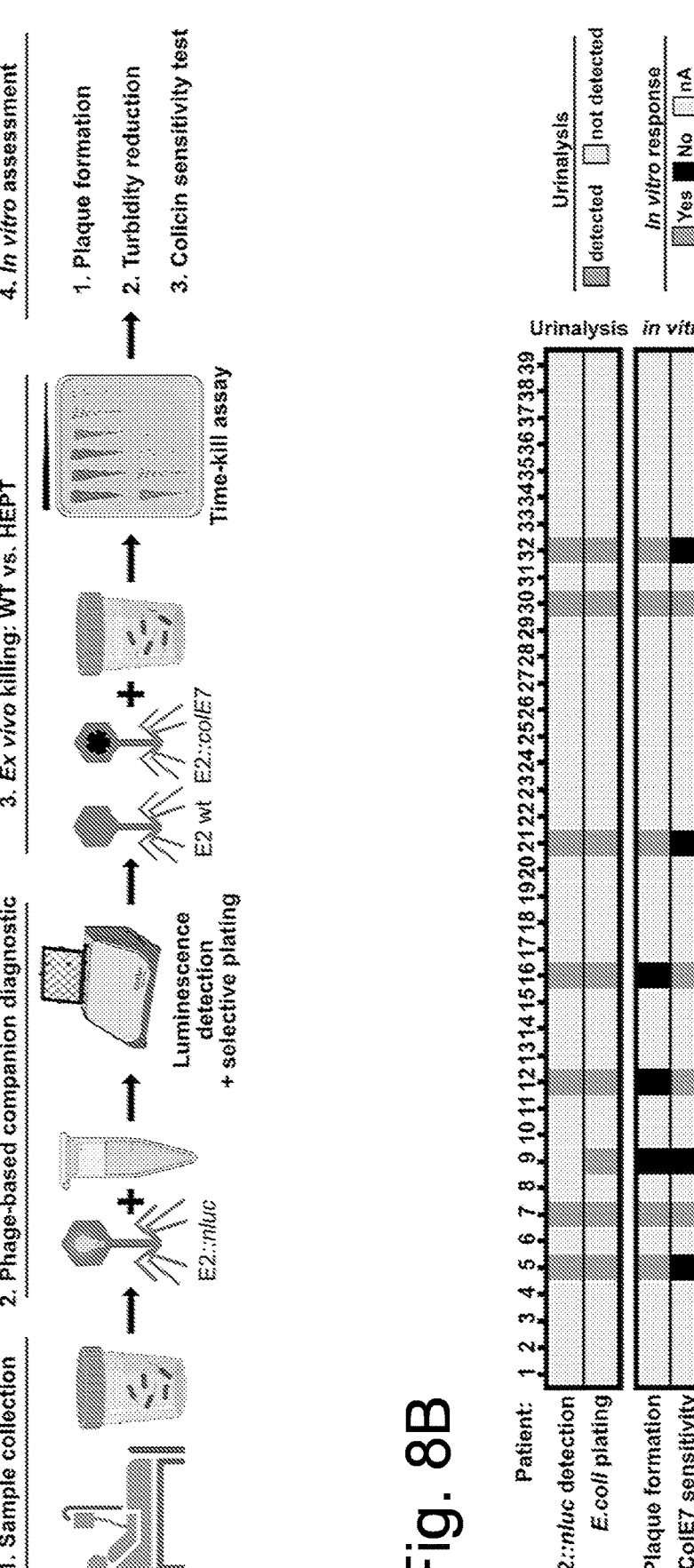

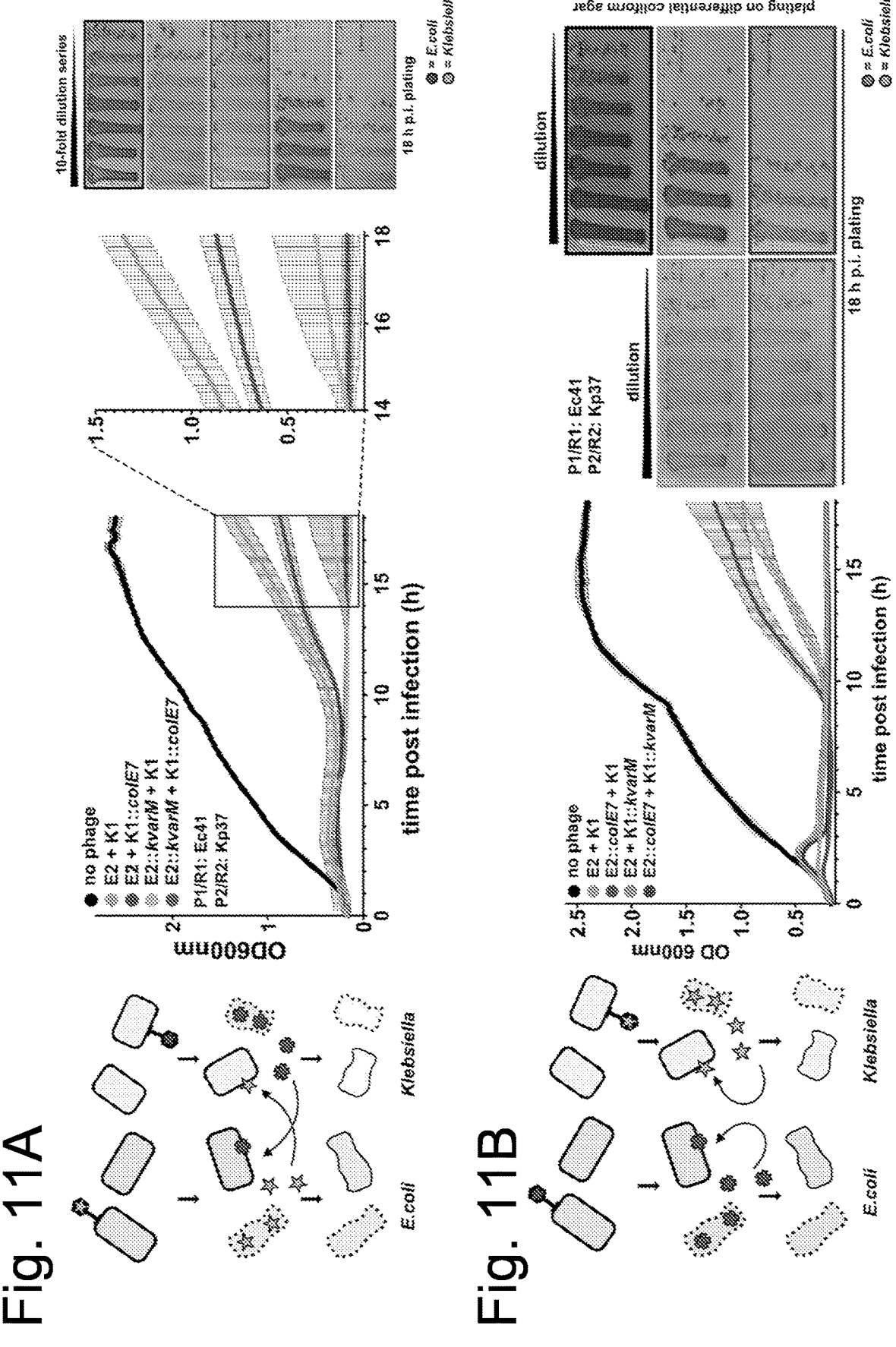

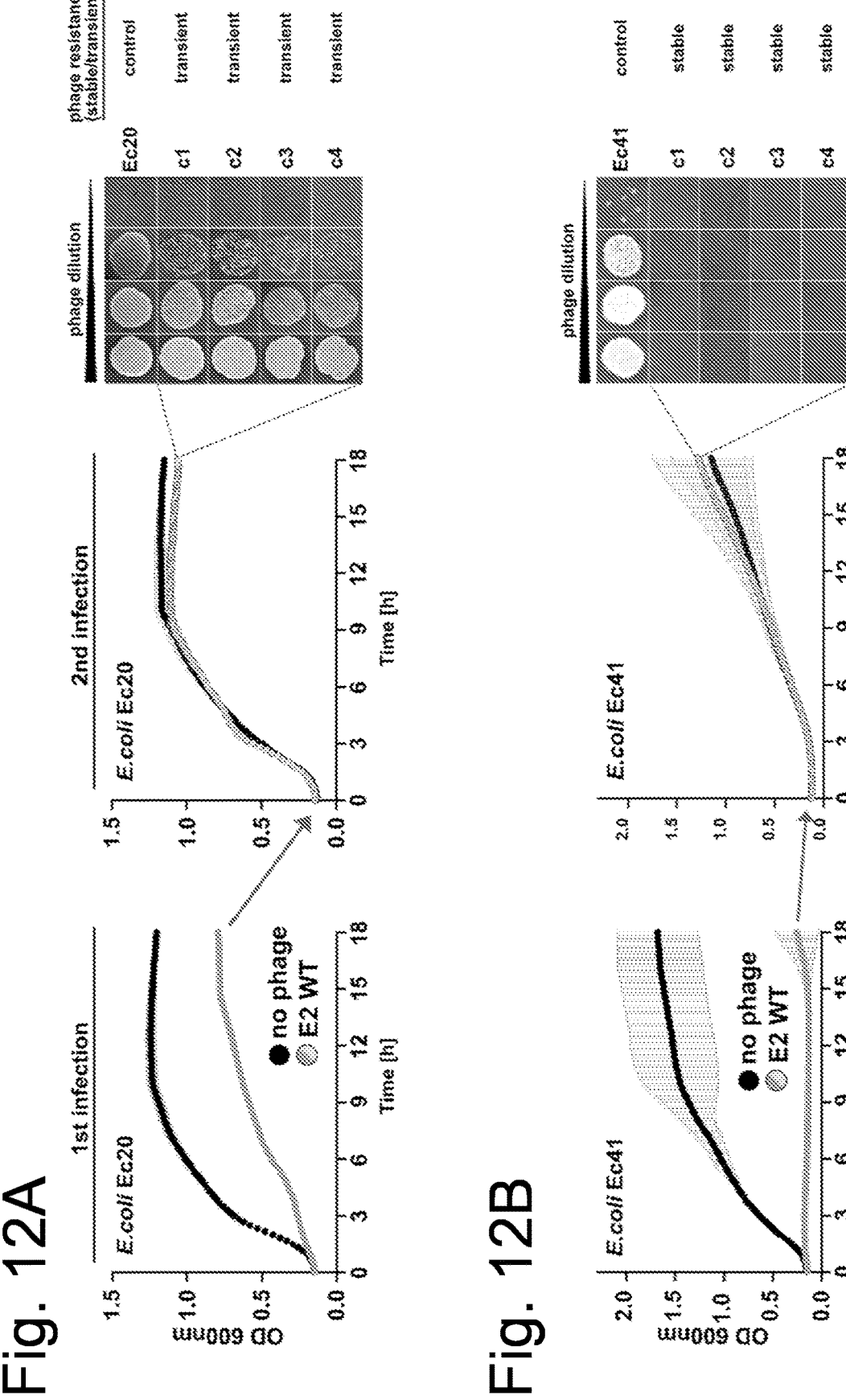

Fig. 14C
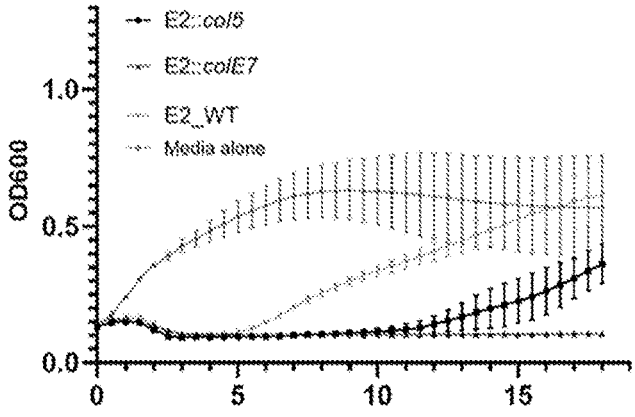
Fig. 14D
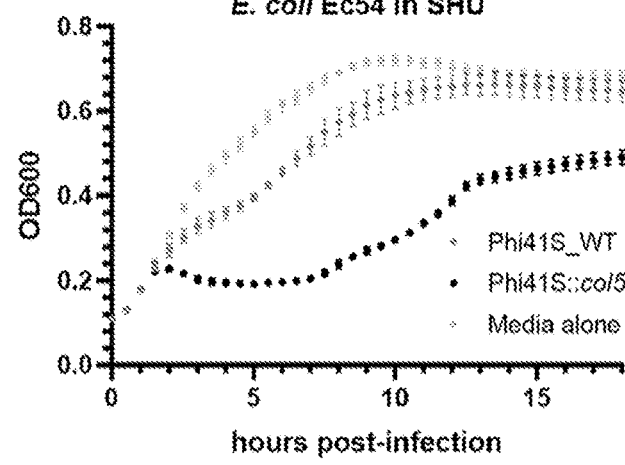
Fig. 14E

BACTERIOPHAGES PRODUCING HETEROLOGOUS BACTERIOCINS

REFERENCE TO AN ELECTRONIC SEQUENCE LISTING

The contents of the electronic sequence listing (P6106044US1 wiposequence St26.xml.; Size: 3.31 MB; and Date of Creation: Jun. 21, 2023) is herein incorporated by reference in its entirety.

FIELD OF THE INVENTION

The present invention relates to the field of medicine, specifically the field of bacterial infection and treatment thereof.

BACKGROUND OF THE INVENTION

The antibiotic resistance crisis and adverse effects caused by antibiotic-induced microbiome dysbiosis highlight the need for novel and more pathogen-specific antibacterial interventions. The therapeutic use of bacteriophages/phages (i.e., viruses that infect bacteria) is one promising alternative option. While phages offer the required pathogen-specificity, it remains difficult to completely inactivate all cells from a population of target cells. This is due to the evolution of effective phage resistance mechanisms such as receptor diversification, adaptive CRISPR-Cas immunity, restriction/modification, or abortive infection that bacteria use to counteract phage predation. To circumvent this limitation, multiple phages with distinct infection pathways are typically combined to replace or complement antibiotic therapy with varying results.

Accordingly, there is a need to further improve pathogen-specific antibacterial interventions.

DESCRIPTION OF THE INVENTION

The inventors have established that bacteriophages can be engineered to encode bacteriocins as genetic payloads. Heterologous bacteriocins can be expressed during infection and can be released upon host cell lysis to locally improve and expand the antibacterial effect of the parental host phage. Bacteriocins may act on species of the host strain itself to target resistant sub-populations and other survivors of phage infection. Alternatively, a bacteriocin may be produced that is not toxic to the host strain but is toxic to another strain, so a second pathogen can be targeted.

Accordingly, in a first aspect there is provided, a modified bacteriophage capable of infecting a host bacterium, wherein the bacteriophage comprises a gene that is foreign to the bacteriophage and wherein said gene encodes a bacteriocin.

In the embodiments herein, 'modified bacteriophage' means that the bacteriophage is genetically modified such that the genome comprises a gene that is foreign to the bacteriophage and which gene encodes a bacteriocin which is antibacterial enzyme that targets species of the host bacterium. The person skilled in the art knows how to modify a genome of a bacteriophage. To be able to express the bacteriocin, the coding sequence may be operable linked to control sequences such as but not limited to a promoter and a terminator sequence. The promoter may be any promotor that is compatible with the target bacterium and may be a constitutive or an inducible promotor. The coding sequence of the bacteriocin may be codon optimized for optimal expression in the target bacterium. The modified bacteriophage may further comprise a selectable marker, which may be a dominant or an auxotrophic marker. The marker may be an antibiotic or a non-antibiotic marker. The marker may be a marker that after engineering the genome can be deleted. The genome of the bacteriophage may be modified by a polynucleotide-guided genome editing system such as a CRISPR-Cas system or variant thereof.

Bacteriocins are known to the person skilled in the art and are toxins that inhibit the growth of bacteria. Since they can be specific for species of bacteria, the can be used to selectively target bacteria within a microbiome without targeting other bacteria in the microbiome, unlike antibiotics which typically target large groups of bacteria.

In the embodiments herein, the bacteriocin may be any bacteriocin that can be encoded by a gene within a modified bacteriophage. The bacteriocin may be a peptide or a polypeptide, the polypeptide may be an enzyme such as the chimeric endolysin EC300 as described in the examples herein or a functional variant of EC300 having at least 50% sequence identity to SEQ ID NO: 32. Another example of a bacteriocin enzyme is the nuclease Colicin E7 as described elsewhere herein. In an embodiment, the bacteriocin is not lysostaphin. In an embodiment, the bacteriocin is not ALE-1. In an embodiment, the bacteriocin is not Lacticin Q.

In the embodiments herein, the bacteriocin may a bacteriocin specific for Gram-negative bacteria, such as a microcin, a colicin-like bacteriocin or a tailocin.

In the embodiments herein, the bacteriocin is a bacteriocin specific for Gram-positive bacteria, such as class III bacteriocins.

In the embodiments herein, the bacteriocin may target species of the host bacterium. This means that a population of host bacteria is not only targeted and inhibited in growth by the bacteriophage, but also by the bacteriocin. In case where a bacterium within the population would be resistant or tolerant to the bacteriophage, it may still be killed by the bacteriocin.

In the embodiments herein, the bacteriocin may not target species of the host bacterium. This means that the host bacterium is targeted by the bacteriophage and may be inhibited in growth by the bacteriophage, but the host bacterium is not targeted and not inhibited in growth by the bacteriocin. The bacteriocin may target other bacterial species present in the microbiome or infection and may inhibit growth of these species.

In the embodiments herein, the bacteriocin may have a protein sequence that can be classified into an InterPro homologous superfamily, family, or domain selected from the group consisting of: IPR036725, IPR037146, IPR038283, IPR036302, IPR024575, IPR028056, IPR000293, IPR009105, IPR024566, and IPR016128. The bacteriocin protein sequence may be classified as homologous superfamily IPR036725, IPR037146, IPR038283, or IPR036302; may be classified as family IPR024575 or IPR028056, or may be classified as domain IPR000293, IPR009105, IPR024566, or IPR016128. InterPro classification of protein families is known to the person skilled in the art and provides functional analysis of proteins by classifying them into families and predicting domains and important sites. To classify proteins in this way, InterPro uses predictive models, known as signatures, provided by several different databases (referred to as member databases) that make up the InterPro consortium. InterPro combines protein signatures from these member databases into a single searchable resource, capitalising on their individual strengths to produce a powerful integrated database and diagnostic tool. See e.g. www.ebi.ac.uk/interpro and Blum et al, 2020 (The InterPro protein families and domains database: 20 years on. *Nucleic Acids Research*, November 2020, (doi: 10.1093/nar/gkaa977).

In the embodiments herein, the bacteriocin may be selected from the group consisting of Colicin M, Colicin E7, Colicin K, Colicin 5, Colicin E6 and Klebicin M.

In the embodiments herein, the bacteriocin may have at preferably at least 50% sequence identity with a bacteriocin selected from the group consisting of Colicin M (SEQ ID NO: 18), Colicin E7 (SEQ ID NO: 20), Colicin K (SEQ ID NO: 19), Colicin 5 (SEQ ID NO: 17), Colicin E6 (SEQ ID NO: 16) and Klebicin M (SEQ ID NO: 21) while preferably maintaining its wild-type bacteriocin functionality. Such bacteriocin may also be a variant bacteriocin that has different properties compared to the corresponding wild-type bacteriocin and may e.g. have altered host specificity or altered specific activity.

In the embodiments herein, the host bacterium may be any bacterium known to the person skilled in the art. In the embodiments herein, the host bacterium may a bacterium selected from the group consisting of: *Acetinobacter, Chroinobacter, Bortadella, Burkholderia, Campylobacter, Staphylococcus, Pneumococcus, Enterococcus*, such as *Enterococcus faecalis, Klebsiella*, such as *Klebsiella pneumoniae, Escherichia*, such as *E. coli, Pseudomonas, Salmonella, Shigella, Vibrio, Neisseria, Brucella, Haemophilus, Mycobacterium, Listeria, Legionella, Yersinia, Chlamydia, Clostridium, Helicobacter, Corynebacterium, Lactobacillus, Lactococcus, Fusobacterium*, and *Streptococcus.*

In an embodiment, the host bacterium is an *E. coli* species and the bacteriocin targets said *E. coli* species.

In an embodiment, the host bacterium is an *E. coli* species and the bacteriocin does not target said *E. coli* species.

In an embodiment, the host bacterium is an *Enterococcus* species, such as *Enterococcus faecalis*, and the bacteriocin targets said *Enterococcus* species.

In an embodiment, the host bacterium is an *Enterococcus* species, such as *Enterococcus faecalis*, and the bacteriocin does not target said *Enterococcus* species.

In an embodiment, the host bacterium is a *Klebsiella* species, such as *Klebsiella pneumoniae*, and the bacteriocin targets said *Klebsiella* species.

In an embodiment, the host bacterium is a *Klebsiella* species, such as *Klebsiella pneumoniae*, and the bacteriocin does not target said *Klebsiella* species.

In the embodiments herein, the bacteriophage is derived from wild-type bacteriophage *Klebsiella* phage K1*, E. coli* phage CM001, *E. coli* phage E2, *Enterococcus* phage Efs3, *Enterococcus* phage Efs7 or from *E. coli* phage phi41S.

In an embodiment, the bacteriophage is derived from wild-type bacteriophage *Klebsiella* phage K1 and the bacteriocin is Colicin M, or a variant having at least 50% sequence identity to Colicin M (SEQ ID NO: 18).

In an embodiment, the bacteriophage is derived from wild-type bacteriophage *Klebsiella* phage K1 and the bacteriocin is Colicin E7, or a variant having at least 50% sequence identity to Colicin E7 (SEQ ID NO: 20).

In an embodiment, the bacteriophage is derived from wild-type bacteriophage *Klebsiella* phage K1 and the bacteriocin is Colicin E6, or a variant having at least 50% sequence identity to Colicin E6 (SEQ ID NO: 16).

In an embodiment, the bacteriophage is derived from wild-type bacteriophage *Klebsiella* phage K1 and the bacteriocin is Colicin K, or a variant having at least 50% sequence identity to Colicin K (SEQ ID NO: 19).

In an embodiment, the bacteriophage is derived from wild-type bacteriophage *Klebsiella* phage K1 and the bacteriocin is Colicin 5, or a variant having at least 50% sequence identity to Colicin 5 (SEQ ID NO: 17).

In an embodiment, the bacteriophage is derived from wild-type bacteriophage *Klebsiella* phage K1 and the bacteriocin is Klebicin M (kvarM), or a variant having at least 50% sequence identity to Klebicin M (SEQ ID NO: 21).

In an embodiment, the bacteriophage is derived from wild-type bacteriophage *E. coli* phage CM001 and the bacteriocin is Colicin M, or a variant having at least 50% sequence identity to Colicin M (SEQ ID NO: 18).

In an embodiment, the bacteriophage is derived from wild-type bacteriophage *E. coli* phage CM001 and the bacteriocin is Colicin E7, or a variant having at least 50% sequence identity to Colicin E7 (SEQ ID NO: 20).

In an embodiment, the bacteriophage is derived from wild-type bacteriophage *E. coli* phage CM001 and the bacteriocin is Colicin E6, or a variant having at least 50% sequence identity to Colicin E6 (SEQ ID NO: 16), or a variant having at least 50% sequence identity to Colicin E6 (SEQ ID NO: 16).

In an embodiment, the bacteriophage is derived from wild-type bacteriophage *E. coli* phage CM001 and the bacteriocin is Colicin K, or a variant having at least 50% sequence identity to Colicin K (SEQ ID NO: 19).

In an embodiment, the bacteriophage is derived from wild-type bacteriophage *E. coli* phage CM001 and the bacteriocin is Colicin 5, or a variant having at least 50% sequence identity to Colicin 5 (SEQ ID NO: 17).

In an embodiment, the bacteriophage is derived from wild-type bacteriophage *E. coli* phage CM001 and the bacteriocin is Klebicin M (kvarM), or a variant having at least 50% sequence identity to Klebicin M (SEQ ID NO: 21).

In an embodiment, the bacteriophage is derived from wild-type bacteriophage *E. coli* phage E2 and the bacteriocin is Colicin M, or a variant having at least 50% sequence identity to Colicin M (SEQ ID NO: 18).

In an embodiment, the bacteriophage is derived from wild-type bacteriophage *E. coli* phage E2 and the bacteriocin is Colicin E7, or a variant having at least 50% sequence identity to Colicin E7 (SEQ ID NO: 20).

In an embodiment, the bacteriophage is derived from wild-type bacteriophage *E. coli* phage E2 and the bacteriocin is Colicin E6, or a variant having at least 50% sequence identity to Colicin E6 (SEQ ID NO: 16).

In an embodiment, the bacteriophage is derived from wild-type bacteriophage *E. coli* phage E2 and the bacteriocin is Colicin K, or a variant having at least 50% sequence identity to Colicin K (SEQ ID NO: 19).

In an embodiment, the bacteriophage is derived from wild-type bacteriophage *E. coli* phage E2 and the bacteriocin is Colicin 5, or a variant having at least 50% sequence identity to Colicin 5 (SEQ ID NO: 17).

In an embodiment, the bacteriophage is derived from wild-type bacteriophage *E. coli* phage E2 and the bacteriocin is Klebicin M (kvarM), or a variant having at least 50% sequence identity to Klebicin M (SEQ ID NO: 21).

In an embodiment, the bacteriophage is derived from wild-type bacteriophage *Enterococcus* phage Efs3 and the bacteriocin is Colicin M, or a variant having at least 50% sequence identity to Colicin M (SEQ ID NO: 18).

In an embodiment, the bacteriophage is derived from wild-type bacteriophage *Enterococcus* phage Efs3 and the bacteriocin is Colicin E7, or a variant having at least 50% sequence identity to Colicin E7 (SEQ ID NO: 20).

In an embodiment, the bacteriophage is derived from wild-type bacteriophage *Enterococcus* phage Efs3 and the bacteriocin is Colicin E6, or a variant having at least 50% sequence identity to Colicin E6 (SEQ ID NO: 16).

In an embodiment, the bacteriophage is derived from wild-type bacteriophage *Enterococcus* phage Efs3 and the bacteriocin is Colicin K, or a variant having at least 50% sequence identity to Colicin K (SEQ ID NO: 19).

In an embodiment, the bacteriophage is derived from wild-type bacteriophage *Enterococcus* phage Efs3 and the bacteriocin is Colicin 5, or a variant having at least 50% sequence identity to Colicin (SEQ ID NO: 17).

In an embodiment, the bacteriophage is derived from wild-type bacteriophage *Enterococcus* phage Efs3 and the bacteriocin is Klebicin M (kvarM), or a variant having at least 50% sequence identity to Klebicin M (SEQ ID NO: 21).

In an embodiment, the bacteriophage is derived from wild-type bacteriophage *Enterococcus* phage Efs7 and the bacteriocin is Colicin M, or a variant having at least 50% sequence identity to Colicin M (SEQ ID NO: 18).

In an embodiment, the bacteriophage is derived from wild-type bacteriophage *Enterococcus* phage Efs7 and the bacteriocin is Colicin E7, or a variant having at least 50% sequence identity to Colicin E7 (SEQ ID NO: 20).

In an embodiment, the bacteriophage is derived from wild-type bacteriophage *Enterococcus* phage Efs7 and the bacteriocin is Colicin E6, or a variant having at least 50% sequence identity to Colicin E6 (SEQ ID NO: 16).

In an embodiment, the bacteriophage is derived from wild-type bacteriophage *Enterococcus* phage Efs7 and the bacteriocin is Colicin K, or a variant having at least 50% sequence identity to Colicin K (SEQ ID NO: 19).

In an embodiment, the bacteriophage is derived from wild-type bacteriophage *Enterococcus* phage Efs7 and the bacteriocin is Colicin 5, or a variant having at least 50% sequence identity to Colicin (SEQ ID NO: 17).

In an embodiment, the bacteriophage is derived from wild-type bacteriophage *Enterococcus* phage Efs7 and the bacteriocin is Klebicin M (kvarM), or a variant having at least 50% sequence identity to Klebicin M (SEQ ID NO: 21).

In an embodiment, the bacteriophage is derived from wild-type bacteriophage *E. coli* phage phi41S and the bacteriocin is Colicin M, or a variant having at least 50% sequence identity to Colicin M (SEQ ID NO: 18).

In an embodiment, the bacteriophage is derived from wild-type bacteriophage *E. coli* phage phi41S and the bacteriocin is Colicin E7, or a variant having at least 50% sequence identity to Colicin E7 (SEQ ID NO: 20).

In an embodiment, the bacteriophage is derived from wild-type bacteriophage *E. coli* phage phi41S 1 and the bacteriocin is Colicin E6, or a variant having at least 50% sequence identity to Colicin E6 (SEQ ID NO: 16).

In an embodiment, the bacteriophage is derived from wild-type bacteriophage *E. coli* phage phi41S and the bacteriocin is Colicin K, or a variant having at least 50% sequence identity to Colicin K (SEQ ID NO: 19).

In an embodiment, the bacteriophage is derived from wild-type bacteriophage *E. coli* phage phi41S and the bacteriocin is Colicin 5, or a variant having at least 50% sequence identity to Colicin 5 (SEQ ID NO: 17).

In an embodiment, the bacteriophage is derived from wild-type bacteriophage *E. coli* phage phi41S and the bacteriocin is Klebicin M (kvarM), or a variant having at least 50% sequence identity to Klebicin M (SEQ ID NO: 21).

In the embodiments herein, the modified bacteriophage may be a bacteriophage having a genome that has at least 50% sequence identity to a sequence as set forward in SEQ ID NO: 6-15, 23-31 or 33.

The modified bacteriophage as defined in the embodiments herein can conveniently be comprised in a composition.

Accordingly, in a second aspect there is provided for a composition comprising a carrier and a modified bacteriophage as defined in the first aspect. The carrier may be any carrier known to the person skilled in the art. In the embodiments herein, the composition will typically comprise water and a modified bacteriophage as defined in the first aspect. Other components may be present that are known in the field of bacteriophages such as a buffering agent and a preservation agent.

In the embodiments herein, the composition may be a pharmaceutical composition. Such composition fulfils the requirements for pharmaceutical use and may comprise a pharmaceutical grade excipient and/or a further active ingredient.

In the embodiments herein, the composition may be formulated to contain specific excipients known to the person skilled in the art to allow any specific route of administration; the composition may be formulated for topical, intravenous, intramuscular, intrathecal, oral, intraperitoneal, vaginal, rectal, lumbar, or meningeal administration.

The bacteriophage as defined in the first aspect and the composition as defined in the second aspect may conveniently be used for antibacterial decontamination.

Accordingly, in a third aspect there is provided for the use of a modified bacteriophage as defined in the first aspect or of a composition as defined in the second aspect, for in vitro or ex vivo antibacterial decontamination. The product to be contaminated may be any product where decontamination is required, such as but not limited to food processing equipment, food products, medical devices, and surfaces in a hospital such as in an operation room.

The bacteriophage as defined in the first aspect and the composition as defined in the second aspect may conveniently be used for detection of a bacterial pathogen.

Accordingly, there is provided for the use of a modified bacteriophage as defined in the first aspect or of a composition as defined in the second aspect, for in vitro or ex vivo detection of a bacterial pathogen.

The bacteriophage as defined in the first aspect and the composition as defined in the second aspect may conveniently be used for treatment of bacterial infections in subject in need thereof.

Accordingly, in a fourth aspect, there is provided for a modified bacteriophage as defined in the first aspect or a composition as defined in the second aspect, for use as a medicament for the treatment of a bacterial infection in a subject in need thereof.

Further provided is the use of a modified bacteriophage as defined in the first aspect or of a composition as defined in the second aspect, for the production of a medicament for the treatment of a bacterial infection in a subject in need thereof.

Further provided is a method of treatment of a bacterial infection in a subject in need thereof, comprising administration of a therapeutically effective amount of a modified bacteriophage as defined in the first aspect or of a composition as defined in the second aspect, to the subject, thereby treating the bacterial infection.

In the embodiments herein, a therapeutically active amount is defined as such amount that decreases the amount of the target bacterium present in the subject by preferably 100%, 99%, 90%, 80%, 70%, 60%, 50%, 40%, 30%, 20%, 10%, or at least 5%.

The subject may be an animal, preferably a mammal and more preferably a human.

The bacteriophage or composition may be administered in any way known to the person skilled in the art, preferably one of the routes described elsewhere herein.

The bacteriophage as defined in the first aspect and the composition as defined in the second aspect may conveniently be used for altering the microbial composition of a microbiome.

Accordingly, in a further aspect there is provided for a method of altering the microbial composition of a microbiome, comprising introducing a modified bacteriophage as defined in the first aspect or a composition into the second aspect into the microbiome. The microbiome may be present in a subject or may be an in vivo or ex vivo microbiome.

TABLE 1

| | Overview of sequences | |
|---|---|---|
| SEQ ID NO: | Identity | Host/target organism |
| 1 | Wild-type K1 phage | *Klebsiella* |
| 2 | Wild-type CM001 phage | *E. coli* |
| 3 | Wild-type phage Efs3 | *Enterococcus* |
| 4 | Wild-type phage Efs7 | *Enterococcus* |
| 5 | Wild-type E2 phage | *E. coli* |
| 6 | K1_kvarM | *Klebsiella* |
| 7 | CM001_colE7 | *E. coli* |
| 8 | Efs3_kvarM | *Enterococcus* |
| 9 | Efs3_colE7 | *Enterococcus* |
| 10 | Efs7_kvarM | *Enterococcus* |
| 11 | K1_colM | *Klebsiella* |
| 12 | K1_colE6 | *Klebsiella* |
| 13 | Efs3_colM | *Enterococcus* |
| 14 | Efs7_colM | *Enterococcus* |
| 15 | E2_colE7 | *E. coli* |
| 16 | colE6 | *E. coli* (target) |
| 17 | col5 | *E. coli* (target) |
| 18 | colM | *E. coli* (target) |
| 19 | colK | *E. coli* (target) |
| 20 | colE7 | *E. coli* (target) |
| 21 | KvarM | *Klebsiella* (target) |
| 22 | Wild-type phi41S phage | *E. coli* |
| 23 | E2_col5 | *E. coli* |
| 24 | E2_KvarM | *E. coli* |
| 25 | Efs3_colE7 | *Enterococcus* |
| 26 | Efs7_colE7 | *Enterococcus* |
| 27 | K1_col5 | *Klebsiella* |
| 28 | K1-colE7 | *Klebsiella* |
| 29 | K1_colK | *Klebsiella* |
| 30 | phi41S_col5 | *E. coli* |
| 31 | phi41S_coE7 | *E. coli* |
| 32 | EC300 | *Enterococcus* (target) |
| 33 | CM001_ec300 | *E. coli* |

Graphical representation of bacteriophages engineered to encode and produce bacteriocins as genetic payloads. Graphical representation generated with BioRender.

Figure 2A:
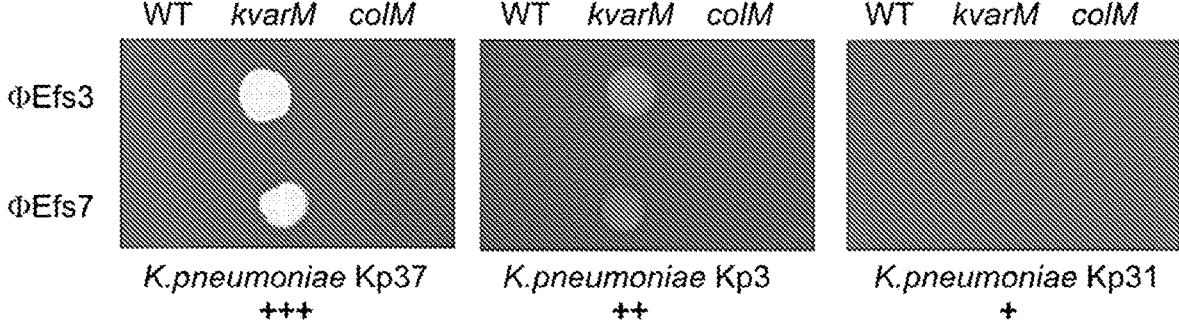

FIG. 2A-2B. Engineered phages produce active bacteriocins.

Phage lysates were spotted on bacterial lawns using the soft-agar overlay method and incubated over-night at 37° C. Growth inhibition/antibacterial effect were scored as shown in (FIG. 2A) using Klebicin M and Colicin M-producing

*Enterococcus* phages as examples. Bacteriocin production and activity on urological *E. coli* and *Klebsiella* isolates is summarized in (FIG. 2B).

Figure 3A:
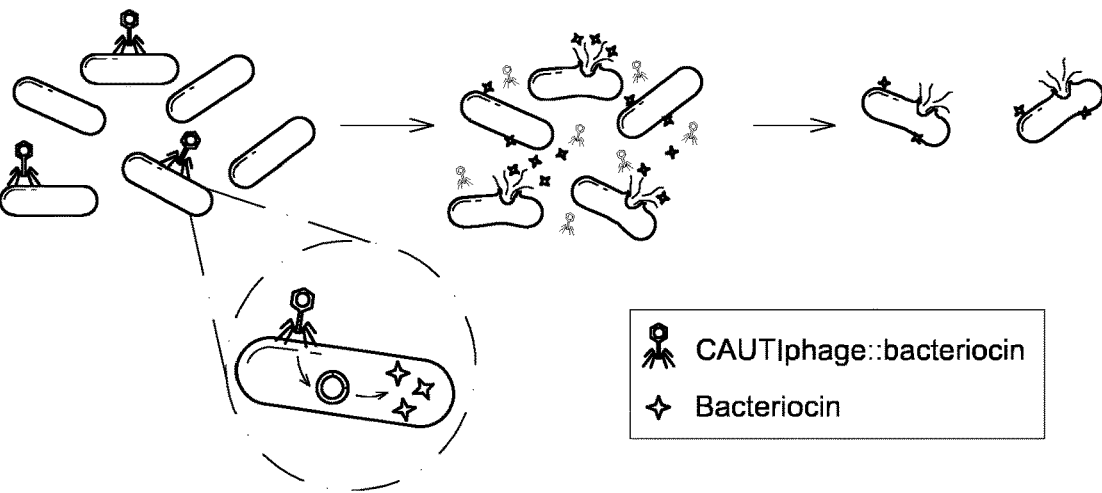
Figure 3B:
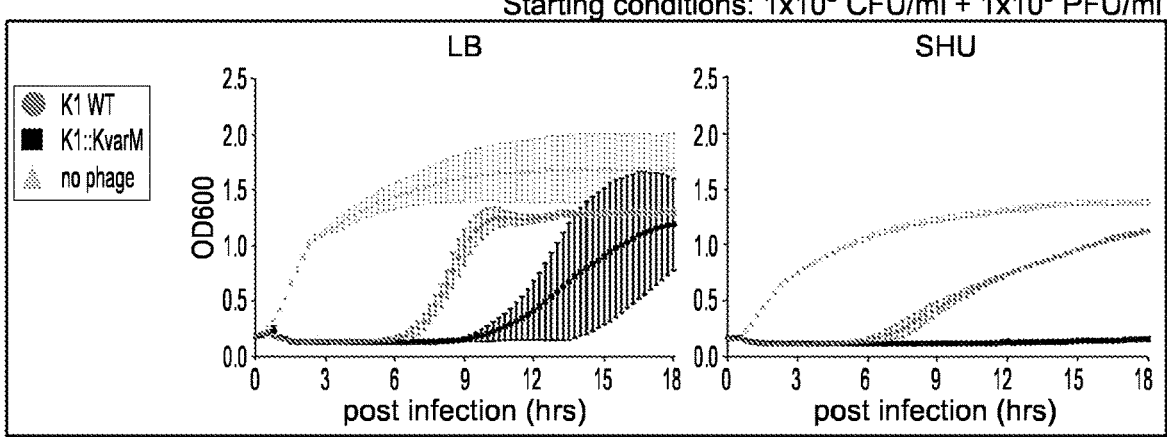
Figure 3C:
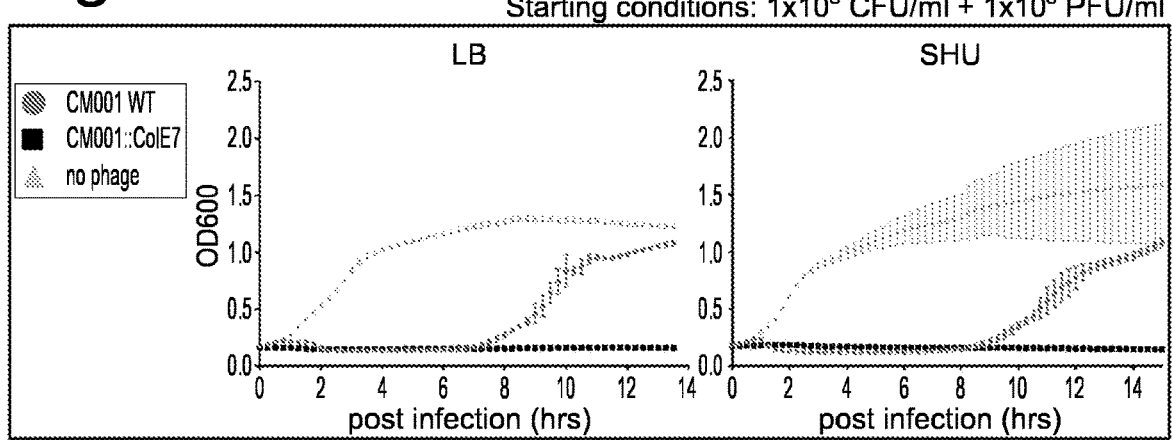

FIG. 3A, 3B, 3C. Enhanced host-killing by bacteriocin-producing phages.

(FIG. 3A) Resistant sub-populations are targeted during phage infection through the release of phage-encoded bacteriocins. While the wild type phages K1 and CM001 can only control bacterial growth for 6 to 9 hours before host cells start to overgrow the culture, the engineered Klebicin M and Colicin E7-producing bacteriophages are able to prevent or delay regrowth of *Klebsiella* (FIG. 3B) and *E. coli* (FIG. 3C) in both LB and SHU media. CFU=colony forming unit; PFU=plaque forming unit.

Figures 4A, 4B:
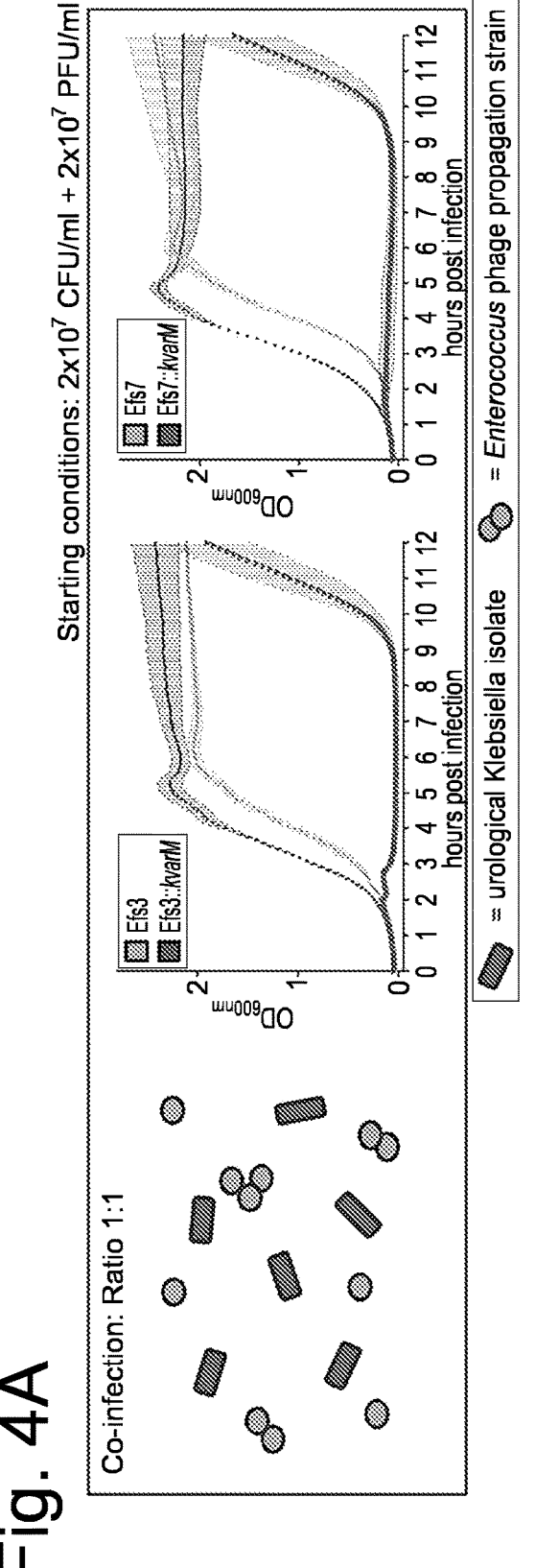

FIG. 4A-4B. Klebicin M-producing *E. faecalis* phages are able to clear *Enterococcus/Klebsiella* co-cultures.

*E. faecalis* and urological *K. pneumoniae* isolates were co-cultured at a ratio of 1:1 (FIG. 4A) or 100:1 cells (FIG. 4B), infected with wt or kvarM-encoding *Enterococcus* phages using the indicated starting conditions, and $OD_{600\ nm}$ was followed for 12 hours post infection at 30° C.

Figures 5A, 5B:
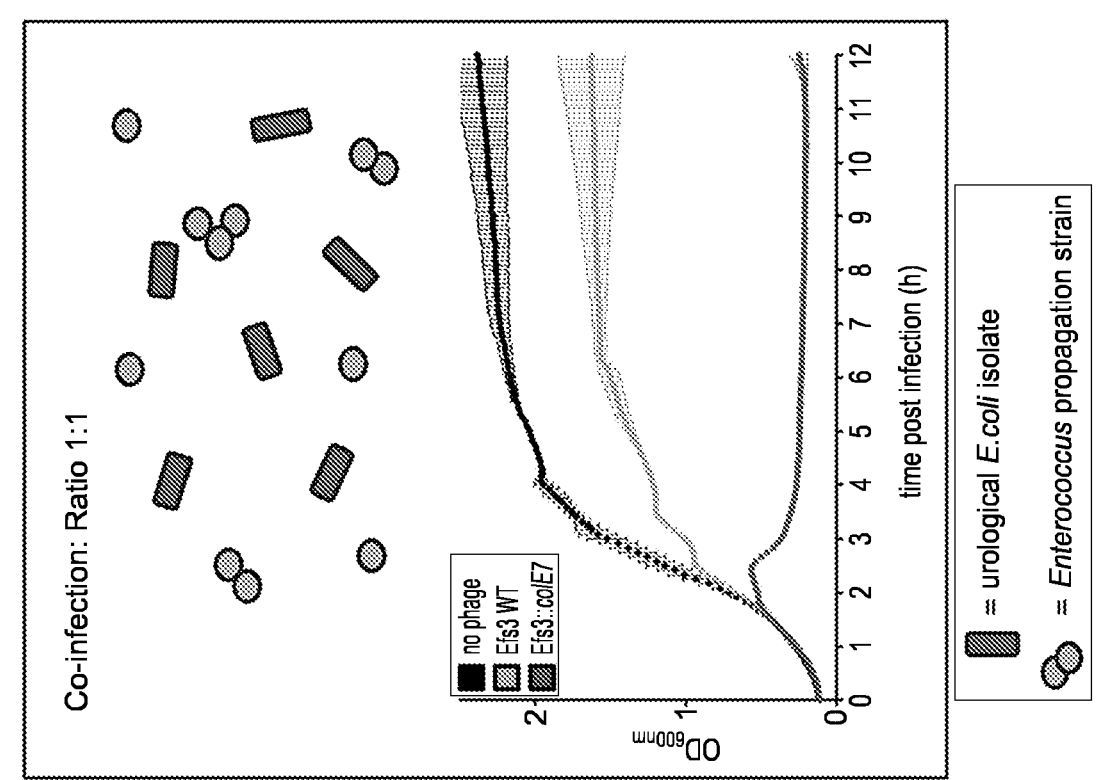

FIG. 5A-5B. Colicin E7-producing *E. faecalis* phages are able to clear *Enterococcus/E. coli* co-cultures.

*E. faecalis* and urological *E. coli* isolates were co-cultured at a ratio of 1:1 (FIG. 5A) or 10:1 cells (FIG. 5B), infected with wt or co/E7-encoding Efs3 phage, and $OD_{600\ nm}$ was followed for 12 hours post infection at 30° C.

FIG. 6A, 6B, 6C, 6D, 6E, 6F, 6G, 6H. Cross-targeting HEPTs control polymicrobial uropathogen communities.

(FIG. 6A) Heterologous effector phage therapeutics (HEPTs) enable pathogen-specific delivery and production of antimicrobial effector genes (yellow). Upon phage-induced host cell lysis, effectors are released alongside progeny virions to exert a secondary antimicrobial activity against defined bacterial targets. HEPTs were designed against the uropathogens *E. coli* (light green), *K. pneumoniae* (light purple), and *E. faecalis* (light blue).

(FIG. 6B) Five phages were employed as HEPT scaffolds to integrate colicins (M, E6, and E7; square star), klebicin M (star), or the *E. faecalis*-specific cell wall hydrolase EC300 (Pac-Man) (28) within the phage structural gene cassette.

Figure 6A:
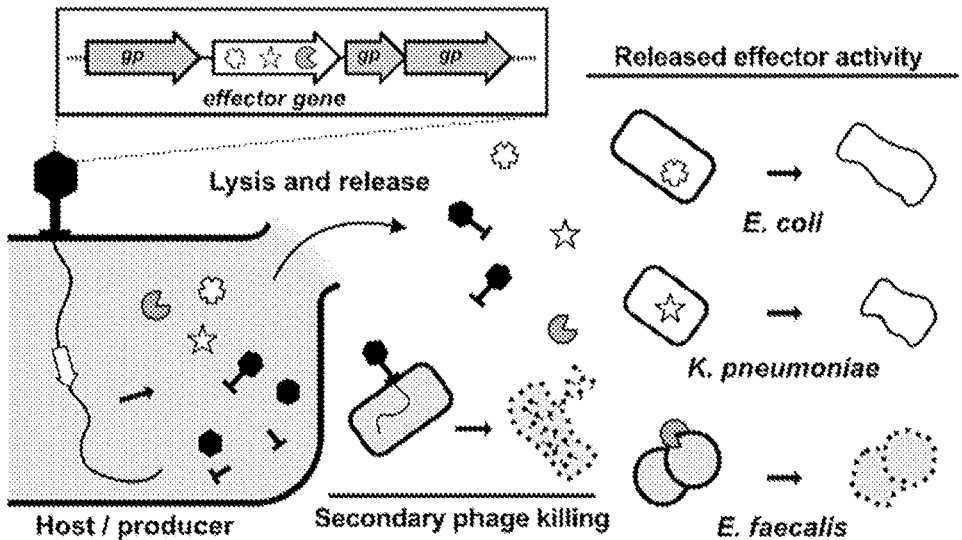
Figure 6B:
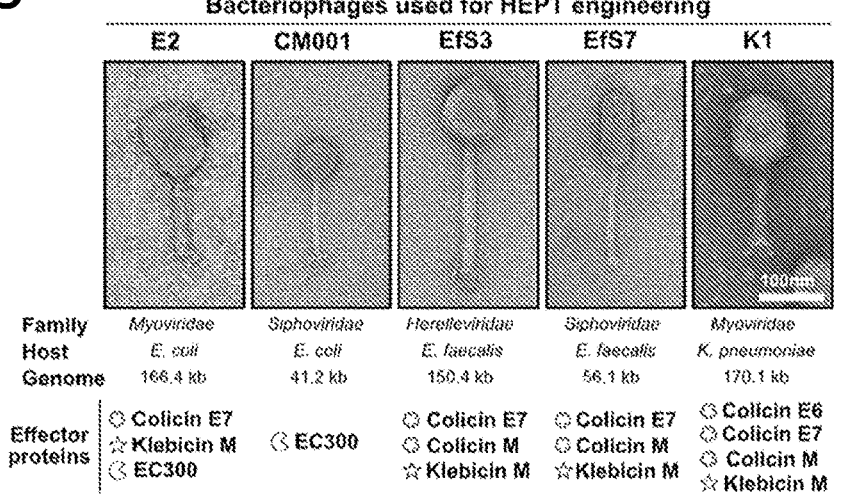
Figure 6C:
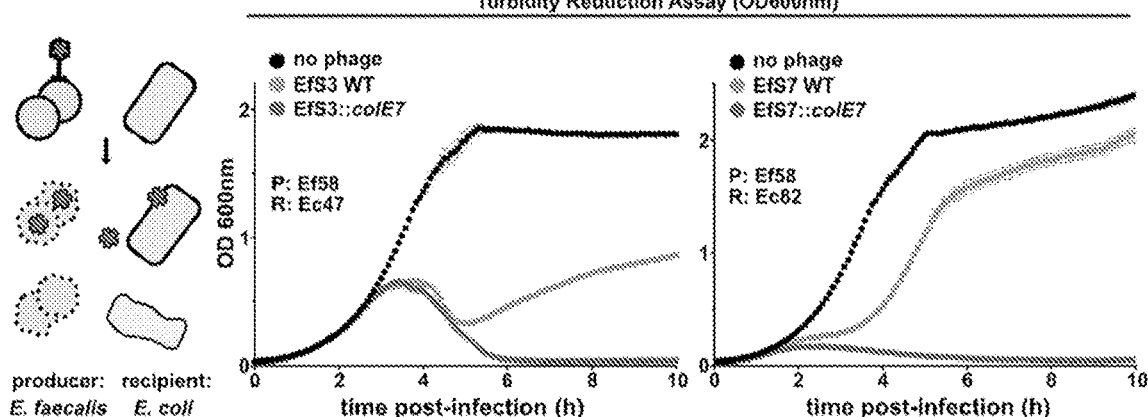
Figure 6D:
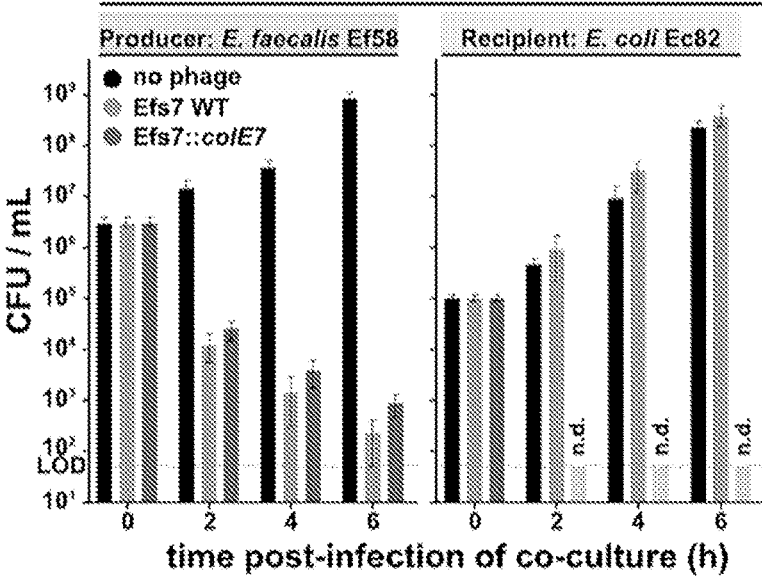
Figure 6E:
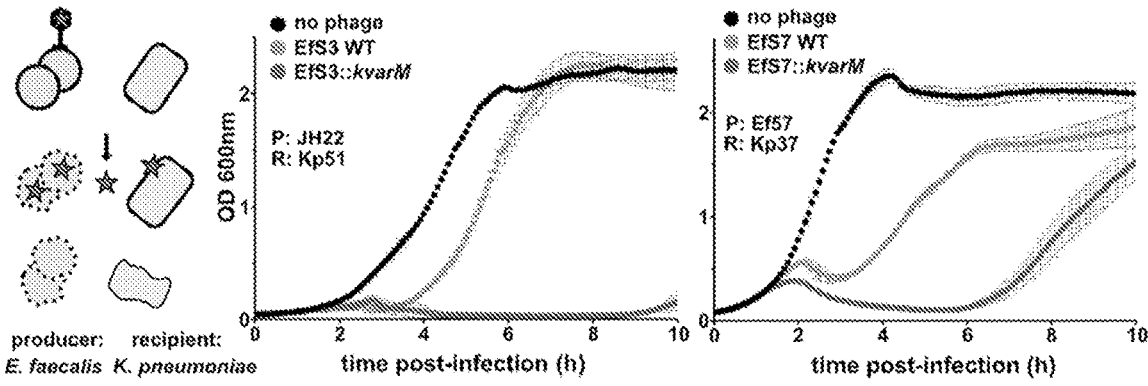
Figure 6F:
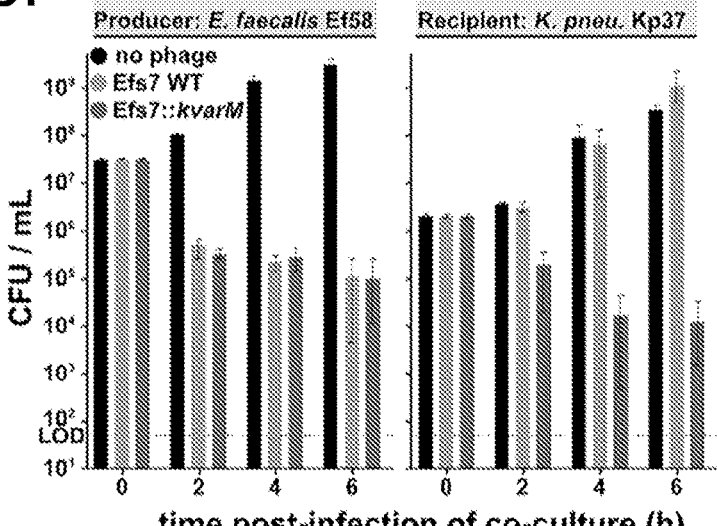
Figure 6G:
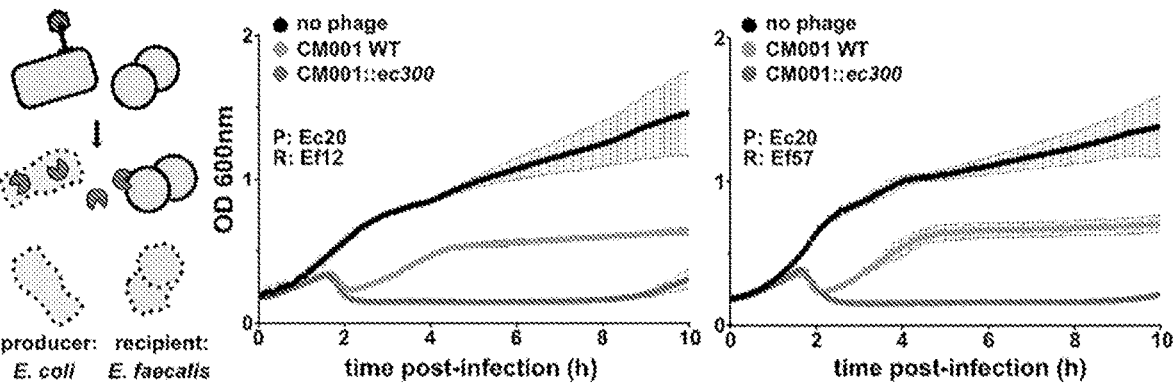
Figure 6H:
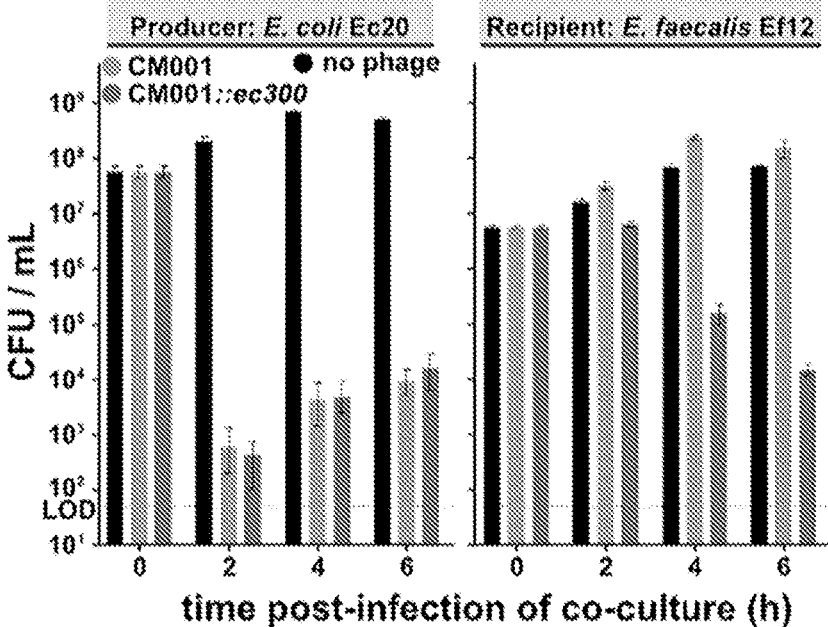

(FIG. 6C, 6D, 6E, 6F, 6G, 6H) The colour of the effector symbol matches the target organism. The antimicrobial effect of cross-targeting HEPTs was compared to their WT counterparts upon infecting co-cultures of a phage-susceptible host (P, producer) and an effector-susceptible target (R, recipient). Bacterial killing was quantified using 10 h turbidity reduction assays (FIG. 6C, FIG. 6E, FIG. 6G). 6 h time kill assays were combined with plating on differential and selective agar to enumerate different bacterial species (FIG. 6D, FIG. 6F, FIG. 6H). Strains used from the Zurich Uropathogen Collection: *E. faecalis* Ef12/57/58; *E. coli* Ec20/47/82; *K. pneumoniae* Kp37/51; gp=gene product; LOD=limit of detection; $OD_{600\ nm}$=optical density at 600 nm. Data are shown as mean±SD (n=3).

FIG. 7A-7B-7C-7D. Self-targeting HEPTs enhance killing of uropathogenic *E. coli* and *K. pneumoniae* isolates through release of colicin-like bacteriocins.

(FIG. 7A) The rapid propagation of bacteria (pink) surviving WT phage treatment (e.g., phage-resistant or tolerant subpopulations) results in a failure to control bacterial growth. Self-targeting HEPTs can prevent or delay the growth of resistant subpopulations in vitro by releasing complementary antimicrobial effectors.

(FIG. 7B) Genes encoding colicin E7 (green) or klebicin M (purple) were integrated within the structural gene cassette of phage scaffolds E2 or K1 to generate HEPTs targeting *E. coli* (E2::colE7) or *K. pneumoniae* (K1::kvarM).

(FIG. 7C-FIG. 7D) Turbidity reduction assays combined with timepoint plating (red stars) demonstrated improved antimicrobial activity (i.e., regrowth was avoided or delayed) for E2::colE7 (FIG. 7C) and K1::kvarM (FIG. 7D) compared to WT phage treatment of uropathogenic *E. coli* and *K. pneumoniae* monocultures, respectively. hoc=highly immunogenic outer capsid protein. HEPTs=heterologous effector phage therapeutics, CLB=colicin-like bacteriocin. $OD_{600\ nm}$=optical density at 600 nm. Data are shown as mean±SD (n=3).

Figure 8C:
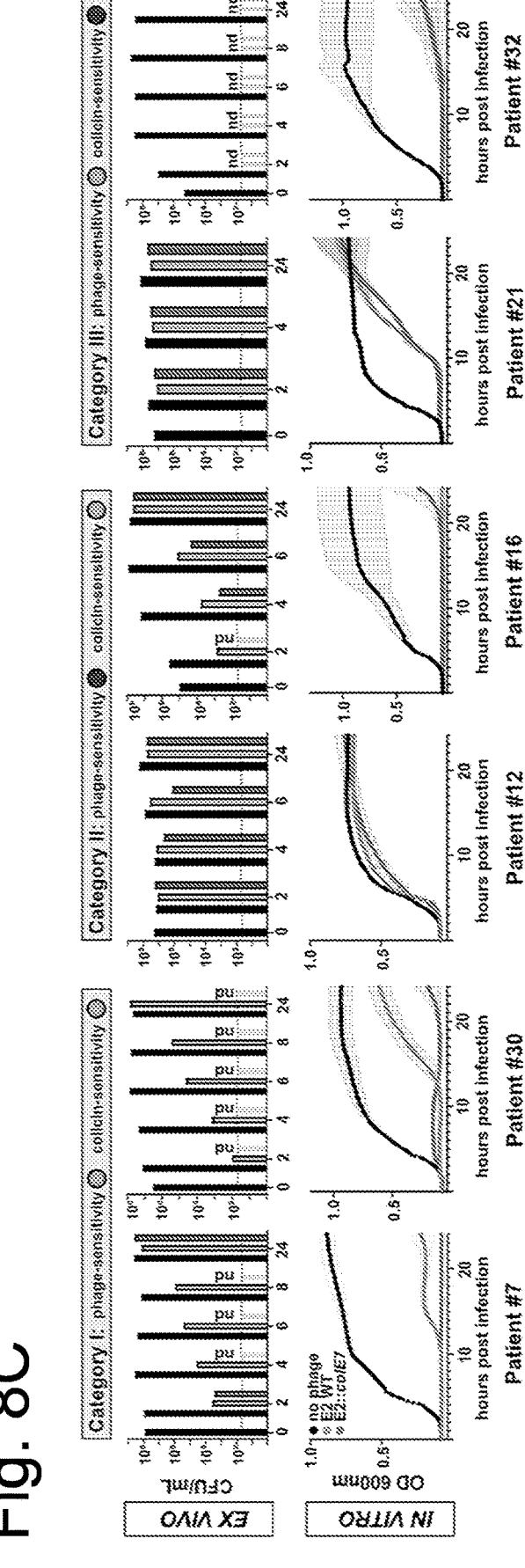

FIG. 8A-8B-8C. HEPTs provide enhanced killing of colicin-sensitive *E. coli* in patient urine. (FIG. 8A) Workflow for combining a phage-based companion diagnostic to identify potential HEPT responder patients presenting with E2-sensitive *E. coli* bacteriuria (steps 1-2) with subsequently ex vivo treatment (step 3) and in vitro assessment (step 4) of positive urine specimens using E2 WT or E2::colE7.

(FIG. 8B) Patient urine samples (n=39) were subjected to a bioluminescence-based (E2::nluc) reporter phage assay (3) to identify E2-sensitive *E. coli* in the urine within 4.5 h (3). Urine was plated on differential agar to isolate patient strains and enumerate overall bacterial load. *E. coli* isolates were further tested in vitro for E2 sensitivity (plaque formation) and colicin E7 sensitivity (detailed results provided in FIG. 13) and categorized: Category I=phage and colicin sensitive; Category II=phage-resistant, colicin-sensitive; Category III=phage-sensitive, colicin-resistant.

(FIG. 8C) Time kill assays were used to assess ex vivo treatment using $10^9$ PFU/mL E2 or E2::colE7 added to fresh urine for 24 h at 37° C. A similar HEPT treatment was performed in vitro on patient isolates grown in SHU with bacterial killing measured using turbidity reduction assays. $OD_{600\ nm}$=optical density at 600 nm. Turbidity data is mean±SD (n=3). *, specimen #5 was excluded due to a *K. pneumoniae* polymicrobial infection.

Figure 9A:
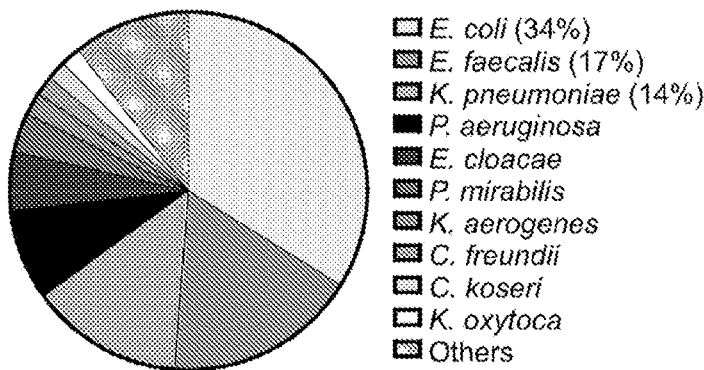
Figure 9B:
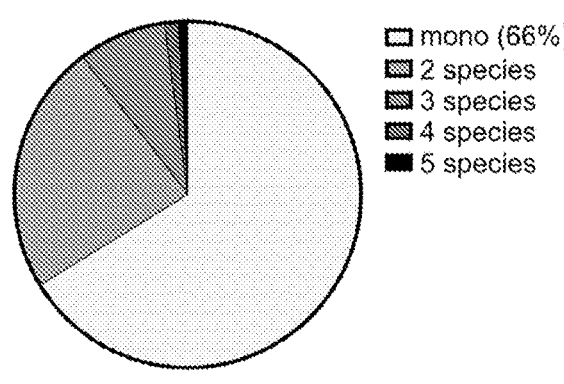
Figure 9C:
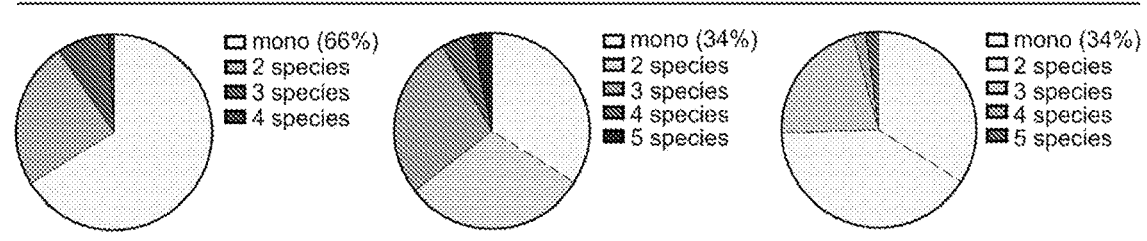

FIG. 9A-9B-9C. Analysis of UTI incidents within the Zurich Uropathogen Collection.

The Zurich Uropathogen Collection comprises 665 isolates from 461 incidents of asymptomatic bacteriuria (n=230) or UTI (n=231).

(FIG. 9A) The species distribution of 340 isolates acquired from UTI patients was determined and (FIG. 9B) the occurrence of mono- vs polymicrobial infections quantified for the corresponding UTI incidents.

(FIG. 9C) UTI incidents involving the top three uropathogens were analyzed separately to determine the top five co-infecting species and the frequency of mono- and polymicrobial UTIs.

FIG. 10. HEPT construction and assessment of payload activities. (A): Codon-optimized genes encoding for colicins (M, E6, and E7, green), klebicin M (purple), or the *E. faecalis*-specific cell wall hydrolase EC300 (blue) (8) were integrated within the structural gene cluster of the corresponding phage scaffold alongside a strong ribosomal binding site (RBS) to mediate phage promoter-driven effector expression.

(B-D): Cross-genus antimicrobial activity of crude WT phage or HEPT lysates were tested using the spot-on-the-lawn method against clinical uropathogen isolates. cps, major capsid protein; gp, gene product; hoc, highly immunogenic outer capsid protein; 168, phage K1 gene product 168; kb, kilobase; HEPTs, heterologous effector phage therapeutics.

FIG. 11A-11B. Simultaneous application of two cross- or two self-targeting HEPTs to co-cultures containing uropathogenic *E. coli* and *K. pneumoniae*.

Growing cultures of *E. coli* (Ec41) and *K. pneumoniae* (Kp37) were adjusted to $OD_{600\ nm}$ of 0.1, mixed at a ratio of 1:1, and infected with the indicated WT phages and/or HEPTs ($5\times10^7$ PFU/mL). Optical density was monitored over 18 h of infection at 30° C., followed by differential plating on chromogenic coliform agar (matching box and curve colors). Double cross-targeting with phages E2::kvarM and K1::colE7 was assessed in (FIG. 11A), while double self-targeting with phages E2::colE7 and K1::kvarM was assessed in (FIG. 11B). P, producer; R, recipient; HEPTs, heterologous effector phage therapeutics. Data is mean±SD (n=3).

Figures 12C, 12D:
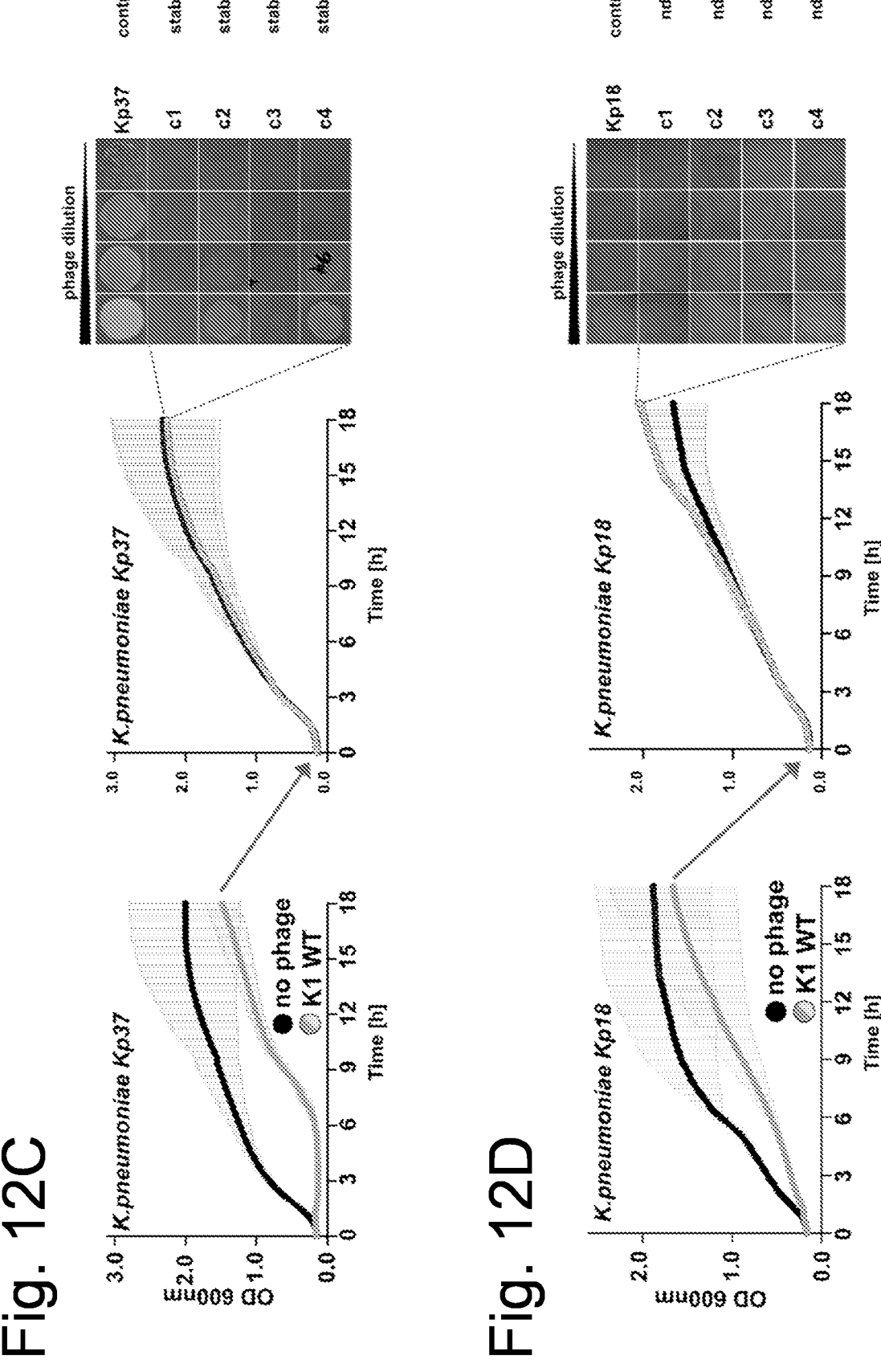
Figure 12E:
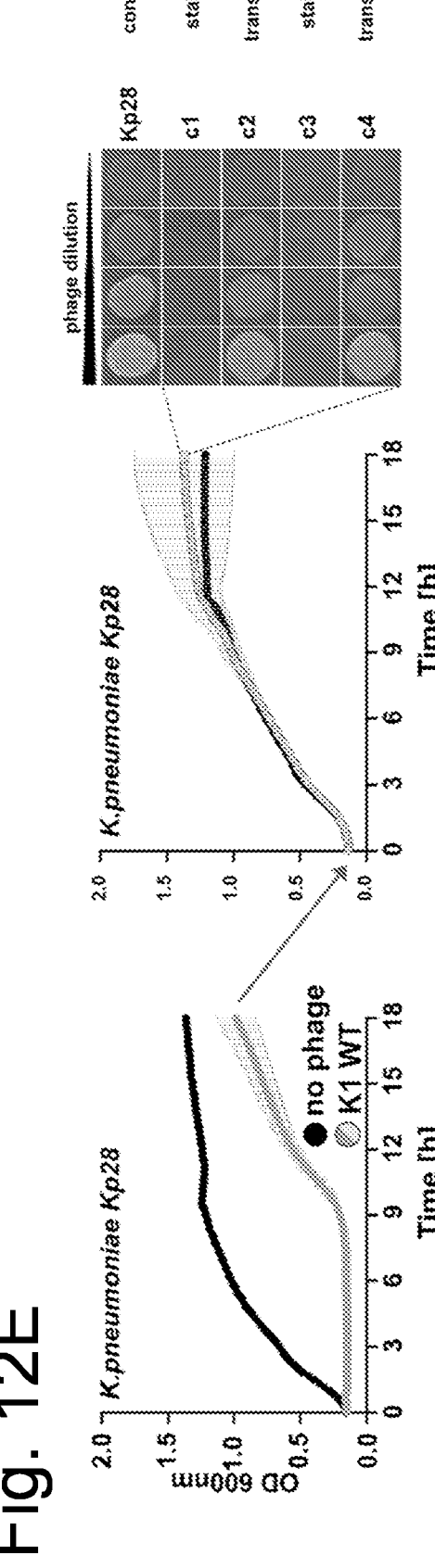

FIG. 12. Phage resistance development upon treatment of UTI isolates with wildtype E2 and K1.

Phage resistance development was assessed by two consecutive rounds of phage infection of bacterial cultures in SHU medium. Turbidity reduction assays were performed for *E. coli* isolates Ec20 (A) and Ec41 (B) or *K. pneumoniae* isolates Kp37 (C) and, Kp18 (D), and Kp28 (E) infected with $10^8$ PFU/mL of phages E2 or K1, respectively, with optical density monitored for 18 h. Phage-exposed cultures were combined (n=3), re-adjusted to $OD_{600\ nm}$ of 0.1 in SHU and incubated for another 18 h with additional wildtype (WT) phages (pink) or media alone (black). Growth kinetics were compared to non-infected controls. After the second round of infection, individual clonal survivors were isolated (three rounds of colony purification) and assessed for phage susceptibility using spot-on-the-lawn assays. Turbidity data is mean±SD (n=3). nd=not determined.

Figure 13A:
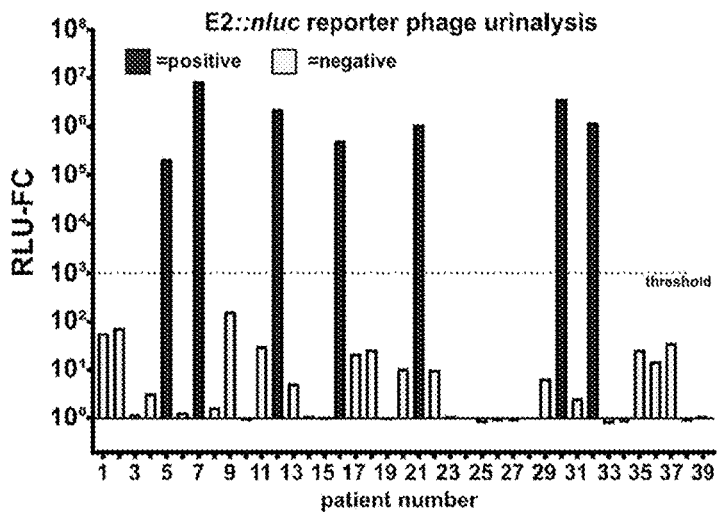
Figure 13B:
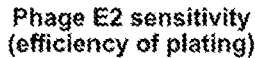
Figure 13C:
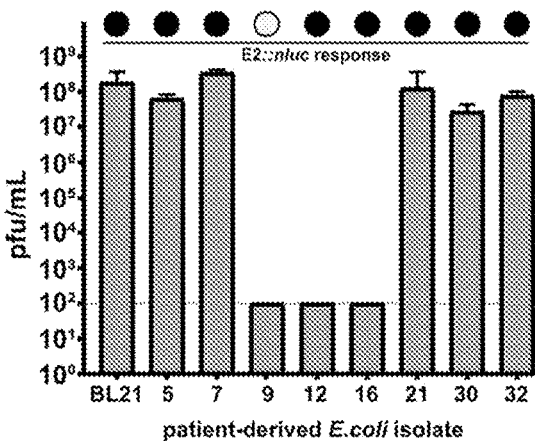
Figure 14A:
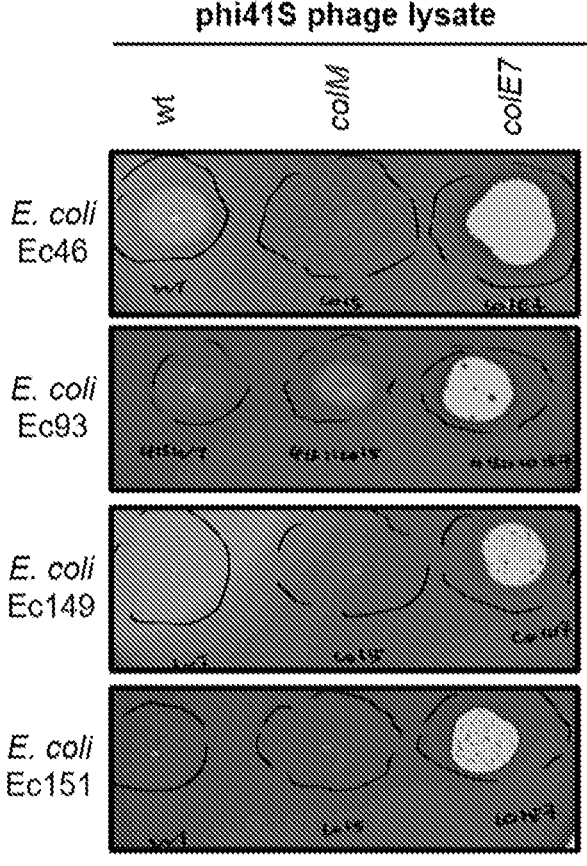
Figure 14B:
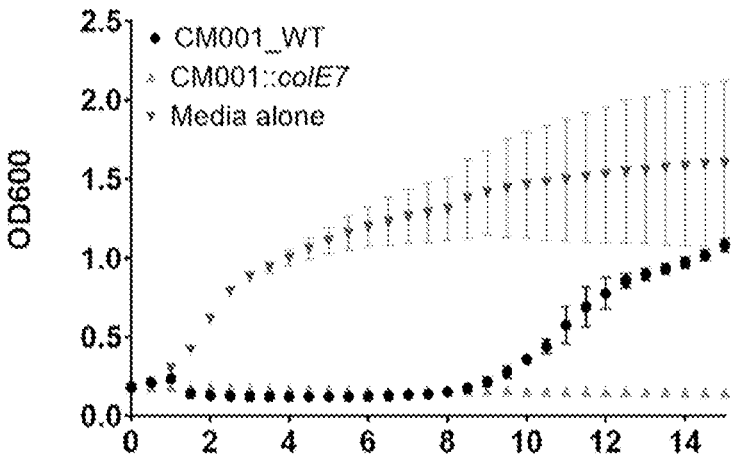

FIG. 13A-13B-13C. Reporter phage-based urinalysis of patient urine samples with phage and colicin E7 susceptibility screening of isolated, patient-derived *E. coli* strains.

(FIG. 13A) Reporter phage urinalysis was performed using 39 fresh patient urine samples from the Balgrist University Hospital, Zurich, Switzerland, as described in the Materials and Methods and in (1). The fold change (compared to media alone) in relative light units (RLU-FC) was determined at 3 hours post-infection with urine samples producing values $>10^3$ considered as positive samples, i.e., containing E2-susceptible *E. coli*.

(FIG. 13B) All *E. coli* strains were isolated and purified from patient urine after differential plating, and E2-susceptibility quantified using plaque assays (efficiency of plating).

(FIG. 13C) Colicin E7 effector susceptibility was determined on patient-derived *E. coli* strains by spotting K1 WT or K1::colE7 phage lysates.

FIG. 14A-14B-14C-14D-14E. Spot assays and turbidity reduction assays of additional self-targeting HEPTs.

(FIG. 14A) Activity of phi41S wildtype and phi41S-derived HEPTS that produce colicin M (phi41S::colM) or colicin E7 (phi41S::colE7) was assessed by spot-on-the-lawn assays. In short, crude phage lysates were generated by infection of the phi41S propagation host (*E. coli* Ec20) to produce semi-confluent lysis on agar plates. Phages (and produced bacteriocin payload) were extracted with 5 mL SM buffer (2 h, 4° C.) and sterile filtered (0.22 mM). Resulting lysates were spotted on growing bacteria lawns (grey) of the indicated strains. Activity of phage and/or payload is visualized through reduced turbidity on the spot-area. Wildtype phage lysates served as a control. (FIG. 14B-14C-14D-14E) Turbidity reduction assays were performed with the indicated self-targeting HEPTs and wildtype phage controls. Bacterial cultures were diluted to $5\times10^7$ CFU/mL in synthetic human urine (SHU) and infected with $5\times10^7$ PFU/mL of the indicated phage in 96-well plates at 37° C. and the optical density at 600 nm (OD600) was monitored over time. Uninfected bacterial cultures served as a growth control (Media alone). Data is mean±SD. All *E. coli* strains are clinical isolates from the Zurich Uropathogen Collection. co/M=colicin M gene; colE7=colicin E7 gene; col5=colicin 5 gene.

Figure 15A:
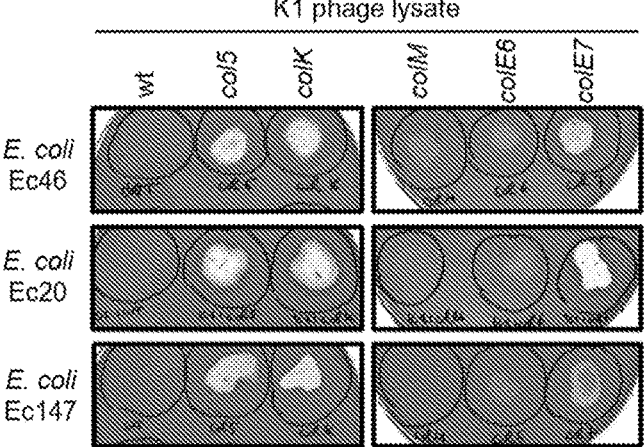
Figure 15B:
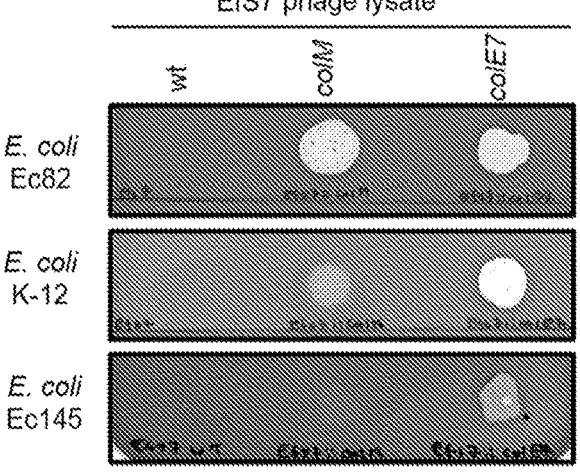
Figure 15C:
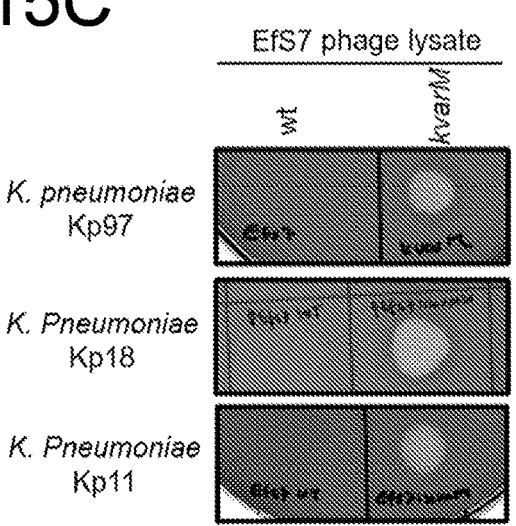

FIG. 15A-15B-15C. Spot assays of additional cross-genus targeting HEPTs. Activity of engineered HEPTs producing bacteriocins with cross-genus activity was assessed by spot-on-the-lawn assays. In short, crude phage lysates were generated by infection of the propagation host to produce semi-confluent lysis on agar plates. Phages (and produced bacteriocin payload) were extracted with 5 mL SM buffer (2 h, 4° C.) and sterile filtered (0.22 mM). Resulting lysates were spotted on growing bacteria lawns (grey) of the indicated strains. Activity of payload is visualized through reduced turbidity on the spot-area. Wildtype phage lysates served as a control. FIG. 15A Bacteriocin activity of lysates from *K. pneumoniae* phages K1 wildtype, K1::col5, K1::colK, K1::colE6, and K1::colE7 on several clinical *E. coli* isolates. (FIG. 15B. FIG. 15C) Bacteriocin activity of lysates from *E. faecalis* phages EfS7 wildtype, EfS7::co/M, EfS7::co/E7, and EfS7::kvarM on several clinical *E. coli* or *K. pneumoniae* isolates. col5=colicin 5 gene; colK=colicin K gene; colM=colicin M gene; colE6=colicin E6 gene; colE7=colicin E7 gene, kvarM=klebicin M gene. Except for *E. coli* K-12, all tested strains are from the Zurich Uropathogen Collection.

DEFINITIONS

"Sequence identity" is herein defined as a relationship between two or more amino acid (peptide, polypeptide, or protein) sequences or two or more nucleic acid (nucleotide, polynucleotide) sequences, as determined by comparing the sequences. In the art, "identity" also means the degree of sequence relatedness between amino acid or nucleotide sequences, as the case may be, as determined by the match between strings of such sequences. "Similarity" between two amino acid sequences is determined by comparing the amino acid sequence and its conserved amino acid substitutes of one peptide or polypeptide to the sequence of a second peptide or polypeptide. In a preferred embodiment, identity or similarity is calculated over the whole SEQ ID NO as identified herein. "Identity" and "similarity" can be readily calculated by known methods, including but not limited to those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heine, G., Academic Press, 1987; and Sequence Analysis Primer, Gribskov, M. and Devereux, J., eds., M Stockton Press, New York, 1991; and Carillo, H., and Lipman, D., SIAM J. Applied Math., 48:1073 (1988).

Preferred methods to determine identity are designed to give the largest match between the sequences tested. Methods to determine identity and similarity are codified in publicly available computer programs. Preferred computer program methods to determine identity and similarity between two sequences include e.g. the GCG program package (Devereux, J., et al., Nucleic Acids Research 12 (1): 387 (1984)), BestFit, BLASTP, BLASTN, and FASTA (Altschul, S. F. et al., J. Mol. Biol. 215:403-410 (1990). The BLAST X program is publicly available from NCBI and other sources (BLAST Manual, Altschul, S., et al., NCBI NLM NIH Bethesda, MD 20894; Altschul, S., et al., J. Mol. Biol. 215:403-410 (1990). The well-known Smith Waterman algorithm may also be used to determine identity.

Preferred parameters for polypeptide sequence comparison include the following: Algorithm: Needleman and Wunsch, J. Mol. Biol. 48:443-453 (1970); Comparison matrix: BLOSUM62 from Hentikoff and Hentikoff, Proc. Natl. Acad. Sci. USA. 89:10915-10919 (1992); Gap Penalty: 12; and Gap Length Penalty: 4. A program useful with these parameters is publicly available as the "Ogap" program from Genetics Computer Group, located in Madison, WI. The aforementioned parameters are the default parameters for amino acid comparisons (along with no penalty for end gaps).

Preferred parameters for nucleic acid comparison include the following: Algorithm: Needleman and Wunsch, J. Mol. Biol. 48:443-453 (1970); Comparison matrix: matches=+10, mismatch=0; Gap Penalty: 50; Gap Length Penalty: 3. Available as the Gap program from Genetics Computer Group, located in Madison, Wis. Given above are the default parameters for nucleic acid comparisons.

Optionally, in determining the degree of amino acid similarity, the skilled person may also take into account so-called "conservative" amino acid substitutions, as will be clear to the skilled person. Conservative amino acid substitutions refer to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulphur-containing side chains is cysteine and methionine. Preferred conservative amino acids substitution groups are: valine-leucine-isoleucine, phenylalanine-tyrosine, lysine-arginine, alanine-valine, and asparagine-glutamine. Substitutional variants of the amino acid sequence disclosed herein are those in which at least one residue in the disclosed sequences has been removed and a different residue inserted in its place. Preferably, the amino acid change is conservative. Preferred conservative substitutions for each of the naturally occurring amino acids are as follows: Ala to ser; Arg to lys; Asn to gln or his; Asp to glu; Cys to ser or ala; Gln to asn; Glu to asp; Gly to pro; His to asn or gln; Ile to leu or val; Leu to ile or val; Lys to arg; gln or glu; Met to leu or ile; Phe to met, leu or tyr; Ser to thr; Thr to ser; Trp to tyr; Tyr to trp or phe; and, Val to ile or leu.

A "nucleic acid molecule" or "polynucleotide" (the terms are used interchangeably herein) is represented by a nucleotide sequence. A "polypeptide" is represented by an amino acid sequence. A "nucleic acid construct" is defined as a nucleic acid molecule which is isolated from a naturally occurring gene or which has been modified to contain segments of nucleic acids which are combined or juxtaposed in a manner which would not otherwise exist in nature. A nucleic acid molecule is represented by a nucleotide sequence. Optionally, a nucleotide sequence present in a nucleic acid construct is operably linked to one or more control sequences, which direct the production or expression of said peptide or polypeptide in a cell or in a subject.

"Operably linked" is defined herein as a configuration in which a control sequence is appropriately placed at a position relative to the nucleotide sequence coding for the polypeptide of the invention such that the control sequence directs the production/expression of the peptide or polypeptide of the invention in a cell and/or in a subject. "Operably linked" may also be used for defining a configuration in which a sequence is appropriately placed at a position relative to another sequence coding for a functional domain such that a chimeric polypeptide is encoded in a cell and/or in a subject.

"Expression" is construed as to include any step involved in the production of the peptide or polypeptide including, but not limited to, transcription, post-transcriptional modification, translation, post-translational modification and secretion.

A "control sequence" is defined herein to include all components which are necessary or advantageous for the expression of a polypeptide. At a minimum, the control sequences include a promoter and transcriptional and translational stop signals. Optionally, a promoter represented by a nucleotide sequence present in a nucleic acid construct is operably linked to another nucleotide sequence encoding a peptide or polypeptide as identified herein.

The term "transformation" refers to a permanent or transient genetic change induced in a cell following the incorporation of new DNA (i.e. DNA exogenous to the cell). When the cell is a bacterial cell, as is intended in the present invention, the term usually refers to an extrachromosomal, self-replicating vector which harbors a selectable antibiotic resistance.

An "expression vector" may be any vector which can be conveniently subjected to recombinant DNA procedures and can bring about the expression of a nucleotide sequence encoding a polypeptide of the invention in a cell and/or in a subject. As used herein, the term "promoter" refers to a nucleic acid fragment that functions to control the transcription of one or more genes or nucleic acids, located upstream with respect to the direction of transcription of the transcription initiation site of the gene. It is related to the binding site identified by the presence of a binding site for DNA-dependent RNA polymerase, transcription initiation sites, and any other DNA sequences, including, but not limited to, transcription factor binding sites, repressor and activator protein binding sites, and any other sequences of nucleotides known to one skilled in the art to act directly or indirectly to regulate the amount of transcription from the promoter. Within the context of the invention, a promoter preferably ends at nucleotide −1 of the transcription start site (TSS).

A "polypeptide" as used herein refers to any peptide, oligopeptide, polypeptide, gene product, expression product, or protein. A polypeptide is comprised of consecutive amino acids. The term "polypeptide" encompasses naturally occurring or synthetic molecules.

The sequence information as provided herein should not be so narrowly construed as to require inclusion of erroneously identified bases. The skilled person is capable of identifying such erroneously identified bases and knows how to correct for such errors.

Sequence identity herein of a polynucleotide, polynucleotide construct or of a polypeptide is preferably at least 50%. Preferably at least 50% is defined as preferably at least 50%, more preferably at least 51%, more preferably at least 52%, more preferably at least 53%, more preferably at least 54%, more preferably at least 55%, more preferably at least 56%, more preferably at least 57%, more preferably at least 58%, more preferably at least 59%, more preferably at least 60%, more preferably at least 61%, more preferably at least 62%, more preferably at least 63%, more preferably at least 64%, more preferably at least 65%, more preferably at least 66%, more preferably at least 67%, more preferably at least 68%, more preferably at least 69%, more preferably at least 70%, more preferably at least 71%, more preferably at least 72%, more preferably at least 73%, more preferably at least 74%, more preferably at least 75%, more preferably at least 76%, more preferably at least 77%, more preferably at least 78%, more preferably at least 79%, more preferably at least 80%, more preferably at least 81%, more preferably at least 82%, more preferably at least 83%, more preferably at least 84%, more preferably at least 85%, more preferably at least 86%, more preferably at least 87%, more preferably at least 88%, more preferably at least 89%, more preferably at least 90%, more preferably at least 91%, at least 92%, at least 93%, at least 94%, at least 95%, at least 96%, at least 97%, more preferably at least 98%, more preferably at least 99%, or most preferably 100% sequence identity. In case of 100% sequence identity, the polynucleotide or polypeptide has exactly the sequence of the depicted SEQ ID NO. Sequence identity is preferably determined over the entire length of the subject sequence.

In this document and in its claims, the verb "to comprise" and its conjugations is used in its non-limiting sense to mean that items following the word are included, but items not specifically mentioned are not excluded. In addition the verb "to consist" may be replaced by "to consist essentially of" meaning that a product or a composition or a nucleic acid molecule or a peptide or polypeptide of a nucleic acid construct or vector or cell as defined herein may comprise additional component(s) than the ones specifically identified; said additional component(s) not altering the unique characteristic of the invention. In addition, reference to an element by the indefinite article "a" or "an" does not exclude the possibility that more than one of the elements is present, unless the context clearly requires that there be one and only one of the elements. The indefinite article "a" or "an" thus usually means "at least one". The word "about" or "approximately" when used in association with a numerical value (e.g. about 10) preferably means that the value may be the given value (of 10) more or less 10% of the value.

All patent and literature references cited in the present specification are hereby incorporated by reference in their entirety.

Unless otherwise indicated each embodiment as described herein may be combined with another embodiment as described herein.

The following examples are offered for illustrative purposes only, and are not intended to limit the scope of the present invention in any way.

Further Embodiments

Further embodiments of the invention are listed here below.

1. A modified bacteriophage capable of infecting a host bacterium, wherein the bacteriophage comprises a gene that is foreign to the bacteriophage and wherein said gene encodes a bacteriocin.
2. A modified bacteriophage according to embodiment 1, wherein the bacteriocin is a bacteriocin specific for Gram-negative bacteria, such as a microcin, a colicin-like bacteriocin or a tailocin.
3. A modified bacteriophage according to embodiment 1, wherein the bacteriocin is a bacteriocin specific for Gram-positive bacteria, such as class III bacteriocins.

4. A modified bacteriophage according to any one of the preceding embodiments, wherein the bacteriocin targets species of the host bacterium.

5. A modified bacteriophage according to any one of the preceding embodiments, wherein the bacteriocin does not target species of the host bacterium.

6. A modified bacteriophage according to any one of the preceding claims, wherein the bacteriocin has a protein sequence that can be classified into an InterPro homologous superfamily, family, or domain selected from the group consisting of: IPR036725, IPR037146, IPR038283, IPR036302, IPR024575, IPR028056, IPR000293, IPR009105, IPR024566, and IPR016128.

7. A modified bacteriophage according to any one of the preceding embodiments, wherein the bacteriocin is selected from the group consisting of Colicin M, Colicin E7, Colicin K, Colicin 5, Colicin E6 and Klebicin M, or wherein the bacteriocin has preferably at least 50% sequence identity with a bacteriocin selected from the group consisting of Colicin M (SEQ ID NO: 18), Colicin E7 (SEQ ID NO: 20), Colicin K (SEQ ID NO: 19), Colicin 5 (SEQ ID NO: 17), Colicin E6 (SEQ ID NO: 16) and Klebicin M (SEQ ID NO: 21) and/or is a variant bacteriocin that has different properties compared to the corresponding wild-type bacteriocin and has altered host specificity or altered specific activity.

8. A modified bacteriophage according to any of the preceding embodiments, wherein the host bacterium is selected from the group consisting of: *Acetinobacter, Chroinobacter, Bortadella, Burkholderia, Campylobacter, Staphylococcus, Pneumococcus, Enterococcus, Klebsiella, Escherichia, Pseudomonas, Salmonella, Shigella, Vibrio, Neisseria, Brucella, Haemophilus, Mycobacterium, Listeria, Legionella, Yersinia, Chlamydia, Clostridium, Helicobacter, Corynebacterium, Lactobacillus, Fusobacterium*, and *Streptococcus*.

9. A modified bacteriophage according to any one of the preceding embodiments, wherein the host bacterium is an *E. coli* species and wherein the bacteriocin targets said *E. coli* species.

10. A modified bacteriophage according to any one of the preceding embodiments, wherein the host bacterium is an *E. coli* species and wherein the bacteriocin does not target said *E. coli* species.

11. A modified bacteriophage according to any one of the preceding embodiments, wherein the host bacterium is an *Enterococcus* species, such as *Enterococcus faecalis*, and wherein the bacteriocin targets said *Enterococcus* species.

12. A modified bacteriophage according to any one of the preceding embodiments, wherein the host bacterium is an *Enterococcus* species, such as *Enterococcus faecalis*, and wherein the bacteriocin does not target said *Enterococcus* species.

13. A modified bacteriophage according to any one of the preceding embodiments, wherein the host bacterium is a *Klebsiella* species, such as *Klebsiella pneumoniae*, and wherein the bacteriocin targets said *Klebsiella* species.

14. A modified bacteriophage according to any one of the preceding embodiments, wherein the host bacterium is a *Klebsiella* species, such as *Klebsiella pneumoniae*, and wherein the bacteriocin does not target said *Klebsiella* species.

15. A modified bacteriophage according to any one of the preceding embodiments, wherein the bacteriophage is derived from wild-type bacteriophage *Klebsiella* phage K1, *E. coli* phage CM001, *E. coli* phage E2, *Enterococcus* phage Efs3, *Enterococcus* phage Efs7 or from *E. coli* phage phi41S.

16. A composition comprising a carrier and a modified bacteriophage as defined in any one of embodiments 1 to 15.

17. A composition according to embodiment 17, wherein the composition is a pharmaceutical composition.

18. A composition according to embodiment 16 or 17, wherein the composition is formulated for topical, intravenous, intramuscular, intrathecal, oral, intraperitoneal, vaginal, rectal, lumbar, or meningeal administration.

19. Use of a modified bacteriophage according to any one of embodiments 1 to 15 or of a composition according to any one of embodiments 16 to 18 for in vitro or ex vivo antibacterial decontamination.

20. A modified bacteriophage according to any one of embodiments 1 to 15 or of a composition according to any one of embodiments 16 to 18 for use as a medicament for the treatment of a bacterial infection in a subject in need thereof.

21. Use of a modified bacteriophage according to any one of embodiments 1 to 15 or of a composition according to any one of embodiments 16 to 18, for the production of a medicament for the treatment of a bacterial infection in a subject in need thereof.

22. A method of treatment of a bacterial infection in a subject in need thereof, comprising administration of a therapeutically effective amount of a modified bacteriophage according to any one of embodiments 1 to 15 or of a composition according to any one of embodiments 16 to 18 to the subject, thereby treating the bacterial infection.

23. A method of altering the microbial composition of a microbiome, comprising introducing a modified bacteriophage according to any one of embodiments 1 to 15 or of a composition according to any one of embodiments 16 to 18 into the microbiome.

24. Use of a modified bacteriophage according to any one of embodiments 1 to 15 or of a composition according to any one of embodiments 16 to 18 for in vitro or ex vivo detection of a bacterial pathogen.

EXAMPLES

Example 1: Phages Carrying Active Bacteriocin Payloads

Introduction

Figure 1:
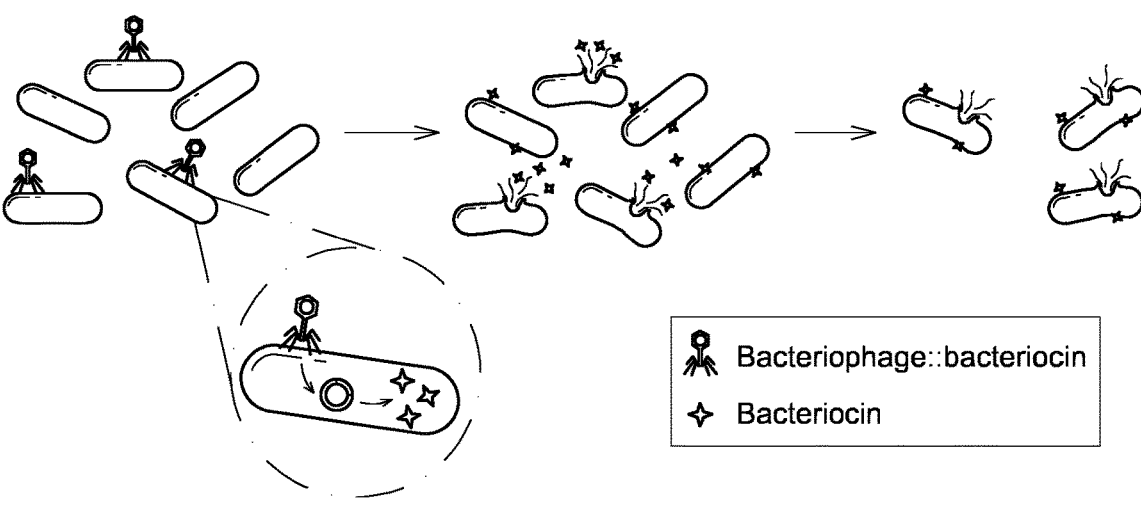
FIG. 1. Graphical representation

The antibiotic resistance crisis and adverse effects caused by antibiotic-induced microbiome dysbiosis highlight the need for novel and more pathogen-specific antibacterial interventions. The therapeutic use of bacteriophages/phages (i.e., viruses that infect bacteria) is one promising alternative option. While phages offer the required pathogen-specificity, it remains difficult to completely inactivate all cells from a population of target cells. This is due to the evolution of effective phage resistance mechanisms such as receptor diversification, adaptive CRISPR-Cas immunity, restriction/modification, or abortive infection that bacteria use to counteract phage predation. To circumvent this limitation, multiple phages with distinct infection pathways are typically combined to replace or complement antibiotic therapy. Here, we demonstrate how individual phages can be engineered to encode bacteriocins as genetic payloads; a graphical representation is depicted in FIG. 1. Heterologous bacteriocins, i.e. bacteriocins that are foreign to the bacteriophage, are expressed during infection and released upon host cell lysis to locally improve and expand the antibacterial effect of their wild type parental phage. Bacteriocins may act on the same strain or species to target resistant sub-populations and other survivors of phage infection. Alternatively, bacteriocins may be produced by one species in a poly-microbial infection and released to target a second pathogen. To demonstrate these concepts, we engineered virulent phages targeting *E. coli, Klebsiella,* and *Enterococcus* to produce the bacteriocins Colicin M, Colicin E7, or KlebicinM. These phages control their target pathogens with higher efficacy, prevent to amplification of resistant sub-populations during prolonged treatment, and enable cross-genus targeting to control polymicrobial populations.

Results and Discussion

Colicin- and Klebicin-Encoding Phages Produce Active Bacteriocin Payloads During Infection Bacteriophages that infect *Klebsiella* (phage K1), *E. coli* (phage CM001), or *Enterococcus* (phages Efs3 and Efs7) were engineered to encode bacteriocin genes within the late gene cluster where their expression is driven from strong late viral promoters. The genome sequences are presented in the sequence listing part of this application; an overview of the sequences is given in Table 1. Ribosomal binding sites were inserted immediately upstream of each bacteriocin gene to ensure efficient translation initiation. To test phage-mediated bacteriocin expression, bacterial host cells were infected using the soft-agar overlay method to produce unpurified high-titer lysates containing progeny phage and any expressed viral and bacterial gene (including bacteriocin). Lysates were sterile-filtered and tested for antibacterial effect by spotting on bacterial lawns (FIG. 2). The antibacterial effects were judged visually (−,+,++,+++) as shown in FIG. 2A and compared on a selection of 26 clinical *E. coli* and 24 clinical *Klebsiella* isolates (FIG. 2B). It was demonstrated that our modified, recombinant, phages produce active bacteriocin payloads with varying activity range on urological isolates. So far, Colicin E7 (co/E7) and Klebicin M (kvarM) were identified as the bacteriocins with excellent activity profiles. Testing of more bacteriocins in various phages is ongoing, such as Colicin E7 in *E. coli* phage E2, which also demonstrates a good activity profile.

Bacteriocin Production Enhances Killing of Phage Susceptible Target Populations

In prolonged liquid infection assays, most phages cannot efficiently control their bacterial host resulting in bacterial outgrowth. This is due to the presence of phage-resistant subpopulations, whose resistance phenotype can be genetic or transient. Bacteriocin-producing phages may enable killing of such resistant sub-populations and therefore enhance the antibacterial effect of their wild-type counterparts (FIG. 3A). Here, we compared host killing of wild-type and engineered phages using 12-18 h liquid infection assays in LB or synthetic human urine medium (SHU) (FIGS. 3B/C). Bacterial growth or killing was visualized by reading the optical density at 600 nm. Both the Klebicin M-producing *Klebsiella* phage K1 (K1:kvarM) and the Colicin E7-producing *E. coli* phage CM001 (CM001::colE7) resulted in killing and long-term suppression of bacterial growth, whereas the wild-type parental phages could only control bacterial growth for 8-10 hours. This data demonstrates the superior killing of phage susceptible-host populations by bacteriocin-producing bacteriophages; complete sterilization can be achieved.

Bacteriocin Production Enables Cross-Genus Targeting

Many bacterial infections can be caused by or be associated with the presence of multiple bacterial genera. For example, such polymicrobial infections are frequently observed within the urinary tract. The main contributors to urinary tract infections (UTIs) are *E. coli, Klebsiella,* and *Enterococcus faecalis.* To mimic the application of engineered, bacteriocin-producing phages for the control of polymicrobial UTIs, we co-cultivated *E. faecalis* either with a urological *Klebsiella* isolate (FIGS. 4A/B) or with a urological *E. coli* isolate (FIGS. 5A/B). These co-cultures were subsequently infected with wild-type *Enterococcus* phages or with engineered phage-derivatives that produce Klebicin M or Colicin E7 within the infected *Enterococcus* cell, respectively. Upon host-cell lysis, the released bacteriocins were able to successfully control the polymicrobial infection, whereas the wild-type phages could not. This data demonstrates that bacteriocin-producing phages can be used for cross-genus targeting of polymicrobial infections.

Example 2: Enhancing Bacteriophage Therapeutics Through In Situ Production and Release of Heterologous Antimicrobial Effectors Bacteriophages operate via pathogen-specific mechanisms of action distinct from conventional, broad-spectrum antibiotics and are emerging as promising alternatives. However, phage-mediated killing is often limited by bacterial resistance development (1, 2). Here, we engineer phages for target-specific effector gene delivery and host-dependent production of colicin-like bacteriocins and cell wall hydrolases. Using urinary tract infection (UTI) as a model, we show how heterologous effector phage therapeutics (HEPTs) suppress resistance and improve uropathogen killing by dual phage- and effector-mediated targeting. Moreover, we designed HEPTs to control polymicrobial uropathogen communities through production of effectors with cross-genus activity. Using a phage-based companion diagnostic (3), we identified potential HEPT responder patients and treated their urine ex vivo. Compared to wildtype phage, a colicin E7-producing HEPT demonstrated superior control of patient *E. coli* bacteriuria. Arming phages with heterologous effectors paves the way for successful UTI treatment and represents a versatile tool to enhance and adapt phage-based precision antimicrobials.

Main

Currently, conventional, small-molecule antibiotics with broad target specificity are the most effective treatments against bacterial infections. However, the global emergence and spread of antimicrobial resistance (AMR) (4), as well as adverse effects caused by antibiotic-induced microbiome dysbiosis, highlight the need for novel and more pathogen-specific antimicrobial interventions (5,6). Bacteriophages (phages), bacteriocins, synthetic antimicrobial peptides, and target-specific cell wall hydrolases (e.g., phage-derived endolysins) are currently being developed as precision antimicrobials (7). Among these, phages are highly promising because of their ubiquity, pathogen specificity, and ability to self-replicate (8,9). Although the killing of host bacteria by phages is largely independent of the host drug-resistance profile, treatment with phages often fails to inactivate all bacterial cells within a target population. This can be due to phage tolerance (10) or resistance mechanisms that bacteria employ to counteract viral predation, including the production of extracellular matrices, mutation or reduced expression of phage receptors, adaptive CRISPR-Cas immunity, restriction/modification systems, abortive infection systems, and a growing number of other resistance mechanisms described in the literature (11, 12).

Recent advances in CRISPR-Cas technology and synthetic biology have enabled the rapid modification of phage genomes beyond model phages (such as T4, T7, or lambda) to include therapeutic phage candidates that are typically less well-studied (13). As a result, engineering has been applied to (i) adapt phage tropism through directed receptor binding protein modification (14-17), (ii) construct sequence-specific antimicrobials through phage-mediated, pathogen-specific delivery of programmed CRISPR-Cas modules (18,19), (iii) deliver toxic proteins as genetic payloads (20), (iv) develop rapid phage-based (companion) diagnostics through the delivery of reporter genes (reporter phages) (13,21), and (v) optimize therapeutic phages for experimental therapy (22).

In this study, we demonstrate how diverse phages can be engineered to encode bacteriocins and cell wall hydrolases as antimicrobial effector genes, a concept we coin heterologous effector phage therapeutics (HEPTs). Here, effector genes are expressed during infection and their products released upon host cell lysis to function as secondary pathogen-specific antimicrobials, thereby complementing and enhancing phage-mediated killing. As a model system, we focused on developing HEPTs as precision antimicrobials against UTI pathogens (concept: FIG. 6A). UTIs are among the most common community-acquired and healthcare-associated microbial infections in all age groups and a major public health concern, resulting in annual healthcare costs exceeding 1.6 billion dollars in the US alone (23). While the most prevalent causative agent of UTIs is *Escherichia coli*, the microbial etiology is complex and can involve a wide range of Gram-negative or Gram-positive bacteria and certain fungi (24). An analysis of 340 isolates acquired from 231 incidents of UTI during 2020 in Zurich, Switzerland (the Zurich Uropathogen Collection; FIG. 9) identified 26 different bacterial species, with *E. coli* (34%), *Enterococcus faecalis* (17%), and *Klebsiella pneumoniae* (14%) as the most prevalent uropathogens, which is consistent with previous etiological studies on UTIs (24).

Guided by these observations, we engineered HEPTs using five distinct and strictly lytic phages that target the predominant uropathogens *E. coli* (phages E2 and CM001), *E. faecalis* (phages EfS3 and EfS7), and *K. pneumoniae* (phage K1). These phages represent various phylogenetic families with distinct virion morphologies and genome sizes (3,25) (FIG. 6B). To target Gram-negative uropathogens, we selected four colicin-like bacteriocins (CLBs) as effectors, which are active against either *E. coli* (colicins E6, M, and E7; green) or *K. pneumoniae* (klebicin M; purple). CLBs are protein toxins with narrow-spectrum activity, characterized by a distinct, three-domain architecture that mediates receptor binding (central domain), Ton- or Tol-dependent translocation (N-terminal domain), and periplasmic or intracellular toxicity (C-terminal domain) (26). The cytotoxicity of CLBs that were selected for HEPT engineering is mediated by periplasmic peptidoglycan biosynthesis inhibition (colicin M, klebicin M), intracellular 16s rRNase activity (colicin E6), or unspecific cytosolic nuclease activity (colicin E7) (26, 27). To target the Gram-positive uropathogen *E. faecalis*, we employed a phage-derived, chimeric cell wall-hydrolase (EC300; blue) that recognizes and degrades *E. faecalis* cell walls with high specificity (28). EC300 was engineered by fusing an M23 endopeptidase domain from a virion-associated lysin with a cell wall binding domain of an *E. faecalis* phage endolysin (28).

Figure 10A:
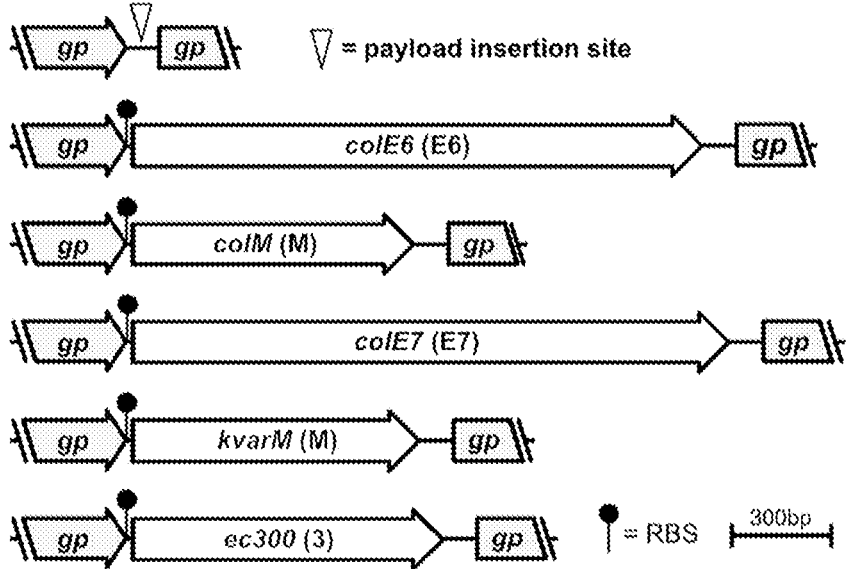
Figure 10B:
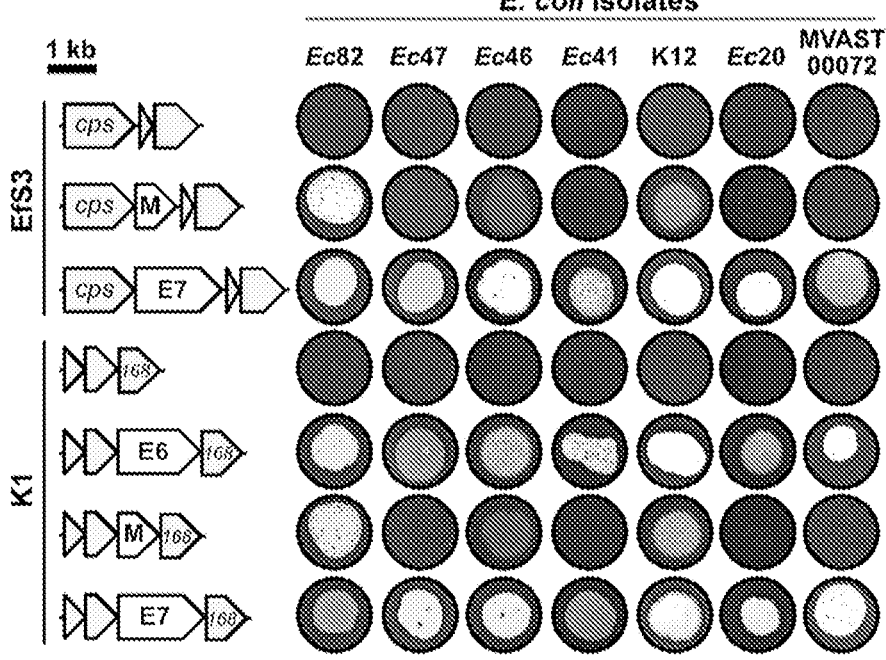
Figure 10C:
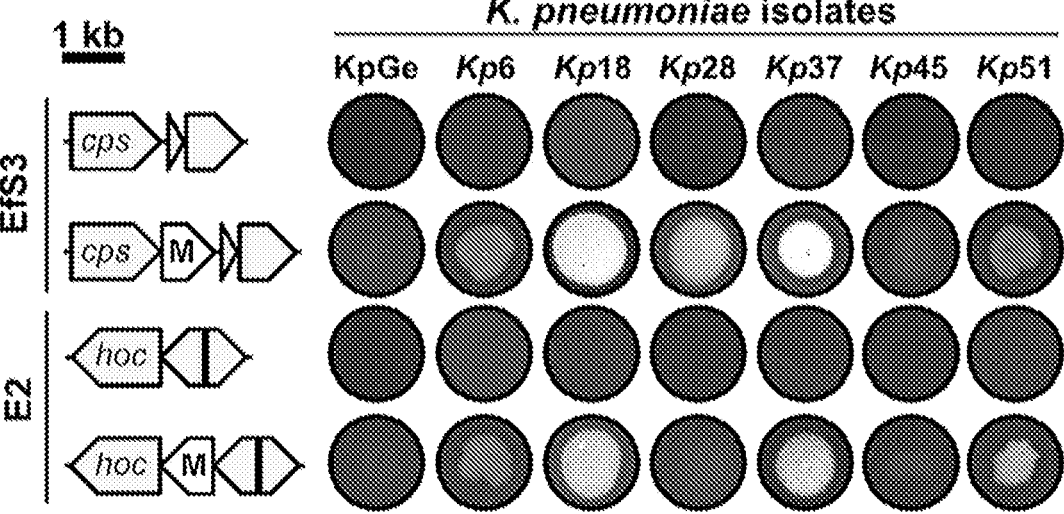
Figure 10D:
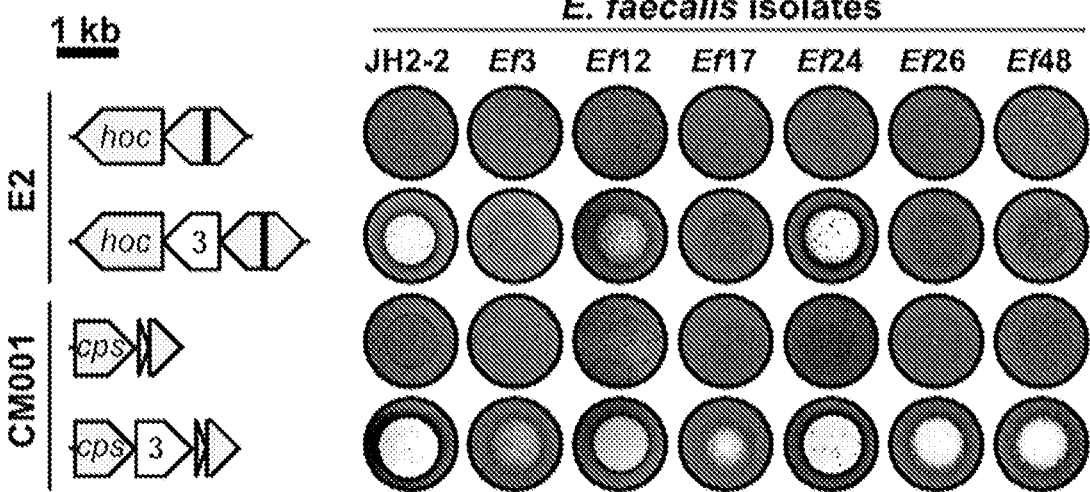

All effector genes were codon-optimized to match scaffold target species specificity (29) and integrated within the phage structural gene cassette alongside a strong ribosomal binding site to guide late promoter-driven expression (see FIG. 10A). Engineered HEPT candidates were constructed either using CRISPR-Cas9-assisted engineering (3, 15, 25) or by rebooting synthetic genomes in suitable surrogate hosts (30). To avoid toxicity, CLB-encoding HEPTs were engineered and amplified under constitutive expression of their respective immunity proteins. The production of active effector protein upon engineered phage infection was demonstrated by spot assays using crude wildtype (WT) phage or HEPT lysates on a selection of clinical target strains (FIG. 10B, C, D). To ensure that phage activity does not interfere with these assays, we tested lysates from engineered phages producing effectors with cross-genus activity. All effectors were produced and active against a broad range of urine-derived isolates of the respective target species with variable levels of activity depending on the phage scaffold. The klebicin M and EC300 encoding HEPTs targeted up to 54% and 92% of tested isolates, respectively. Among the three colicins, colicin E7 presented the broadest range of activity with HEPT EfS3::co/E7 active against 70% of the 56 *E. coli* isolates tested.

Polymicrobial infections are commonly observed within the urinary tract, particularly during catheter-associated UTIs (31), which may complicate therapeutic phage selection, combination, and treatment. Interestingly, analysis of the Zurich Uropathogen Collection revealed 34% of UTI cases (78/231) as polymicrobial with *E. faecalis* identified as a common co-infector associated with polymicrobial UTIs involving *E. coli* (46%) and *K. pneumoniae* (39%) (FIG. 6C). We therefore assessed the ability of HEPTs to deliver effectors with cross-genus activity to target polymicrobial communities composed of different combinations of clinical isolates through enzymatic collateral damage (cross-targeting HEPTs, FIG. 6 C-H). Using turbidity reduction and time kill assays combined with differential plating, we demonstrate the ability of HEPTs EfS3::co/E7 and EfS7::co/E7 to infect and kill *E. faecalis* cells (P, producer) while simultaneously eradicating co-cultured *E. coli* (R, recipient) within two hours of treatment through in situ release of colicin E7 effectors (FIG. 6 C, D). Similarly, we demonstrate that the klebicin M-producing HEPTs EfS3::kvarM and Efs7:: kvarM can successfully control co-cultures of *E. faecalis* (P) and *K. pneumoniae* (R) (FIG. 6 E, F), suggesting that CLB effectors provide a viable strategy for cross-genus targeting.

Since the protective peptidoglycan layer of Gram-positive pathogens such as *E. faecalis* is externally accessible, cell wall hydrolases are also promising enzyme antibiotics (enzybiotics) for cross-genus HEPT engineering. As shown in FIG. 6 G, H, we demonstrate the ability of an EC300-producing HEPT based on *E. coli* phage CM001 (CM001:: ec300) to target *E. faecalis* in co-culture, resulting in approximately 4-log reduction in *E. faecalis* after six hours of treatment for a co-culture of *E. coli* Ec20 (P) and *E. faecalis* Ef12 (R) (FIG. 6H). In clinical practice, polymicrobial UTIs would require application of multiple phages for treatment. Using a combination of two cross-genus HEPTs (E2::kvarM and K1::colE7), we were able to demonstrate a strongly enhanced killing of an *E. coli* and *K. pneumoniae* co-culture, providing a promising strategy to tackle polymicrobial UTIs (FIG. 11A). During polymicrobial UTIs, each bacterial species could be leveraged as an effector-producing host, even if it might not be the causative agent.

Regardless of the importance of polymicrobial infections, most UTIs are caused by a single uropathogen, with *E. coli* and *K. pneumoniae* as predominant agents (24). Infection of monocultures with WT phages typically leads to substantial initial host killing, as can be observed in turbidity reduction assays. However, within hours of infection, stable or transient phage resistance frequently occurs, leading to regrowth of phage resistant populations. To demonstrate this well-known limitation for phage treatment, we infected urine-derived *E. coli* (Ec20 and Ec41) or *K. pneumoniae* (Kp18, Kp28, and Kp37) isolates with WT phages E2 or K1, respectively. As expected, regrowth was observed within <18 h and a second round of infection demonstrated that these cells no longer responded to phage challenge, with both transient and stable phage resistance identified for individual clones isolated after the second round of infection (FIG. 12).

Figure 7A:
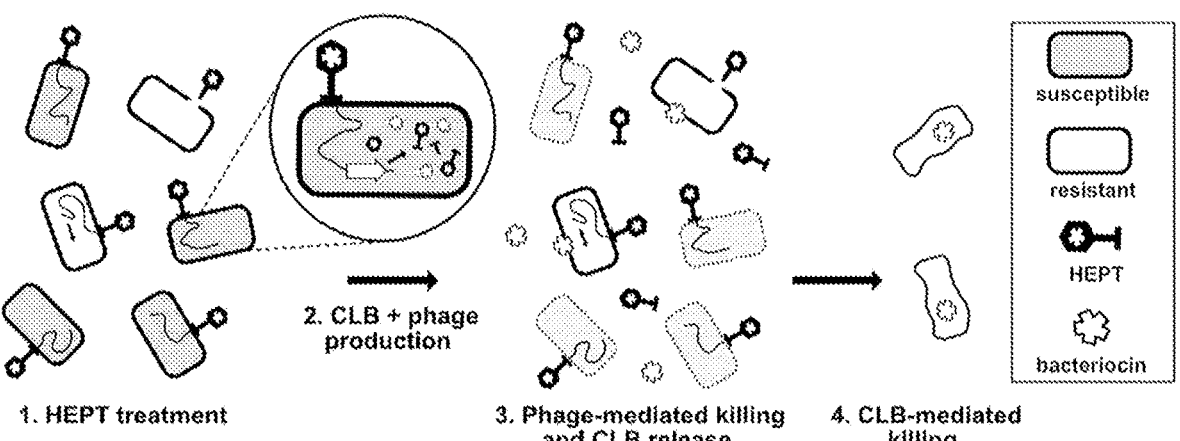
Figure 7B:
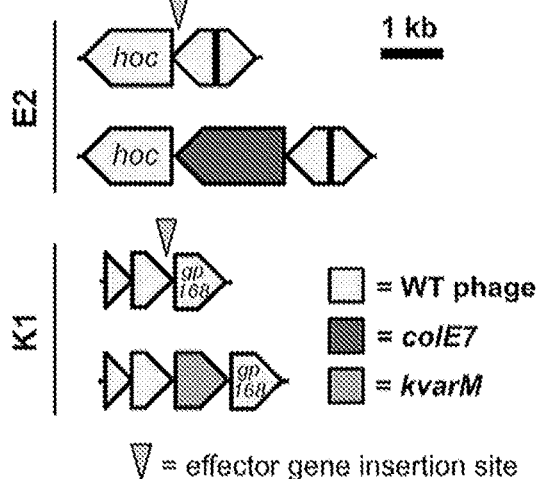
Figures 7C, 7D:
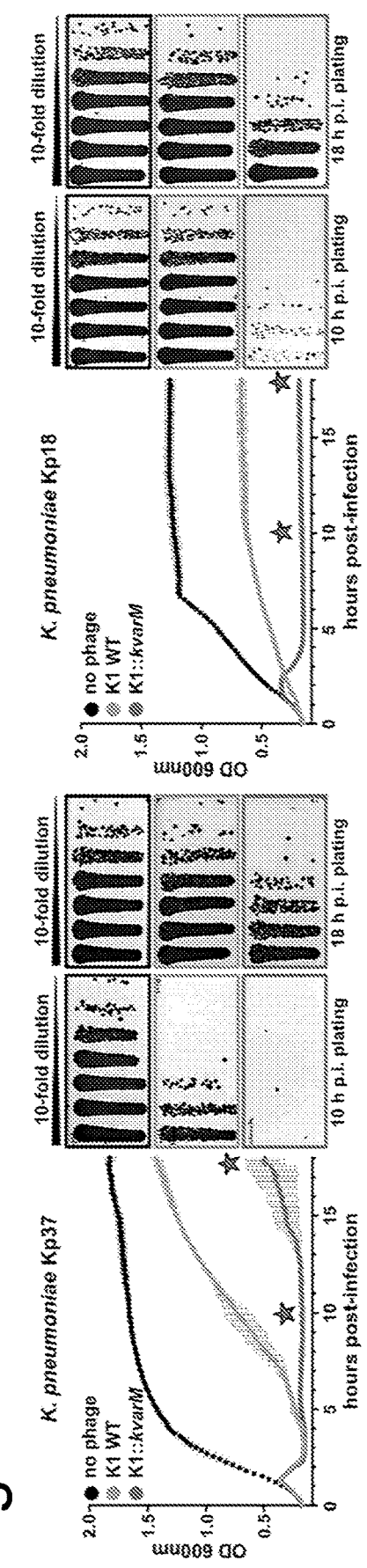

To circumvent this limitation, HEPTs were engineered to target resistant subpopulations through phage-mediated delivery of CLBs that provide an orthogonal killing mechanism against the same target species (self-targeting HEPTs, FIG. 7A). To this end, we constructed HEPTs E2::colE7 and K1::kvarM (FIG. 7B) to treat *E. coli* or *Klebsiella* monocultures and compared performance to their WT phage counterparts. Depending on the target isolate, E2 WT treatment led to rapid (*E. coli* Ec20) or delayed (*E. coli* Ec41) regrowth due to the expansion of resistant subpopulations. Strikingly, treatment with E2::colE7 led to a sustained (18 h) reduction in optical density and dramatic reduction of *E. coli* cell counts (>6-log reduction as compared to E2 WT) (FIG. 7C). Similar results were obtained for the self-targeting HEPT K1::kvarM, which strongly reduced *Klebsiella* cell counts at 10 h post-infection (p.i.) and delayed the regrowth of *Klebsiella* cells when measured at 18 h p.i. (FIG. 7D). Akin to the use of dual cross-targeting HEPTs (FIG. 11A), the combination of E2::co/E7 and K1::kvarM led to enhanced control of *E. coli* and *Klebsiella* co-cultures compared to combinations containing WT phages (FIG. 11B). Overall, through in situ production of self-targeting effectors, HEPTs provide an effective two-pronged attack to target bacteria and prevent or delay their regrowth.

In the future, phage-based precision antimicrobials will most likely be designed and implemented as personalized treatment options. Therefore, a rapid and reliable companion diagnostic would be helpful to guide phage selection and/or predict therapeutic success. To assess the performance of self-targeting HEPTs against *E. coli* in patient urine, we combined our recently developed reporter phage-based diagnostic (3) with ex vivo urine treatment using HEPT E2::colE7 (workflow: FIG. 8A). To this end, 39 patient urine samples were collected and subjected to reporter phage-based pathogen identification and phage susceptibility screening using a nanoluciferase-encoding phage E2 (E2::nluc) (3). Reporter phage-induced bioluminescence was quantified within 4.5 h as an indicator of successful phage genome delivery and expression. Concurrently, the presence of *E. coli* in individual urine specimens was screened and confirmed using differential plating. Eight urine samples were positive for *E. coli*, seven of which were detected by E2::nluc (FIG. 8B, urinalysis). To assess the advantage of heterologous effector delivery, fresh urine samples were subjected to HEPT (E2::colE7) or WT phage treatment, with *E. coli* killing assessed over 24 h using time kill assays (FIG. 8C, ex vivo). In addition, patient-derived *E. coli* strains were isolated and tested for phage and colicin E7 susceptibility, with phage susceptibility defined as the ability to form plaques (FIG. 8B, FIG. 13). Specimen #5 was excluded due to the presence of >$10^7$ CFU/mL *K. pneumoniae* (polymicrobial infection). The remaining six patient isolates could be classified into three categories based on their susceptibility profiles: (I) phage and colicin sensitive, (II) phage resistant but colicin sensitive, and (III) phage sensitive but colicin resistant. Compared to E2 WT, improved *E. coli* killing by E2::colE7 was observed for both ex vivo treatments of urine in category I (specimens #7 and #30), which was subsequently confirmed in vitro using turbidity reduction assays (FIG. 8C, in vitro). In category II (specimens #12 and #16), a slight enhancement of activity was observed during ex vivo HEPT treatment; however, no improvement could be validated during in vitro turbidity reduction analysis. This was attributed to incomplete infectivity of phage E2 towards specimens #12 and #16, as observed by a lack of plaque formation. As expected, due to a lack of colicin sensitivity for specimens #21 and #32, no difference in activity was observed between E2 WT and E2::colE7 within category III. Overall, the ex vivo study demonstrated enhanced HEPT-mediated killing of *E. coli* in fresh patient urine, provided that the isolate is susceptible to both phage and effector, e.g., colicin E7. For future implementation of HEPTs and other phage-based therapeutics, careful and rapid screening of relevant susceptibility profiles, e.g., using reporter phage companion diagnostics, will be an essential component to guide their therapeutic use.

In conclusion, we present HEPTs as precision antimicrobials that combine the inherent, pathogen-specific killing activity of bacteriophages with in situ production and release of secondary antimicrobial effectors. This two-pronged approach enhances the antimicrobial activity of phages, is capable of suppressing outgrowth of phage resistant subpopulations, and can be harnessed to provide cross-genus control of bacterial pathogens using a single HEPT. Through the careful selection of phage scaffolds and heterologous effectors, HEPTs provide a customizable platform for targeted antimicrobial therapy.

REFERENCES

1. Gurney, J., Brown, S. P., Kaltz, O. and Hochberg, M. E. (2020) Steering Phages to Combat Bacterial Pathogens. *Trends Microbiol,* 28, 85-94.
2. Oechslin, F. (2018) Resistance Development to Bacteriophages Occurring during Bacteriophage Therapy. *Viruses,* 10.
3. Du, J., Meile, S., Staubli, S., Koliwer-Brandl, H., Piffaretti, P., Leitner, L., Matter, C. I., Baggenstos, J., Milek, S., Gübeli, C. et al. (2022) Engineered reporter phages for rapid detection of *Escherichia coli* and *Klebsiella* spp. in urine. *Cell Rep Med,* submitted.
4. Antimicrobial Resistance, C. (2022) Global burden of bacterial antimicrobial resistance in 2019: a systematic analysis. *Lancet,* 399, 629-655.
5. (2019) Antibiotic resistance threats in the united states. *U.S. Department of Health and Human Services,* CDC.
6. de la Fuente-Nunez, C., Torres, M. D., Mojica, F. J. and Lu, T. K. (2017) Next-generation precision antimicrobials: towards personalized treatment of infectious diseases. *Curr Opin Microbiol,* 37, 95-102.
7. Mills, S., Ross, R. P. and Hill, C. (2017) Bacteriocins and bacteriophage; a narrow-minded approach to food and gut microbiology. *FEMS Microbiol Rev,* 41, S129-S153.
8. Gordillo Altamirano, F. L. and Barr, J. J. (2019) Phage Therapy in the Postantibiotic Era. *Clin Microbiol Rev,* 32.

9. Meile, S., Du, J., Dunne, M., Kilcher, S. and Loessner, M. J. (2022) Engineering therapeutic phages for enhanced antibacterial efficacy. *Curr Opin Virol,* 52, 182-191.

10. Tzipilevich, E., Pollak-Fiyaksel, O., Shraiteh, B. and Ben-Yehuda, S. (2022) Bacteria elicit a phage tolerance response subsequent to infection of their neighbors. *EMBO J,* 41, e109247.

11. Bernheim, A. and Sorek, R. (2020) The pan-immune system of bacteria: antiviral defence as a community resource. *Nat Rev Microbiol,* 18, 113-119.

12. Labrie, S. J., Samson, J. E. and Moineau, S. (2010) Bacteriophage resistance mechanisms. *Nat Rev Microbiol,* 8, 317-327.

13. Kilcher, S. and Loessner, M. J. (2019) Engineering Bacteriophages as Versatile Biologics. *Trends Microbiol,* 27, 355-367.

14. Dunne, M., Rupf, B., Tala, M., Qabrati, X., Ernst, P., Shen, Y., Sumrall, E., Heeb, L., Pluckthun, A., Loessner, M. J. et al. (2019) Reprogramming Bacteriophage Host Range through Structure-Guided Design of Chimeric Receptor Binding Proteins. *Cell Rep,* 29, 1336-1350 e1334.

15. Yehl, K., Lemire, S., Yang, A. C., Ando, H., Mimee, M., Torres, M. T., de la Fuente-Nunez, C. and Lu, T. K. (2019) Engineering Phage Host-Range and Suppressing Bacterial Resistance through Phage Tail Fiber Mutagenesis. *Cell,* 179, 459-469 e459.

16. Ando, H., Lemire, S., Pires, D. P. and Lu, T. K. (2015) Engineering Modular Viral Scaffolds for Targeted Bacterial Population Editing. *Cell Syst,* 1, 187-196.

17. Yosef, I., Goren, M. G., Globus, R., Molshanski-Mor, S. and Qimron, U. (2017) Extending the Host Range of Bacteriophage Particles for DNA Transduction. *Mol Cell,* 66, 721-728 e723.

18. Bikard, D., Euler, C. W., Jiang, W., Nussenzweig, P. M., Goldberg, G. W., Duportet, X., Fischetti, V. A. and Marraffini, L. A. (2014) Exploiting CRISPR-Cas nucleases to produce sequence-specific antimicrobials. *Nat Biotechnol,* 32, 1146-1150.

19. Citorik, R. J., Mimee, M. and Lu, T. K. (2014) Sequence-specific antimicrobials using efficiently delivered RNA-guided nucleases. *Nat Biotechnol,* 32, 1141-1145.

20. Cass, J., Barnard, A. and Fairhead, H. (2021) Engineered Bacteriophage as a Delivery Vehicle for Antibacterial Protein, SASP. *Pharmaceuticals (Basel),* 14.

21. Meile, S., Kilcher, S., Loessner, M. J. and Dunne, M. (2020) Reporter Phage-Based Detection of Bacterial Pathogens: Design Guidelines and Recent Developments. *Viruses,* 12.

22. Dedrick, R. M., Guerrero-Bustamante, C. A., Garlena, R. A., Russell, D. A., Ford, K., Harris, K., Gilmour, K. C., Soothill, J., Jacobs-Sera, D., Schooley, R. T. et al. (2019) Engineered bacteriophages for treatment of a patient with a disseminated drug-resistant *Mycobacterium abscessus. Nat Med,* 25, 730-733.

23. Foxman, B., Barlow, R., D'Arcy, H., Gillespie, B. and Sobel, J. D. (2000) Urinary tract infection: self-reported incidence and associated costs. *Ann Epidemiol,* 10, 509-515.

24. Flores-Mireles, A. L., Walker, J. N., Caparon, M. and Hultgren, S. J. (2015) Urinary tract infections: epidemiology, mechanisms of infection and treatment options. *Nat Rev Microbiol,* 13, 269-284.

25. Meile, S., Du, J., Grossman, S., Koliwer-Brandl, H., Piffaretti, P., Leitner, L., Baggenstos, J., Matter, C. I., Milek, S., Gübeli, C. et al. (2022) Engineered reporter phages for rapid detection of *Enterococcus faecalis* in urine. *Cell Rep Med,* submitted.

26. Cascales, E., Buchanan, S. K., Duche, D., Kleanthous, C., Lloubes, R., Postle, K., Riley, M., Slatin, S. and Cavard, D. (2007) Colicin biology. *Microbiol Mol Biol Rev,* 71, 158-229.

27. Cherier, D., Patin, D., Blanot, D., Touze, T. and Barreteau, H. (2021) The Biology of Colicin M and Its Orthologs. *Antibiotics (Basel),* 10.

28. Proenca, D., Leandro, C., Garcia, M., Pimentel, M. and Sao-Jose, C. (2015) EC300: a phage-based, bacteriolysin-like protein with enhanced antibacterial activity against *Enterococcus faecalis. Appl Microbiol Biotechnol,* 99, 5137-5149.

29. Grote, A., Hiller, K., Scheer, M., Munch, R., Nortemann, B., Hempel, D. C. and Jahn, D. (2005) JCat: a novel tool to adapt codon usage of a target gene to its potential expression host. *Nucleic Acids Res,* 33, W526-531.

30. Kilcher, S., Studer, P., Muessner, C., Klumpp, J. and Loessner, M. J. (2018) Cross-genus rebooting of custom-made, synthetic bacteriophage genomes in L-form bacteria. *Proc Natl Acad Sci USA,* 115, 567-572.

31. Kline, K. A. and Lewis, A. L. (2016) Gram-Positive Uropathogens, Polymicrobial Urinary Tract Infection, and the Emerging Microbiota of the Urinary Tract. *Microbiol Spectr,* 4.

32. World Medical, A. (2001) World Medical Association Declaration of Helsinki. Ethical principles for medical research involving human subjects. *Bull World Health Organ,* 79, 373-374.

Supplemental Material to Example 2

Materials and Methods

Bacterial Strains and Culture Conditions

*E. coli* BL21 (New England Biolabs), *E. coli* Ec20 (1), *K. pneumoniae* KpGe (2), *E. faecalis* JH2-2, and *E. faecalis* Ef57 (3) were used as phage propagation and engineering hosts. *E. coli* XL1-Blue MRF' (Stratagene) was used as a cloning host for plasmid construction. Clinical strains used in this study include isolates taken from the Zurich Uropathogen Collection; a library of 665 patient isolates identified from urine specimens of patients from the Department of Neuro-Urology, Balgrist University Hospital, Zurich, Switzerland acquired between January and December 2020 and provided after routine testing by the Institute of Medical Microbiology (IMM), University of Zurich. Gram-negative bacteria were grown at 37° C. in Lysogeny Broth (LB) or Synthetic Human Urine (SHU (4)). Gram-positive bacteria were cultivated at 37° C. in BHI-fc broth (37 g/L Brain-Heart-Infusion broth from Biolife Italiana, 4 g/L Phages were propagated on their respective propagation hosts using the soft-agar-overlay method as described previously (1,3). To avoid toxicity, co/E7-encoding HEPTs E2::colE7, K1::colE7, and K1::colE6 were propagated in the presence of their immunity plasmids, plm_E7 and plm_E6, respectively. In brief, after overnight incubation, phage particles were extracted using 5 ml SM buffer per plate (50 mM Tris, pH 7.4, 100 mM NaCl, 8 mM $MgSO_4$) and filter-sterilized (0.2 µm) to obtain crude phage lysates (used for effector susceptibility testing as described below). Phage lysates were further purified and concentrated by PEG precipitation (7% PEG 8000 and 1M NaCl) followed by cesium chloride isopycnic centrifugation and finally dialyzed against a 1000-fold excess of SM buffer.

Phage Genome Sequencing

*E. coli* phage CM001 was isolated from a mixture of wastewaters collected in Switzerland using *E. coli* Ec20 as a host, purified using three sequential rounds of the soft-agar-overlay method, and further propagated as described above. Genomic DNA was extracted from purified phage particles using the phenol:chloroform:isoamyl alcohol (25:24:1) extraction method. Purified DNA was Illumina sequenced (2×150 bp) by Eurofins Genomics Europe Sequencing GmbH (Constance, Germany). A single contig was obtained by de novo assembly using the CLC Genomics Workbench version 20 (QIAGEN Bioinformatics) with default settings. Coding DNA sequence (CDS) identification and annotation was performed using the RAST server (5), with tRNAscan-SE used to identify possible tRNA genes (none detected) (6). Subsequent manual curation and validation was performed using related *E. coli* phage K1H (NC_027994) as a reference genome. The final annotated genome of phage CM001 is available from the GenBank database (UTI-CM001, OM810255) alongside previously sequenced genomes of phage E2 (OL870316), K1 (OL870318), EfS3 (OL870611), and EfS7 (OL870612).

Transmission Electron Microscopy

Phage particles were negatively stained for 20 seconds with 2% uranyl acetate on carbon-coated copper grids (Quantifoil) and observed at 100 kV on a Hitachi HT 7700 equipped with an AMT XR81 B Peltier cooled CCD camera (8M pixel) at the ScopeM facility, ETH Zurich.

CRISPR-Cas9-Assisted Phage Engineering

All HEPTs based on phages E2, K1, EfS3, and EfS7:: colM/kvarM were constructed using the homologous recombination-based and CRISPR-Cas9-assisted engineering as previously described (1,3). In short, WT phages were propagated in the presence of the respective editing template (pEdit) to enable sequence-specific transgene integration through homologous recombination. WT phages were selectively restricted using a SpyCas9-based counterselection system (pSelect) directed at the flanking homology arms within individual phage genomes. Silent mutations within the protospacer-adjacent motifs (PAMs) on the homology arms of pEdit enable CRISPR-escape and enrichment of engineered phage. When PAM mutation is impossible, multiple silent mutations were introduced within the SpyCas9-targeted seed sequence (12 nucleotides immediately upstream of the PAM) to abrogate CRISPR targeting.

Phage Genome Assembly and Rebooting

EfS7::co/E7 and CM001::ec300 genomes were assembled in vitro from overlapping (~40 bp) PCR fragments using the Gibson isothermal method (NEBuilder HiFi DNA assembly master mix, NEB). 20 ng of PCR products per 1 kb of genomic fragment length were used for assembly. Synthetic genomes of *E. faecalis* HEPTs were rebooted through transfection into *L. monocytogenes* Rev2L L-form bacteria as previously described (7). To reboot CM001::ec300, 3 µl of assembly mixture was electroporated into 42 µL of electrocompetent *E. coli* XL1-Blue cells at 1.8 kV, 25 µF, 200Ω using a BTX ECM630 electroporator (BTX Molecular Delivery Systems, MA, USA). 1 mL of SOC medium was supplemented immediately after electroporation and cells were recovered at 37° C. for 4 h with shaking (180 rpm). Subsequently, 10 µl of chloroform was added to assist host lysis and phage release. Following centrifugation at 12,000×g for 1 min, dilutions of the supernatant were mixed with 200 µL of an overnight culture of *E. coli* Ec20 and 5 mL of molten LC soft agar, layered onto pre-warmed LB plates, and incubated for 16 h at 37° C.

Effector Susceptibility Assessment 400 mL of a log-phase culture of the target bacterial strain was mixed with 10 mL of molten LC soft agar, poured onto a square plate (12×12 cm) containing the appropriate growth agar, and dried for 15 min. 10 mL of each sterile-filtered crude phage lysate was spotted on the bacterial lawn, dried, and incubated overnight to visualize the zones of growth inhibition.

Turbidity Reduction Assays

Log-phase cultures were diluted in BHI-fc (*E. faecalis*) or SHU (*E. coli* and *K. pneumoniae*) to an $OD_{600\ nm}$ of 0.05-0.1, distributed into clear, flat-bottom 96-well plates (Bioswisstech) and infected with phages to obtain a final concentration of $5 \times 10^7$ plaque-forming units (PFU)/mL. The plates were sealed with a microplate sealing film (Axygen™) and $OD_{600\ nm}$ was quantified every 5 min at 30° C. using a spectrophotometer (SPECTROstar Omega or SPECTROstar Nano, BMG Labtech). Uninfected bacterial dilutions were used as growth controls, and growth medium without bacteria was used as a background/sterility control. All cross-genus HEPT experiments used a ratio of 10:1 producer to recipient cells. Experiments were performed as technical triplicates and reported as mean±standard deviation (SD). When indicated, triplicate reactions were combined, serially diluted, and plated on agar plates at 10 or 18 h post-infection.

Time Kill Assays

For cross-genus HEPT TKAs, 1 mL of co-culture was infected with $10^9$ or $5 \times 10^7$ PFU/mL of HEPTs derived from EfS7 and CM001 scaffolds, respectively. The ratio of producer cell to recipient cell was always 10:1 with starting concentrations (CFU/mL) provided in FIG. 6. Differential and selective plating was used to enumerate the different bacterial species. *E. coli* and *K. pneumoniae* were counted on chromogenic coliform agar (CCA, Biolife italiana) and *E. faecalis* was counted on KFS agar (Biolife italiana) after incubation at 37 and 42° C. for 16 or 48 h, respectively. Experiments were performed as biological triplicates and reported as mean±SD.

Repeated Phage Exposure and Resistance Development

*E. coli* strains Ec20 and Ec41 and *K. pneumoniae* strains Kp18, Kp28, and Kp37 were diluted to an $OD_{600\ nm}$ of 0.1 and infected with $10^8$ PFU/mL of phages E2 or K1 (round I) in SHU. After 18 h of infection, the phage-exposed samples were combined (n=3) and diluted to an $OD_{600\ nm}$ of 0.1 in fresh SHU and incubated with additional WT phage or media alone for another 18 h (round II). Individual surviving clones were isolated after 36 h by re-streaking on LB agar and tested in vitro for phage susceptibility using spot-on-the-lawn assays.

Reporter-Phage Based Urinalysis and Ex Vivo Activity Assessment

Reporter phage urinalysis was performed as described previously (1). In brief, 1 mL of patient urine sample was directly mixed with 4 mL of LB. Samples were enriched for 1 h at 37° C. with shaking (180 rpm). 50 µL of reporter phage was added to individual 450 µL aliquots of enriched urine ($10^6$ PFU/mL final concentration) and incubated at 37° C. with shaking. LB media spiked with reporter phages alone served as background controls. Bioluminescence measurements were taken at 3 h post infection. Based on manufacturer's instructions, a buffer-reconstituted NLuc substrate (Nano-Glo Luciferase Assay System, Promega) was mixed at a 1:1 ratio with a sample of the infection mixture (40 µL total) in Nunc™ F96 MicroWell™ plates (Thermo Fisher). Bioluminescence was quantified 5 min after substrate addition using a GloMax® Navigator Luminometer (Promega) with 5 s integration and 2 s delay. Relative light units (RLUs) were background corrected by division of the RLU from phage-only controls. Samples producing $>10^3$ RLU fold change (FC) were considered positive. To confirm reporter phage results and to isolate strains, patient urine was plated on differential agar (UriSelect4, BioRad). *E. coli* isolates were tested for phage-sensitivity by determining the efficiency of plating using the soft-agar-overlay method. For ex vivo TKA experiments, 250 mL of patient urine was infected with 250 mL of a $10^9$ PFU/mL stock of E2 or E2::colE7 in PBS solution, incubated for 24 hours at 37° C., and plated on LB at the indicated time points. T=0 was plated prior to phage addition as an input control. To replicate TKA conditions, in vitro turbidity reduction assays were performed by adding 100 ml of a $10^9$ PFU/mL stock solution of E2 or E2::colE7 to 100 ml of bacterial culture in SHU at a lower starting $OD_{600\ nm}$ of 0.005 to reproduce bacterial loads in patient urine.

Additional data on self-targeting HEPTs phi41S::co/M, phi41S::colE7, CM001::colE7, E2::col5, and phi41S::col5 is depicted in FIG. 14. Additional data on cross-targeting HEPTs K1::col5, K1::colE6, K1::co/K, EfS7::co/M, and EfS7::kvarM is depicted in FIG. 15.

REFERENCES

1. Du, J., Meile, S., Staubli, S., Koliwer-Brandl, H., Piffaretti, P., Leitner, L., Matter, C. I., Baggenstos, J., Milek, S., Gübeli, C. et al. (2022) Engineered reporter phages for rapid detection of *Escherichia coli* and *Klebsiella* spp. in urine. *Cell Rep Med*, submitted.

2. Lima, W. C., Pillonel, T., Bertelli, C., Ifrid, E., Greub, G. and Cosson, P. (2018) Genome sequencing and functional characterization of the non-pathogenic *Klebsiella pneumoniae* KpGe bacteria. *Microbes Infect,* 20, 293-301.

3. Meile, S., Du, J., Grossman, S., Koliwer-Brandl, H., Piffaretti, P., Leitner, L., Baggenstos, J., Matter, C. I., Milek, S., Gübeli, C. et al. (2022) Engineered reporter phages for rapid detection of *Enterococcus faecalis* in urine. *Cell Rep Med,* submitted.

4. Sarigul, N., Korkmaz, F. and Kurultak, I. (2019) A New Artificial Urine Protocol to Better Imitate Human Urine. *Sci Rep,* 9, 20159.

5. Aziz, R. K., Bartels, D., Best, A. A., DeJongh, M., Disz, T., Edwards, R. A., Formsma, K., Gerdes, S., Glass, E. M., Kubal, M. et al. (2008) The RAST Server: rapid annotations using subsystems technology. *BMC Genomics,* 9, 75.

6. Chan, P. P. and Lowe, T. M. (2019) tRNAscan-SE: Searching for tRNA Genes in Genomic Sequences. *Methods Mol Biol,* 1962, 1-14.

7. Kilcher, S., Studer, P., Muessner, C., Klumpp, J. and Loessner, M. J. (2018) Cross-genus rebooting of custom-made, synthetic bacteriophage genomes in L-form bacteria. *Proc Natl Acad Sci USA,* 115, 567-572.

8. Proenca, D., Leandro, C., Garcia, M., Pimentel, M. and Sao-Jose, C. (2015) EC300: a phage-based, bacteriolysin-like protein with enhanced antibacterial activity against *Enterococcus faecalis. Appl Microbiol Biotechnol,* 99, 5137-5149

SEQUENCE LISTING (33 sequences)

SEQ ID NO: 1 - DNA, 170051 bp, synthetic construct
  source 1..170051: mol_type = other DNA
tcacacataaaacacatcatatcgaccacgggtagtaccaacatataataactgctgtgcgagagaagcatctgccatgtgaatgcatggagtataaatgaagcttctgtcaattgagatgccctgggccttatggaaagtcgaagccggtaatgctttcactttatgaaacttacgcttagcgtcccagaactcagaccaaggagctttacctcctttattccaattcttatatgtatctgcagtttttgccaagaagaattgaaatttattcatttcttcttcggatgagatgacacagattttctctctagcgtactcttcatcgtcgccataggtttcaatatctaatacccaatgacgaaccagatattcacctggaacacctctggcacccaaaaatgtggtggtttcaactgcatccaatatgcgaacaaactgaccattattgaaaagaatttcgctgaatttcttcccttcaaatttaagttccttggtaagaggttcttgcataacaacaatctcgcctactacgaatggtcgttcagtttcgtatattcttcgtctgattatttcattcaatttgtctacagatttattcgtgaatgcaagcattcggttttcaaataaatcttctggtgttttaactaaattaaaataatttagcataaaatctttaagggcagttcctttcgtaaacccacggacaccatgaccatcaactacacagtcacgaatccatccaccatttctgatttcagtagcaacttcaatgattggagcattacttcgcatcacctcggtcaaatgaagctgtaagaaatctttatgagtgaagaatggactcagtgcaggttcattacttccaggttctaccggacgtatctgagccttatcaccaatggcaatgacaatacaccaggcaggaatagttgccatcaaaatcttaaacagcttacggtcatacattgaagcttcatcgcaaatgagaactcgaatagatgccatatccggaactttcttttgttcaaacagaacgttttcttcatatgtcgtcgggttaattttcagaagactatgaatagtactggcctgcattccgctgagcttagataaaacctttttggccccatgtgtaggtgctgccaacgcaatgccagagataccctgagaaatcaaagcatcaatgataaatttggttaaagttgttttacctgtaccggcaggtccattaatcgtaatatgttgacctttagctccttgtttgaccatttcaatgactttattaaaaatcgctttttgactttcttttaattggtcaaacgtaatcatgccacttttaccctcactacatgtagatttttaatttttgcttcgagtttttcacgctcaacatcgctaagtggttcatacactagctcagttgttttccaccaaagcattcctttggttttgctttttccagtaaaattcccttttgctaatttgtctgttaaaaccgacattgtacgaatccgtgctttattagccgattcttcattagtgaagaccacacatcgttctccatcgtacatatcagttgtgactggatggtcaaatccgtctttatccttatacgctactacatatccatagtgttgcattacattttacctctcaaaagttggaagaaggacgcagtcaatggaagaccttttttcaattttaacttatctagcattgagcatttttctaaccgacgaagtgagctaacaattagccgtattgattgtacacggatttcagcatctgatggacgattcggaactgatgctaaaatagcagataacttacgctcaactttagctaattcagacttaccaccgctgatacgagttctcaatgcattaataagttctaaatctgccgaggttgcagttccattcttttctttttgcacaaattgagaaagatgattttcgcgattacgtaagttagttttaattgatgttatagttttttcatactcacgaatcttttccaaacgagaagcttctttatcacttgttggcttaacagaatcagaagagcgaactatgcgtgccgcaatttcattcgcttttcgttcaaggccttcaatcgtattatttccacgcaaagtattatacttttgcttgacaggaataacattccctactacatatcccaagtcattattccaacgctcgagcgtcatgctatcaggatgatttcctttaacagttccaaacttttcgcctgagtatgcgcaatgtgtctgctgcatgatgttaaacagatattctggggtgagattgaactccttgtgccgacgttgagcagaacctaaagttgtaattaaacgagtataaactttagcggtttcagcagtaaatttcatcatgttttcctcaaaaatgctttcgtcttacggacggtataatgggtctaggtccctagttctagataatcactagttgactaagctatagtaacactaaagtagtccataagtaaaccagatttttcaactttgttatgaccaaccactttgaacttagttcccatcggtagcatcctttcttgttctttatcaatcatctcgatgtcagcgcttctgcgctgagcaatgttatcaatcacatcatttggtcgcatgaattcagaatctggtgcagtaattaaaagcgatttcatgttggtatgataatcaaatgattgctgacaattattgacttcaatgactacaaaggtcgagtaatgccatttgcctgcaaactctcgggcgatcgtttcatctgttgtgaatgatgctacctttccaaagtcaaatttctctcctttaataagagcgtcataaaaggctttagcctcacgacacgatagacctctatagagaatttctctgttatcgatttgatgacgtctaacgatagagtcaagtttcttatgaaattcttcgccaatcttattgttcatgcactgccacagaattgactgttctttgcagtcaaaacgattggctaatgcttcccatacgcttaaatcatataaaggtaatcctttgctttctcgcgcgaagttaagaacatcaatggagcgaatgggttcttcgataggaataacctttgataattttactgaaatagatgggtttaatgaaatagccatgatattctccattttggttacgagaggtatcttatcatggctttttggaagagtaaactactttgtgaaattattttgcccagggagaccagggcggcgggtcagaccagattgaagctagttcatctagaagagcttctggggctttaataccatacttctgtataattatacggtattcgtctttgatgtccttagaaatcactggatgaacttgaacctcttcctgaggctcttccatcatttcaaacaaatccatcacatgaaccactcagtattgcgatacagacaactactgctgttatatccatcagctgctttttgcaacagcgggcttggagcaagtttgataaaatctgcgcccatatataaccaaactaacttagtaaattctattagagaatctgtgctatcaatgataatctttttgcctcttgaaattatgtcattttcgtattcatataagctagtttcatgacatacattggtgtatcctttcaagtggagagcatgcagtatagaaacaggacttcctggaactgtatctacgtcaaagacatgagcagtcttaataatgccataatcttcagaaggacaccaaccaaatgcctcgaatttattaattaaatctttgaaatctttgtcgaacgtactgtatagagcaacagtaaaaattctatcttggtctagacgcaaagctccttttgcatcatttcttgattgaactgcgcgctgtaagcttactttatagatttttgcgtttgccacacatagctccttcagtcatgttgttgtcttcaaaccacttatcatttgctttaattaaagcaggcgcagcttttagtaataacgctgcagctcttacacctctgtaccaacaatcaaaatgagacttctttaatggcgattgataccagggcttagtataacatatcattttcttctcctcagttagtaggaataatatactattcccagtatagcataaaaggactcccgaaggagtccttaattttatacttcgccatcagccggaacagcttcaaacattttcgcgttggtggttgcccaagtagcagcatcatcaactactgttgaataagcagctttttcagatgggaaaatctgatactgcgcattagcaatacgatgcgaatcagaatacaccttaaaagctacagatacttctgtgcctttaacttcaccatcagcagttgcatggtcaaaagttttgatgtttacgtaagccattttaatctcctatttagtttacagaagtatttatacagctgctgtaaacatctttaatatttctttatcaatttctcgagtgatttcttctcgaagggccaatactaaggccctttctttttgttttctgataatttttaaacgacgcttagatattcttttagccatcaataaccactgtcttgacgagcaaagttctctgcgtttttcagataatacagcttaaagatttcttcagaatccagaccaagcgccataaacatattcagaacaaagtgcaggatatcaatcatttcaaatttgatttcaagctggtctttatcagacaggtctttgatataagtttcctgcatcttgacgtggtcagctttccatggtttccatacggcagatgctgccttttcaccgttactcataccgccaagagacgtcagcaattcgcggaattcgtcatcaatgtaatctttttggttacgcagccactgcacgatatcaccggcttgggccaattcatcaggatgcatgttagtaccaggcttatcgtttgctagacgaacctgaagagatttttgcatatcaagcattacttgcagagggtcaccaccaactttgcgtacgatacctgcgtatcgagcttcagctttatctgcaccagcgatcagttgactacattcgttgaaatgtggcatattatttttcctttcaattaaattagataaatattatatcacttaacataaatagcaggaggattcatgtctgaagtgaaacgagaatgtaaagacaaaggaggatttggaagatatctttacgtcggaatcgccactgctgctttagctgcatggaattatgtggtagttccattagctagcacacacgggctagttcttcctccaatgccgttagaaaaagttgtgtcgtttattatgactggaggattgctttaatttaaggggctttggcccctatatcttcgcatatttgtcaagacgtaatttagccattaaaccttgcgatatattttgattaatataatccgttatttcagaagcagttgccccctctttcataatcatatcatttatatctttgcttttccaaggcgacttatcccagaaaactaccttttcaccagcatctactaaacgtttcatacgcttaattgtatcaggatgacgaggttcatggtccataatccatgctcggttatcatgacatggaacttgagctaaatctaaagacccgccagtgattgcaatagcattatcaatgaacaacgaatctattggtccttccatgacgaatacgagttttgactcatcaatggtgtcgagaccataaattttggttgcatgttcatgggctttgattgtgatgtatttttgtggagcattctttcgtagtgctcgtccttgaaacgactcaatctctcctttcttgttgaagataggaataaccaaacgtggttcgttcgtctcattcttataggttcctggattaacagagttaacaagagaaggccattggttagtaaaccataaccttttccaagaagtgcttggaatacatctggcagtcacatatttaactatcggatgttccttcggaagtctatctaatcgctcgcagaaattaagtttttctattacggggagttttgcattaattttctcagacggttctacagcctttggcttatcaaagacttgttcctttcttttctcaagaagatactctcgatagaggtcaggctcattatctttaagatactgtgatagccacttgttatactcacagttgaagcaatggcagcgtaatccttgacctgcatcaaaaatccagaatcgggctttattgatatctttctgtgagtcaccacaaattgggcaacgacagtttaacttgaatgttgaagatgtagtaacgtgtctaaatttaggtaggtgagatattgcgcgaattgcatactcgttatcaacccaagacataatatttcctctggccttaaactaataaggccattttatcactttttcttggcagcgtctttatccgcttttcgtttctttggaagagtttcgggtcctttattgacgatgtccccggaagttgtacctgatgcaatattctgtggattgccgcccgcatcacctgcgaccatctcagtaacaaactctttgtatgttttcatagagcctcctactatttattcatgcgtaatacgtaagcatttatatgtaggatacagcgtcggagacattgattttggattgtctttgataagcataaactgcttgcctgtatcttcacacttttgcttaatcattgcttcatctttaccagtgaatgccatcttttcagtagacattccgcctgaacctgtagatagcgccattattaaaacgtatgtaatcatcctaaaatccacttaacaatgttgaagttatcaaactgggcatcacagtaaagaacataattcaacttaagtgctgcgccgtcgtctttaagttctgcttgcacttctgtttgtttgctcgggtctacgttttccacaatatgaccaacatctgcacgaatctgctgagctacttcagactcatcagcagtcattgaccactcgcataagtctttgtcatagttggccatggcaggaactgcagagcaacttgatactgcgaacactaaagcaagtacaatctttttcattttggtttcctcaagcagcttgtacgttaagagcagaaatcaggcgataatcaccgtttgcgtatactaacattgacacattgccatcagtgtttttgaatggctcaacaactactaaaactgtatcgccttcatctaatgcttttcgtactacgccatcacaacgcagattagcatgtggagatttaactactttgcttccaactaccataccacaatgcggtacggtttccgctgattcatctttactcttaaagactacgtctaatgctttttcaattgtccacatgatgttttcctctactcgttttgtttcagtaaggccatagtatcatggcctttggagaaagtaaactaccttttgaacaattttttcaacaaaatgtcagaggtcagattcttggtaggtaggtatgtagcagagttaacccagatgccatcgctgtcatacaccttgacctctccatagtcgcatacagataggtctgctttgttatatgcctcgatgcctcggtgaatggtatctgtggctgttacgacaaaagagtgacctgattggtcacggaccgcgctaaacacaaaaatcataaaatttacctagaattttaactcttctgccagagcatcaagcttagaacgtgatactcgttcttgacgattagattcggctacacggttctgtgcaccggcaccttctcggacggtattgcttggattaggcttagttgggtcgttttgctgctcaatttctacccagcgttgattagccttatgcacacccataaagaacttattgttgatgttcttatcgccataacgtgatttaatctgcttaattaactgttgcttcatctgagcaagttcaggagtttcaatcacagctaacataaagtctgccgtagcaggtagacccgcagattctgcaatatcactcatgtccatatcagaagcatcccaagctgaacgaccgacctgagccgcggtccaaagaacagtttcagattctacagccaatgcacgaagttcttctgcaatagctttaactaatgtgtaactgttttcagtatattgacgaatacggcaagaagcacaaataccaagatagtcaatgatgataacagtcggtttaaagttcttcttgagtttcaactcattcagaagagctcggaatgtattagcgttagcaccgccagtcggatactgtttaatgattaaacgaccaagagtactagaactacgccatttttccattttgcctttatattcggcgtatgatacacaaccatcatcaatatcgtcaagtgatacatcaagcaaattagcatcaatacgtttagcacaaacttcttctgccatttccatactgatgtaaagaacgttatgccccatctgaagatagtctgcagccaatgaacacaatcctaacgatttaccaacgttgacgcctgccatcaatacgttcagtgtaccagtctcggcaccacctttagtaattttgttcagaatgctaagtttaaacggaactttacgagctttattctggtatgataaccaacgagcttcataatcttccatccaatcatgaccaatatagctatcaaacgatactgataacgcttcacgcatgatatcaggaatagcccccatatcaggaagacgcttatctcgcttatttggctcaagctgggcattagcctgaatttcaataattcgagacgtagcgttatacatagccttttcttgaacgtacttttcagtttccttaactaaccaattcaaatcttcgggagcatcagataacttatcaataagtttctttgcgccttcatgttccgtttcagttatagacgaattatccagtgctacacacaacgcagtctttgaaggaattgctgtatattcattaacgtgtttcttaattatgttaaacaccgtctgagcaggtccttgctcgaagtactctttgtccatatatggccaaaccttcgtaaagaaagcctggttgtaaatcagattagctaagattgtttctaccactttaacctcttaaaagattttccataatgattttttcttggtctttaatgcactctggatttgttgtttaacacaagcttccacatgaggataaagttcatccttatgagcttcagatggagtactaaactcaatagttacttcccccgaaggagaaatatttaatttatgaacataaaccaagtgtgattgaccatttaattttatcacaatttcttggataacagtcttcatagcttcttggattatttcatggcttttcttgaacactcgttcttgacgctcgaagtctccctcttccgagggagattcttgttcaaatttctcgagttcagattctaaatcaaactcagtcttcattcatgaagttctctaattcatcttcaacttcagcagctgatactgaaccactctcagggagtttaacaccatcaaccttagttgaaacttttgagttaatcatttctgctaccgcttcatcaaccgcagcgtttgaatcaatagcacccaactgatagcgagctttgatagcgtcacggaatggctcatgcttaaacagaggaccccaaaattccgtactgctcgtatcttttgcccgccaggatttttcttcacgaatcatctcaccggtttcaacgtccaggaattctcgtgcgtaccatccatttttcggtttaacaacaaatccgatatccagagccatatcaagcagaccactgtacggatctataccaccatcgaatttaacatcgatgaagaacttacttttctctttgacagtacgtgatttctcggcgttcaggacaaactgatatccctcaagctcagtaccatctttaatttggcgtttaccgatgatgaacacagtatccgcagaatacataggacctgtaccaccggtcattaccgtcttactgaacatctcgatggtctcgattgtgtggttaaccgcgacacaaggaatgttcttaatagagaagtaaggagttacgatacggaagagagacttcagacttttcgcacgagtcatatctgcgacagatttctcgttcagtgcatcttcggtttcctttttagacgccatgttaccaatagagtcgataaacacgatgactttttcaccacgctcaatagcttcaagctggttaaccatatcgatttttaattgttcaaccgactgaaccggtgtatgaattacacggtcagggtcaacacccatagatttcagataagctggagtgataccaaattctgaatcatagaacaagcagactgcatcaggatacttattaagataagcactaaccattgtcagagacatgttagatttgaagtgtttagatggacctgcgaagatagtcaacccggactgcataccaccatccaacgctccgctgatcgcaatattgagcatcggaattttagttctaactacatctttctcgttaaagaattttgatttagtcagttctgctgtcattttagaagtggatgctttaatcaggcgagattttaagtcagacattcattatattccataagtctccattatatttttctcacaggttaaaggatagggtaattatattaccttgttcttgaagctattaacagaagttccatttcttcttggtgttataaaccactgtttccgtatctatttcataatgcattttacatccaacacacatgccatgccaccagcaatgcattccatctgagccagtagttccttcatgaacaaactcatcagatttacatacgaagcatctgaattcttcagccttgaatatgttaccagctacatcagatttattatagatgttcataagaggtcctttgagggctttcgccctcacagatatggttctaccttaccaaactcgtggaaggcctgagatttcactcgagtgttaatacacatacgaattgatttcagaggttcgttatcaccgaataacccacgtctttcgccgtctttagatttccaacgggcttgatttgggaaagcagcatgtagttgttcaagggctctattctgtcgagcagtatcacgctgtgtagaacaaccaccaggagactgcaccttaccagatttaacgaggtacttaaacagagccaggtgaggatgacccatgttaattaattttagaaaagcataagcatcttcgttaaggtcaataattccgtaaccaatatcttctgctgtaagtttagtcaaatcatagaaagtattggtgaacccaaaactattctcgcgataatgaccccagcttgatgtaattttgaaaatcggcaagcgagcatggccatgataataaccacaatccatagcagtctctacgtatttgaccatatcatcaaatacctcttgactcattgcctcgccgacaccaagtggaacacggcgatcgtcgcgttcacgaatttcagtcagatgaatggtagtatcatcatcaagcatccaaattcgctgccctgcatacatttcagtaatcagacggcgagtaccagcgattccatcaacatcatcggggacagtaacgattttagcagcatgaccgtgccaagtttcgtatgcttctttttctgattcacgcactacaagatgcggaacataaccttcaggaaacatagtcagggcagtaactgccccggcacgcttataacttggaattacaaactgaatcatttccactcacctttatagtctttctttgcaatatgagtttcaccagtataagcatagttatctacaagatagaaatgacgctcatacacgtgcaaagacccgacgttccaaataatgtcgccaactgaataatttttacctgatgcattcagaagtttggttaactgttccagaacatagagctgccatgcatagtcattacgatatccaaatactacatcatttgaacgcatgtttacaacagcatgaactttattatcacgaatcagatactgaacattgttagtacacatgaaatcactcatgccatcgcgctcaaaatcatactgcatttgaggccgtgtataaatcataattccgcggcgagaatcaggattactgataagttcttttgcacagttagcaaactgcgaatagttttgtgatgaccaaactgcccagccatagttagaattaatctcaccatgtttggatgcaattgctttccaaatagctggggtttcacctggaatatctttaacgaataaactttgagatttataccactcaagttcccgagcaatatatccatcattaactgcgccaaaaattaggttttcatctgcaataaatgatgcacctacgatttcaatagtcttcacacccgtcttatcaatcacaaattctttgttgagcaaagcatcagcgaattcttgacggatatcttgtactgtcattggagttacaatcatgagacctcttatttaacttgctggataataattgtattctgctgtgcgttagaagcagaccaaatcagcgcaattaaccaaccgataatggaccaaccgaatactagatttgtgataaagattccaccccgtgatttatgcttacgactgcaagctacaaaggtcggcaaaaaatagatgaagaaaagaatgattaaaccaaatactgcttccatgttaatctcctcagttagacatgcatttgttgtagatgtgattttggagagattttaactgctccatacgttgtttatgctcattataactcaatccgccgttagcaaaatcagttaaacgaatctggtcattcactgctgccgcttgagcagtacatgtacgttctttttgagttttacgcagacgcttaatttcttccagctcatgcttattctgctcaatcatgtctagttccatcgcagatagctgacgattaggattagctttttctttcgccaaccgacgctcaaccgcgagcgattcagcagagacctggttgctagcacgatagtatcctacagtaccgccaattgctcgcacctgtccaacagaagaagccgggacgatatcaccttgtggcatttgacaaccagtcagcgtgagagcaacgataacagcaagtaacgatttcattgtaatctcctcagtatgttatttcgaaaaccatggtaccacatccttgtggcaaagtaaacaacttttttaaaaatcgaacatgtcaagaagagacgatttctcttcatagtctaaccctgctgcttcagacatacccgtcagaggtttaacgaacgatttttggaacagaacactgtggtcaagccacactagaacttcctgtcggatttcttgtggcagctcagtgcccgatggccatgccatgcatttctcaccgtacgggttaccttcacgcagcgggatgaccatcaccttctcgccttccatgattggtgttataccttcaaagcccgcggtagctcggttatacgctaaagcacctttgacgtgatacggagtacctttatctggatatcccgcaccatcatcatacttaccgatgttgttggcggtcttaacttctgctattactttatagtcaagttcacgatactcagactcaaactgcttataatattgctgtaaagattcttcaccttcctgcagcatacgccgaatagattcttccaacgcattctgaacagcagttggtgtagaactttgctgagtttccatacccatgattttcaggtgcggttctgcataacgagtaccttccatatcatacacgttcagagcatatcgtttcttcgctttccaaaatccaccaatgccgtttgaacctaacggaggacaagaaatagcttcacggtccatgaacattaaatgttctttgttgttcatgtattcacacatctcacgatatgattggtcaatccaaggttccattttcttcttaccgaattggttcaggaattctaccaaatcgttagtttctttgaaacgctcaagacctactttctcaataaccttatcaacacaaacgtaaattgagtcagtatcaccggctactacaaacgaatgtccttcagtaccgcataccttgttgagatattcattaactttacgttcaatccattggattgccatttgaccaaacaaggtgattgctgatgcgttacgtaaatcataataacggaagtaaatgttacccaatgcaccataaagggagttgatcagaatcttacggtttaactggttagtgttacccaagatttcagcgtgtttacattcaaacatcagtttgtcaagacactcttcggtatatgtcagcagttctgctttcatgtcatcagagaaatcttcatagacattaacttctgcgaatttatcgatagttccaaacttcttatcattcagaacctttttaatcagttcttgatttcgtttggcacccatcattttatttttccactctttacgctgataaaataccttcgcgatttcaactggaatgacaccatctacatctttacgatacatccaaccattgggtgaacatgaatattcatcagacggacgaggagcagtcttgttaatgtactcacccagcggatgaagtttaaattgtccaacgatagtttctggtgaaatattaacttgtcggattattgacggatacagagatgtcaagtcaaacgacatgatataacgatatgcagcaggaactggttccttaacatacgcaccaggatatgactgtttaacgtgagaacgactttgcggaataactttgtcttgctctttcagactgttaaagatgattgcgtcccaggttttaatcgggctcattacaccttgatatggcatcttcgcataataagacattgagattgccaggtcaataaatccacgaacagcatcaattgcttgtaccgattcaacgtcgatgatgttatatgaaatatatcgttggtgattagtttcacgcaatttattgatcggaccatcatatgctaatttacctttcttggtttcataataagcaatgaaatccaacttatatgtcggttggttcgtgaaactaaatttcttatacaaatccatgtaatcaagaatagtcacacccatgatagaataaatttctttatcaccatacatgtttgtgataatcttagatgaaaccttgttcagaggagagaaccgtttcatcgtacgctcaccaagaatctgtttcacacgattcatgatgtacggaatatcaaatccttcaatgttccagccagtaaaaattgctgggcatttctgttcccaaagattgatgtactcaagcatcatttctttttctgaattgaacggcatatatactacgcggtcaagaatatgttgtggaacttcatcaccgccttcggaatctaaacgagcagcgagtttcttgtcccactcggaaacggagccataaagcgaatgcagtaaatcaaacacatagaacttatcatcaaccgaatcataatgagtgatagcatcaatttcatattctgctttcatcgggtctgggaattgagatgcagtaacctcaatgtcacagtttgcgattcggatgaattttttattatagacgatttctgaaccgtaagtatcactgatatacgcgagtttgaaatcatccatacccattgcttccattcccatatcttccatacgacgcatccaatcgcgtgcatctttcatggttgggaatgtattcttcttgcaatacttgccatagatgtctttgtactttgtttcttccatgcaatgactaaacataacaggagaatacggaacacgacgcatgcgttcctcaccagtagaatcgatataacgttctacaatgtcattgcctagagtttcaacgctgatataaaattctttcatgggtttcctttgtttatagaccgagttattagtctttagatgggacaattatactccaatttttataaagtaaaaggcccgaaggccttttcttatgcaccaatcgtatatttagattttaaggtccattcatgtttctgcttgaacgtaatgacccggaagttattctgcatctgagcaagagtttgaccacgattaatactcagtagaccccagtcagcaagtagttgtgcgattgagtctcgacgaatttcatcttccaaatcaatagtaacagggcgaccatcaagcttcagcatttctttaaaatgaacaatatagtaacgaccttgtttctgaagaatgtggcagctttgatatagtaccttatctttgttattagcaattcccatacgggttagagtttctttaactttcaggaagtcttcaggctgtttcagtgtaatttcaatcatctttaccattccaatgctgttttcttaagagttttctgttctttcacgtttttcgtgattgtcttgaccaattcatcagtcacaagacctttcattttcttgagagcaggtttaagcttgtttttagcttccagggtctctctatacatcctagcatcaatcgcattgaccttgtaatatgtcattataacttgaagaatcaatgcatcctggatgttttctgttaacttagcccatttaccataccgacgacctctaggaacagaggccatcatatagttatagtgtgcttggtcagataacccttgaccaacaaggttcataacataaaccgaaggcatacagtcagggtgttgagaaagagcgttttcaaccatgaattttgaataatccatcgtcgagatattcaaatgctcttgcttttcgttaatagacccgataattgtgaagaattgattttctgctttttctttatatgaatcagataattcctggactttcgtccagtctttacctaaccacgctatttgatgctcgttatactgatcatcatcttcaaataaactcatcatttccactgcatctctacaacaagttgaataagcatataaaccaagtgtaattcaatcgaagctgctatgccatgatactggttattttcaccgatgatttcatacattcggataatgcttgggccagtaaccattgtatacagctcagaagaaagtttatctacaaaccaagtatagtctgctgcatatttcggagcaagagcacggagttctttgatgttcttagttttaatagcttcaatgacatcttcaattgaaccacggtcattcagaacgatagacaagatacctgcatcaatcacacccttagaagaataatgatcaagcatgttaatggtcttacggaattctgggaaattctttttgaccaaagcagctacaactttcttatcttcaactaccacgccttcattttcacaaattgcgagacaacgcttgagcatctcgatttgcattggcttaacatcagatggagatggtttaccaaaattaattacacggcaacgagactgaagaggtttaatgatgccatcaaggttgtttgcagtaatgataatagtacagtttgtgctatacgcttccatgaatgaacgcagatgtcgttgagattctgcaagacctgcacgatcaaattcgtcaatcacgataattttctgcttgcctgcaatagaagcagaacttgcaaatgcagttaacggtccacgaacgaaatcaattttacagtcagaaccattcacgaacatcatttcagcattaatgtcattacacaatgctttagctactgtggtcttaccggtgccaggagaagtgctatggagaattaaatgaggaatttttcctttagctactaaagctgaaaaaatttctttatcttcagcaggcaatacacactcagaaatagtacctggacgatatttctgttcccacatgaagtctgcttcgtttactgtcaatttcatttatatttcctcattcagattaaagatggggccgaagccccgaaattattactcaaaatcaaaggtactgtctgcttccattgctactacataagaggctgatgcaccttcaaatttcgctgcagtctgtttcttggagccattcatttttgcccacagcatcagtttataatcgccgatagtcattttcatattgctcatgttgatgataaagttgaagttaccgtcaccttcataatcaccgagtgtcagggaatacttcggacgggtcagtgcagcgtcttctactttattataaccgcgcagaacaattttaccatcaacattggtgatagcaattgtgtcaatctgcatgccacgagatactcgcatcagctgttgcaggtcttcacctttaaaatcgataattacgtttgccaccgggaatgggattggtttagtcgggaacacgattgtgctcgggtcagctgctggccagaagatagttgagcgagcatctttaattgccagattaccatcttcctgcatgataatatctgcatcatcaccaaccagagacagaatgctcagaaaactgttcaggtcataaattgctacatcagtatcgatggtatcagaaattgttgcttcagcataagtcgtaccattaacagcacgagtcatgataaaattgccaggtttcagcatgataccggagttgatggtggagaagtttttcagaatgttcagagtttctttagagaatttcatttcaataccttttaattaagttcaggataattatatcaagctgcgaatgtagcagttaattcttctgcaacaatctgacctgccgcaacgagttgctcatcagcatctacgcagtaatcattttctagacgttcgccaccatgacggtcagtaacaattttagcaccagccttgattgattcgttgtaatgcttacgcatcagttcaatccatttttctgcgacttcatcatcgatagatttatagaaagcaaagcgagcttcggaatctttaatcttatctttgatagcctgtttagtttcttcggtcagagccagaacccaagacttacgaatacgattttggttattcgggttggaatctgcacgtacgtttttaacctggatatctttcacatcaacaaaattaatcattatatttaccttaatcgtaataatcttcaaccatccaaccgggattcctgctggacatgactctattatattcatttcctgtaaaagcgtttcgtaacatttcttcagttacgagatgttgctcattagaaaacaaattaattaacacatagcgctttaattcaggaaaggccaacagatgttggcccgtagtaaactcattcattccatcaccgtgaatcgtccgaccttcttcatttgaaggtgttggccatatgcctgcgggtcgtggtcacggtgagaaataataaacacattagcatctaccatcttattcagaatagcagttattgccttaacaccttctgcgtcggtagccgagtcatagacttcgtcaaggaacaaacagtttattttaacaccagaaaccttttcagcaatatcacgccacgtgaatagtaatgctatatcaattcgagctttttcaccttgactaaacgaggcataactaaattcttctcgtccacgtgatttaatcgtttcagagaactcttcgttcagtgtgaacgaataatcagcttccataatttttaggtagctgttaatttgcttattgaacatcgggatgtacttcttgatgatagctcctttaataccggagtctttcagcatttcagttaaaataccacgacgatatttttccataaccaaattagttttgacgaggataattttatctaattcttcttgtagcagtttaatcttgtctgagttatcaataaactcctgagatgctttatcaatagctgctttaatgcgacgtgccttttccacagcagtgatagtcatttgctttaaactagacatttgagttttgatatctctggcacgtgaccggacagtgttatactcgcgagctagttcatccagttcactctggcgcgtctttaactcaccaagaatggtattacattcttcaacatgatgattaatcttagtgattagagtgtcattagaatgcaaatcctgcaagcacgttgggcaatgaccacctttatcatacagtccaagaacctttgaatatgattcaattttagaccgaattttaaatgttttaccttgaacttcttggattgactctgctgggtcgtctccaattactaactcaagcagttctctctggagagtttctaattctgctttatatcctcgtgcctctttcacctgctcatcatacatcgcctgcaggcgagctacgttatcaccagaaagtttcttctgcttttctgcatactcatgatgagttttaatttcattagtcaatgcttcacgctgaacatcattaacctggatttgctgattgatttctcttatctgtgtcttgttcagtttgtccatatcagctaaaagagacacttcaagcaaatcttcaacgagctttcgtctattagcagttgataaccccatgaacggagtatatcctgccgttcctaatacgacaatctgcttaaacgatgtgtatgacatgccgatgagactttcaaagtaagattgaaaatcctttgaacttgcggcttcatcaagcttattgccatctcgtaaaatctcaaagacattcggtttttgtccacgtttaatgtagaaactatgaccgtcatactccatccacagttctactacagagtccttcttattgaaggagttaattaattgacctttcttaatatcacggaacggtttaccaaataaggcaaaagtaatagcttcgagcatagtacttttgccaccaccattcttacctgtgattaaggtcttttggcatttatcaagttgaatgtcaatggccgcttggccaactgacattatattcttatacttgacacgatttagtttaaaagtcttcactgattttgtgcctcaatgtataactgtttagacataacctttaaggctttgatatcatctgcggacaggtcttcaagtgcttggatatattcttccattaaatccaataagcttttaacttctacttcttcgccatcttcagactcaaccgagttgtcaactttagaaacagttcttaattcatgtactaccttttcaagttctgattcaaacttaggaaggtcttcatcgaccgcagtgataataatgcgtactgcgagattacgaaactcttcaaagtcaatttttccagtaacaggataaatcagttttctatgccaagtgatttcattagggacgaaatcaaaggttgataattcagtgtcttgaacccagaagccacgtgggtcgttctcgtcacccgctgtaagcgtccaaggcgttccgatgtacttaacgtttgctgcgcttgatatggtgtggaagtgcccagaccatacttgtttgtactttttgaggaaatctggttccagcccatgagacttcattcctttataaaaataaaagccattaagctcccagtgaccaatacagtattcagcagacgattctttgatatgcttcatgatttctgacgtgttctcttcacacatccatggacacaagtcaatcaaagtcccatcaaaatccatagtcacgggcttttcaataacagtaatatgcttatacttaccaagaacttctgttgatgcattaggcgtcaacgtattcttgtagtgcatatcatgatttccgacgatcgtaattaagttaattccttctttctcaagagactccgcaatttcacgagcgaattccattgtcttatgagtgatagctttacgaacgtcaaaaatatcaccgtattgaatgatagttttaattccatgctttttggcataatcaatatgctgcttaattccgtgtcgttgtacatcctgtacccacgggtcatctgcgcggacacctaaatgccaatcgcctgagtgaataattttcatataacctctctagtagagtttaattttatattattccatgaatagcaaaaagggcccgaaggcccattacttattttgtcattaactcaaattgttctttaaagcaatgctcagaatcttggtgttctaccaggaattcaaatgctttatttcgctctttatcatagagcttctggtcagatgacagatgtttcattcgttcaaagacttcatttttattttcatcattcaaccacagaatgccagaatcatgagaagtcaacggctttccatcaacccggaatttcaaagcatcaccagtagctttatggaacacaggaatagttccacaagcgcctagttctaaatgcgtgtattccagcgaacgctcaaggaatttatctggaagacgtgacagctgataaccaaatccagactgagacatacgctcaagcatttcagagttaacatatcggtcaagaacttgaggattcagacctggtccagttttaacctgatgataatgacggcaataatcaatttcatagcgttctttgatgttaataaatgcaggactgcgttctaacccttccaagatagtcgttttgcctgcggggcgcagatgactttcatgaaagtcaaacatcaagaaatagcctttccacgtagtagtacgaccaatccaacgatgaatatcaaaatcaatagcagagaagtctttccaatacttatcacgaattgctttgatgttcatagcaggttgaaagttataaaccggaggagctgagtcagaatcatcaaagaaactcaacccgccgcttggaaaatattcttccattagcacggtattaaaatcgccgtttgagctatgactaaacagtacatcagcacgcttaacggtttcttcaagaccagcatttctacgaagtgacaatgctctatggtcatgttgatatacgactaccctaacttcaggtttaatgttctctatgagcttcttatagttatcaatcgctgcttctggagcattgatagcaggtactgagttaatgataagaatgtcacatgcgttaagcagagataaagtcttatcatagtcatctgcaagagacacaggaatagttacatctttatagctatgtgctctattacgagtaaacgctttatctttagcgtaaatgatatttacttcatggccatgttttactaaccactcacggtgctcgagactgaacttggttacgccgcatccctcaagtccgcgagccattaaaatattaatcttcatatgttgacctttgttgttaattttgaatattttaccattcccgtaataaagcaaaagggccgaagccctttaaattttcttgtatacaacataacccgctgcttcacatatacgcttagcttcttcaaagcgtctaagcatatctaccttagcattatgaatcgcttcataatcgggagcaggtgcttctctccgagcagtatcacatttataacagaagtaactacgctttggtcctgtataacgttctgaacaattactgcaccggcatgtataatttccttccggccaatcatgtccaggattagaacccatcaaattcgtcatacatcccaattctcttcactagtaataaaatcagggtgttcatctaaatcaatgaatccccagttctcttcatttaccattcataccaccgtttaacttggaaggtgtcaacccagacaagagagttcttatctattagcttacatccttcggtagagcctaacacgcgatattgattatctgctacctttactgccatcgtaccagtcgcagtgtttaaagtaaatcctgcgtctttacgaacacgtttaaattttacttgtaccagcatttagaatgtcccaaacagatttacgagaggtattccaacaagtcagaataatctcatcattaaaaggttgttttaaaatagtacgcagtttttcaatagcatacttgtaagcagggaaattattgtctaataccgcgtctccagcatgagctcgtaatcgctcaagttcacgacggtttttacgaacaactttgttggctcgagcaatagcttgttcttctgccgcttccattagtttctgttgcagctcgtcgcgctcttcctgggtaatattgttcatgttattcctttggatggtaatttatttcaaatgtgaattcagtatcagtccaattataactgtgttcaattatagcagaatctgacctgaaatcagcgtcatgtggatttttcgggtcaatgtgaatatcaagatcaagcacctcccttaaatacatctttagcaaataagggatagcgtctaggtcttgcacatcttctaaaaacccgtcgaggttaatcttcagcctcatataaaaattccagattaggtccatcgcttgtaggttcgctctttttagcagaccctggcgccttataagcggtggattcatactgcgtcattttatcgtagatgtcctgaataaaggtttcatctgctaacgcaaccatatcatcgtcccgtgaatcatacacgttgtggacaaaatagctgtatttctttgccatttctttgcgttcttttttgatacgctgaacgaatgcattgaaacaagcttgggttatatacgcatgcgggttatcatacttagtttcatcgaagttgattaagcctttaattgcggcttcaatcccgtctgaaatcatttcttgcttccaggattgggtgtatcctgaaaagttgaaacgcttactcagaccttctgcgatcagcataatagcaaggccgatcgtatcgttctgttttactactcgaggaccgccagcagcttcagactcccgacacttctctttccatgcacagattgatttatacagttccttgttatttacataattactcatattgcctcttcgcttcaattaataatatctattataacaaatttgggaagcgagaggattaaagcattacttaatcaattcagcgcatgcaattaatttcatcatgatacgataaaaatcgttatacgtgaaatctaatggaacatcaatgacggcttcaaaatcttcaaatacacgctccattccataaccagcgatatcatctgattcagcataccagtacgttccatcttgtgcaaaagttatttggctattttcaagacagaacacacctttaatattttcatgtgtaagagtcaattgaattttcatagttcacccttcataatacgatagcattggaacagctgttccatgatacgtttgaactcaaccaaactaagttcaaaccaatcagattcatctacttcatgcatcatttccatgaatgaagagtataaactttcataatgggtttcatttaacatagaggcatgcgtttcccaatacatgccctcttcattgtcaaaccaaacacccatataagaatctatagtaaatccgccaatgccttctactacaatcataatttggtttactttagccatgctttcaccgagtcaatagcatcttcaaatttagagaaagcatccacggatgtgtattcattctcaccagagcgttcataaatccaaaacgcgtcaaaatcttcttcaatgatgaattctccgttaggagtttcaatcgtgtttctgccatcaggcgttttagatataaaccatccaagaaaaccaacttctacaatttgttcttcagtcatttagaatttccaccaattgattatagtttaatgcctttccagaagaaatcataacattacaaaatctgtataatgcttcttttgatactttatacacataatcagaagttgttataatgtatgaaatacgtacaaatgttggggatttttctgccaattcatacgccagttttctagctctgccaatatcatcggcaaacttggtatcagcaagcaaaatactatcaaatacccaacggttagtaaaaatttctgtgtatagaataaccttacgcatcaagatactctcgcagttcctgctcgtttaacccttcttgccacatctctgacggagatggaagttggctgtctagagtggatgaatcaattggaaatactctgataattacgctagtatcttcatcccattgatttgcgagtatccgtttagcttgactaatgtcaggctcagaatgagcccggatatacttaatccttctatgccatacaccggtaggaatagatgcgcacacgatatatgaaatcatttagccgccttaaccgctttaacatcgcggaagcctttcttacgttgattcttcatcttacgaatagtgctttcagaaatttcaccgatacccggagtgattggttctacaccgaaggctttgatgccaaattcagacagaagataagcaaccactaattcacggatgcgggctttaccaattttttggccttcttctttcatcgtaccgtgaagctcaacttcccactgatcaagcaaagacggagttacacaacgtccttcttccagcattgcagatactttatcataagcaaaagagttcagtacgtttttgattgcttgggacatattaatttcctcagtaacgattgttttgacagaggagattttaaatcaaatctcctgtagcaaatcaatctttgagagattttaactcttcgagcatatcgtagtattctttactagcaaccggagctacagtacagtggtagctattgaattcatggtatttcacgaagcgttcaagttgccactcaatcaggttgttaattcggtgaagcagaaccccctctgaaccgacgtagacaactacttcaaattgaagcccatcccaaattctggtacggacgatatcacctacattaaatgttttcatgcgatgtaccaatgttcgttttgccaagactcacccttgtaccagcgagtcatatcatatccattttcatcacagatgaccttgttcttcatcaagaagtattcgtcatcagtaaaatgcacatgctttactttacagcctttactcatagcttctagagcttcttgccaatttaaccagttcatattttcctctcgagttaaacggtatgctgttatccgttgatagagctatagtatcactcatcaactagcttgtaaacaactttgtgaaaggagtttaaaaataaaagagaggtcccataggaacctctaaatgaagggtatagaaatatacagaaggtggtcaagatgaccttagaaaggaactggttaatcttctatgatatctgggtcatgcccagcagcaataagattggttttgaatgttggaatgtcatactgcttaacgttatccataaaaatgacaggataccgaatagcaagcgatggatagcacccgatgcgtttagcaagtgactcaatcaacggacggtcataaaccggttgaccgtcaacctcgttgattacgttataaaactcatacggaagttgtagcttatcgagcaagtcacgaactgctttacatccagggcatctccaaacttcttccgggatgccatagatttctatcatagttcagccttaatctcagaaatcaatctttcaattaattcaagtttatccgctgtagtcataggataaattttgtcaacagtggcttcttcgagatagcaacggtcagcatcattgagtatacaccactgatcaaaatcatcagcatctatgctaacaccgttgaaggtcttaactcgttcaacagacccgtcctgtgtcagagctgttaccaaaaatggcttaaatttaagcatgttgtagaattcaacatcctttgacgatgcgttatttagccatttatcaacagagtcttctttaaacttgtaccacttatcgcaacaaaataattctatcatttcatgacctgttgaagtttagcagtcagagtattaacacgcttctgaaattcttcattagacagtttttcatctttcttagtaggattaatccagtcagaaataatgatgagaacaataaatggaatagctacgaaagcacctgcggttaatgcaaccagtgcaataacattagaaataaatttacgaatagcattaatgaatttcataattttccttaaatagttaagatgaatgctgtcatagccagaaattctggtccaaacagttcagtagccatgtggttcagagtaaacataattttgtaagtcagcatataaatttcctcaatcatgtgtccaggtagaaccgtttcttacccagagtctttggttgtcagaaccacgccagtttttagtagttggcagtgatttctcatatttcccatcaattataacatcgatgtgttgtagcaaatctaaatctttgatatcttcaaacttatatcctgtccacatccagatatctttctccggaaatcttgctttaacccaagaaactaaatttgaaatctcttctcggttctgtggataaagtgggtcaccgccagttaaggtaagaccttggatatacgatttgcttaagtgagatgcaatttctttaacggtattcatagtgaatagctgtccgttacgagcattccaagtagatttattataacacccttcacatttatgcaaacaccctgtgacaaaaagaacgaccctgcatccagggccgttcacaaagcaacatggatatattctatcatagttcatttatatatttccaattatagccttcaacacttttgcgttctccatttaaacattttaaaatatttcctttactagaaatgttaaaatatttcgcagcatccggtatatagttaaatgtttttaaaagaacaccgtttttatatgcaccaaatacattgagagtatatttttctcgaagacgctggtgctttcttttcataatttcaggattttcatacgccagctttaatgaatttttgtgccgctcttttacttcaggcttttgcattgctagcttagttaatctagaaattttgcttctaactttatcgtctttcattgtatttgataaatttaataaagttttatttctaacttcaggattttgcattgctagcttagttagttctgcatgtctttttctaaaatcatcattcttccacatggtcttagacaattttgacatagaatgatgaagcagttctctttcttttgaatataatttaagaatttcatccaattcgtcagtattaaatctattaacgtttgagtttatcattctatgaaaggcataacacattttaccgtttccagtttttgccaaataatagtgagctaacgcatggtcatagtatgataagttaacgatattccatttatctgatttatgctcaggaaatatagatttaggaagcacatggtgtgcttccgtctttccttttattttagaattattgtaatttctttgtattaaagctgtatacgatagtaaatcgttgtcatcttcgaatattgaagatagcttatcattcacaaaatcagaagggtagattctgtcgaaattcattgaaccttacctcattacgtgcttctacttctgcatcatatttccagggctcatcagtttgaatagccccagccgataatccactttcggggtcacgggttatagcaattccaagcgggtgcagaacctctttgttgattttccaaatcaatccccattcgctaagttggttccaatcaacttgcttcattggtttctctaacatgttttaccctatgcataatttctttgttcttaccaagattgaacccacgctcagaaggattaccaagatagccacaggttctgcggatggtattcattttctttggatcagtttcaccgcaaatcgagcaagtgaatccattttcagtaggtgtcatctcatgagtagaaccacaagaaagacatttatctactggcatattaacaccaaaataatccaacttctcgatagcatagtcccataccgcttcaagaccttcaaggttgcgcttcatgtcaggaagttcaacataagaaatatgaccacctttagcaatagaatgatatggtgcttcgcggtcaattttttcaaaaggcgacaggttttcttctactgacacatgaaaactattagtgtaccagcctttatcagttacgcccttaacatcaccaaacttggcttggtcaatcttacagaaacgatagcacagactttcagccggagttgagtacagactaaaggcatagccggtttcttccgtccacttgtttagcttagtgttgatgtacttcaggacgagtttaccgcttcctttaaaagtaagcatatcaaattcgtggatgccaatatatcctaatgaaattgaactacgtccatttttgaatagctcaagaatttcatcatcaggtttcatacgcacaccaaaagcaccttcctggtaaagaataggagcaactgacgcagtaacaccttcaagtgatttaattctagttaaaagagcttctttacaaatatcaaggcgttcatccagtagtttaaacagtttattactgtcatctgaacttttataatttgcatccagagctatcctagggaggttcagtgttactacccctaggttattacggccatcaagaacgggtttgccagaagagtctctccaagcaccaaggaaacttctacagcccattggagatacaggagtttctgaacctgtaattgctctattatttcgagcactgatgatatcaggatacatacgtttagctgcgcattctaatgcaagctgcttaatatcatagttcgggtcttctttacgtagattaatgccttcttctacaaacatcacaagctttggaaagattggagtaattccatcgcgacctaatccacgaatacgattatcaagaatagctcgttgaattaatttttcttcccatgacgttcccataccaaatgtgatagtcacaaacggagtttggccatttgagctgaacaaagtattcacttcatattcatatgcctggaaagcatcaaatacatctttctcggttttagaaatagcgtaatcttttactagagctacttgatatttgcgtgcatcacgtacatgtttagcgaatgtcttctccacataaggagccaatactaaatcgacgttagcaaacgtagttccaccatactggtgagatgctacttgtgcagtgatttgcgccatgatagcagtagctactccaatactcttaggagtttcaatttgagcgttaccaagtttaaagccattctgcaacatacctttcaaatctactaagcagcagttagtgaaaggcaaagctggactatagtccatatcatgaaaatggataacaccttctttgtgtgcttccattacagagaaaggaatgacctgattggcgatatgtttagatacgataccggccatcaggtcacgttgggtaggaaaaacacgagaatctttgttggcattctcgtttaaaaggtccttgttggttttattaataagtccctggatttctaattcgatattcattttaaactcttacgaagctgcttcttgtattttgaagcaagttgtgattttccatcactttcctcgtatgtaaacccatgcaattccatttcagcaatcatctcaggcttaccaagacgtgaaaagcgtttagccatatcggcaacatattgcgggtgaatattactgtctttacgattctggcggagatagaccagcaaattctctaaccattcgaggtagtcaatatcttgaccttttaaaccagagcggttgaacttatgcttcatttggccttctgccgcattacacaggttacagagcaagcctctgacctttcctgcattgtcaccttctaacgcatggtcatggtcgaggtgattcttttgaatatcctcatctaaaggacgtttgcagcaaggacataatccgttctgtgcctgatatagtttttctttttcttctttatataacttaccggttaataacatactcttacctcagcgattagataagagtatttatagttaaattaacgagtaactactatagatgttatgattagactcttttatgcagaaagaagtacagaaagcatagatgccttcataatcatccgcattgaactcaatatatgaattagtttcttcatgaagaagactcattttagtccaagccattccattgatgtcatcgtcgtaatagcctccactaaattctactacatcgccaacttcataccaatgactgcgtaaaatttctcttgtaacacgatgaatatcagcgaaatcgagaatttttactgtaatagttttagtaatgcacgatttagacatggcgaactccaagacgggtttccaatgcgacgatgtaatccgcggctttttgcattaaagcatactcttctgaatcacaattttcctgtccagcaaatgcgtaaagagctctggtaattggaacgattgcgccttggaaatggttaagtttaatttcagaaatcagaggaacatcttcaccttgaccgatttctttaatttggtgcatcgtatcttcactgtagaagcaccagaaccaagattctccgtgtggagttgggtcgttaatagtaatgattttgtttgtcagcaaatcaattacggcagtaattccacacatttcaaggtcatcttcattaactacagaaatgacttggaacttaaatcccggaataaacacaggaaattgctctgttaattcgtcatcattaataatgacttcaaactgcttaccaataagtcccattcactttgtcctcataatcaagtaattcatttatagtgggttcagaagtattataatcttcttcaggaatagcatcttcctctggctcgacagtttcccagcgagccgcataccagggttttagacctttgctactttgcatggtgttggttcagaatcattagcagaatcatgttcaatacgccattcaacttcagtgcgagtaaccactttttcatgacgtgtaacgatatctacttcaggaggactataataccaatcagtatgatatgagcctgaacgagattctgataccatgaaatgaacgccacgcgctggataataccaaatttgagtgcggtcttgatacttgtgctcttgcgtccaatctccatcttctactaaaacaaagatttcttctgcatcatcgtctggtgcattaggcggatattcgaaatcgtagttgtcgtcccaaccgccagtgacgccagcgatatgtttgatttcttttactaattcagcgttagtcattttaacctcgcagcttctgtaaatcttcatcatcaatccagctttctaaaccggatggaagcgcacattcaatttcccacagcaattcttcaattgcttgcaagcgttcaagctcttctgctgaaatagttaccatgcgtggagcttttaaatcgccaatatcataactcatagttcttcctcatgttaatcataatttcaccatacactcgccgtatttccatttagacataaccttaactccattagagtaagttacctctacctttgctcgatgatttttgatttgtttaatctcaccggtttctaatccgccatagccataataaagggctacaatatcaccctcccgaaggagggttccacgataatcatgcattgaacttgaatttacggagttcatcaaaaccgccgatatgtgtaccgtcaggagcaaaaatctgaggcatagttaatccaacctgtgattcacgacctaaacggcgaagcaaatcactgataaccacttcatcaaatacacctttttctggcattacattgatgaatgcatattcttgcttcttaacgtcgagcagacgttttgcgttatcgcaaaatacacacttatgaatgctgctgtcgtaaccaaaaaccgtgaacatcttcttctatttccttaaatacttgagcttgaactgttttccaatctgggtggcgtactgctttaacgtaatttgtcataccaagacgcttcattacttcgccatcaatagctgcttgagcaaaatttcttccgcgggtcatagctcctttgagtttagaactatcaactatttgaccagtctcattataataaaccgaatacatgagtagcattactcgttcggcttcttccatatatcgtttacgagccattttcagccttagtagttataactaatgttttaccatctaacgcatcgagaatatctttgatgcaattatctggcattggttgaacgctagctaattgcttggcaatatcatcaggaattcccatacgtggtatatttaatttgctaaaatcaattttatccattagcagttaccgggaagtgttctgccaatttagcagcaatggcagcgttaatttgatcagcgaaatttttattcattgcattaacaatgatttcttgaattcggagattagctctttcaatagacatcttaatacgaccttcagcttgcttaacagcgtcatcaatagtttgacgaaccatatcatcaatagcatttttagcgcatgattgggcagcgttacgcatcatctgcgacatttcttctgtagcagacatatcattccaaccgcgagtatggaacatctgctgaacttgcttcttaacttctgctcggacatctggaatagtcacagcagcaatattaacttcagattgtactgcttgcttcagcttattctgtgaatcttttaacaccatttctttaacgatgttattgattactgactgttgcagttgagcacgggctgctgtaccttctgggaataactggcgtactgcataagtatcaagtttaatatcaatcattttacctttttcactccaggaatattagagatagtttcaaatacttcgtcaaagttatctttatcaacagtgactaccatagtgcgagcggtctgtttctttttccaacgtttaaagaaagttgcaagactcaaatcatgggaagtgaagaaatcatcggttttgtaaacatatccgctttcaatttttactacagcatcaggtgaagggtcttcatattcttctacttcaacatcatcaaagagaattaaagtatcatcatgataatagccttcccagaaggcttcatcgttataaaattctttccaaagcgcgccagttgttttcatttaatcaccttcttccaagcttcgtgagcagcgcatgctaatacttcatcatcagtcaaattaaacttgccttcattacgacgagcaatcatttcattgaattcagtatcagttctaagcatcatgttaagaactgtaaaatccattgtcgctcgaagatattctttaagctgcatagggtcgatgccactttcgtatgcgtcaagaatcatatctgcaatgatgttatcaaagtttttgtcttttatgaggttattagcatactcgacaaaaaacttagtattagcaccagtaatagttttagtaatcattttaattttctctcaaatttatgcttacaagtccggcatttcattttcagaatatcggttgtccaatcgacaagctgtacttgaatactaccacatttttcgcaaggcacaacttgtttagctgcagcttctcgacggtctaccatttcaagacaggcatcccagtcaattttaaattcaggtacaggcggatactcaaactcaatttcaaggtcgttatcatcaacgaccatgtcttcttttaattgatttttcacagtaagctccgggcatactcgagagattcataacgctctttgtattcgttaagcgatttaaccaaatctgccatcatcaattcatgtttagccaattcagcttctttagtatcaatgaaccgcttaacagattccatttcaattgcaatagaattcttagcaatttcaatatgatttactgctgtcatctgtaaaggcttaacttgagctaggtacatatgagctacatcggtatcaatgacatgttttgtcattggaggaaaaatcttaaatgggtccaaatgcacttcaagagtagatgaactttcaagaagcattttgcattggacttcttttactatatccatatgatttaatgcattacgaacctgagccaaaagagcacgtgatggataatttccactagtccaatggctattaatatgaatacgtactgttacgttgtcaagttcttctgcgcgaatactgtgaatccctcttggatttttcggattagtagatacttggtatttcacacgatcagtatctttaagcaaagaaattgagcgattaagaatacggcgcagattgctattgaactcagtacagaaaatccgcgaagcagaatgaccaaattcttcatcagttttaaatgatttagacgcaaaattataacgataagatggaattttagtgtctccaacaatgaattgcttcagttgttcagcagcagacattgcacctaaccaacgagagcgacgaatattttctacaaagaaactaactacattggattcgctagtcgccatattatctagagttcgtttggcaaccttacccgcaattgctacatcataagcccttggatttaaatcatgtaaagctgataacaccttaacatgtttctcacgcttcgtgagagttttatctttcaacttattaaattcagcttctacaaacatctttaattcattcttattcattatcttttcctctattttggactgggctcaaagagtatctcaaaatctccctgaacccattatacaacaactattcatcaagcataataactttgcttggacgcttatagaaagcatgagttttatcatctttcgctaattcaaatgtagcagtaaactgtactttgcctctgtattcaaacggaatactttttggaagggagccgtaaaccgtagctccattctcaagcacaaccatcatcttacattgtacgccgtaatagtcttcataaacttttactgacgttactgtaccagagacggtcactcgtccttccggtgcatcccctttattcttattcagctcattgaatatattatcaaagacctcttttgaatgttcctggatagcctctaagatgctcttatgagctctaacttctgccataacaacatctgtgccatcttgcaatttccactctttatatggaatgcgtacttcaagaggataaccatactcccgaagttctttgtactcttcttgagttaagcggattttccaccaaccgtggtcaccggtatactcaggcttatccagtgaatccaattctgtaacatacggcaagtaactgcctgcgtgataagcttcaacttcacctaattcattttcccaaagataaccatcaaagggagcatgaggacgatcatctttgccccaagtaggagctaccactttatcaaagtattcacgaccgaagcgggtcttcgcccatccagcattcaactcctcggcgcgtttttcaactttcgctcggtgtgcttggcgggctacacgattttcttcaacaagtgcagagataatctcggttaaagttttcattttattctccagtttggttgacgagaccatcttatcaacagcctcgccgaaagtaaactactttgtgaaaaattttctccaaagcagaactgcgtctctacgagatacttctactgctcctagagcaactgcttgcttgcgacgaacatcacacaaatcatagtgtggaactcgcttatcctggaaccaagaacgtttcattccgatggcttctgccatagcatgcaactcatcaagattgtcgctaaacatgtggcagttctttacttgatgacctctcattttccaaccatgattcatcaagacatctacgtatactgtcatttatgattctctatgtaagtttcaatgatgaactgtgctaaacacagaagattatcttctgaaggagaatctactaaattctcaaccatttcagaaatagttccaaaagcttcttcagtattgaacatttcttgaagttcgttccaagtaggtgctttcatttcaatctcctcattagttaacggaagctatcttatcatggcttttctaagatgtaaacaacaaaagggcccgaaggcccttaaaaagatcggaaatcactgttaaaccatggcgactggtgttgtcgccgtttaagcaatttcagttggtgtttcctattgtcttctataatcatcttagaggcttttagctcttcagccaatgagacctgtttacggtccatcaagatgaggttctgggtcttctgggcaaatgtctgaatatctttaaggcattccacagattcctccattcctcgcttatacttggttcgggcagcatttaactgcccttcgtaatacgcatgtatagacactatagtattaaacatgggttaccctttagcataattgacgatttgttcacgatcagcgggccaatttaaatcagaacgtttcttgtttgaccaagcaatattttcttcagcccaatgaagtttagccgatacgctcttttgtacgtctctgatggcttcttcaagataaatgcctaaatctctcgggttagttccttgagttttaaatgcattgagcaaaatatttcttacgacttctttaaattgattttcaacttccgggtgaataaattcacgataaccgttgcacggatatccaaaagcatctaccatacgagtagtactaaattctttgttcataatccgagcgcctcgcgttcatcaggatttaatttagccaaagcggattctttaattttttccaaccgtttacgcttagcttcaggtgtttcttcctgaacactaatagcagcgcttttaggaaaagtccacgattcaccattttcatcggtgaatgtaattagttccgttggcttacgattaactgtaccatctgagccccaccaagactgccccttaactgcttcttcggcaacgcaatatgaaccataataaccaaacaactcactacgacgatcgtctggtgaaacatacgctgcataggcttcactttccgtcattacccagtttttcattttagcacctcataacgaataagttcaatacgatttttaagctcttggtatgatttacgccaaggcttataataggcatttaaatcttggtgttgtttatgcatttcgtctaaatgctttactgcatcctgcacatttgcaaggaaagtatcaaatactttattagcgtattctttcctgagctcaatgaatggaggagcacgaaatacgtttaccattacacgtaattcatgataagaagaatggacttcagctaatacatttttcttatcgccaaaattaaacttataaagtttttcacagattgcttcacaagctttctctgctttacccttaggtttacctgcaaagatgtgtcccggtggatatactttaatatcgtttaaccaacattcaatatctttaatagctgctaaactcattgtacccacgctccgttttcatcaatgtaattaatccactcgttaatagtccaggaagaggtattacctttaggagtatcaacgatatacattccgcctttaaacaaaacacgttttacatcattagaaattaaagtagccattatattttcctcagttagggaggagaaatcctcccgtttaaattatttcagcattgttacttcagcaatttcacgccagtttttacggtcagtcgcgacgaaatcaccgatataaagagcagtacggagagatacgttacgcagacgatttacgttatctttcataaattccaaaacttcaataacttcagaatttcttaacccacggttctgtaacatagaagtggtcattattacatcttgaacacgaaccataatctcttcattagtgtgaacaccaaggtcaagataaaccgaacgtgataccagagcttgaagatgcggagcaagtttagaaccacgctctaattcacggtcaatatcaacgttagtgataaagaccacagtaccttcaaactcaaactcattaggaattcctttatcttccaagaaagaagatgcagtgctccagcatactttacgtttctcccctgaatccaaagcagctttcagaaggttaagaatgtccatatcagagaatacatccacatcatcaatgagcagaactgaatttgcttcacgtgattcccaaagacggcagtataaaccaattcctgagattttaccgttcactgatttgtaatcaatagcgttagtatcatgagcatgttgtaatgctttatccaaagagtaagtcttaccgatacctgctgctccggagataatcagagaacgaatattcccatgaattaaaccgttagtcattaatcccatgacgttaaagcgtttcttgatacgctctttcatttcatcaacggattcaacaacttcaatcttagcagctactccgtcaattacgatatcatctttgaatacccaaacaccgcgctttttaccattcagttcaacaaagactttaccatcaccctgacgagagtcttcagcacttaagctatccgggaaccactcaccgagtaactcataagtacctgaaatctctttgccgaagtaaatccctttcttgatggtgatagttgacattttattctccgttactctgttttgttttgatggagctatagtatcattctacagctccaaagtaaactactttttaattatttttctaaaatttcattgatgtagtaaggacggacctttgaaccaagatagaagtcatctacaaaatcaatcaagttgtcagtttcaccacggatgatagcaagcttagagaacacttctcccaccatcattggttcaaattctacaccgtgagcttcagcagctttaaaggctttatcaatgttgtttacgacgatttctaaagttttcattttattctccattgtatctgtttgggtggtacaggtctatagtatcactagctcgcgagcttgtatactactttatgcattcttttgaaacaaaaagaggagcccgaaggctcctcagttatgcgtgcttgttgatagcgttttctgcgatacgctttggaagtttacctgcccagcggaagaacatgataatcgctccggcaataaacgcagggaaccaaaagatgagataaaaccaatactctcctgctttctcgatggttccatttttgattagatgcttacagacagaccaacccacgataaagtaaattattgcaacaacgattggcactactacgctccaaagtaaaatcatatttcagcccagtaaagtgagaaccggagctcttctccggcccatgacataaattggtggatttgttttcgagttggtcgagcagagaatttagcattttctctacgaccagtctctctgcaaactgcttccaaataccaccgtctacctttatgaggtcttccataattcaagaagaccttcattgtatcatttgtagtaagaattgtggttttcaagataaaccttctcgacgaaatcgtcccagaacttcatgtctactttcttaggcattccattcttttcggcttgatgagctagaatttctacttcatctactacagactcgagaagctcctgtacttctttgaacggtaactcacctgctttgaccatcttgaccattttagcatgggtcagagggaattgaaggtcaccagtcatatagatttcctgaagctgcagacctgcacgaagagcatgactcagtgctttccaatctacaccttcgttagcttctgccttacgagcacgttcaccatattcagcatcaagcttctcaagggagtacttcatctctttgatagtgatagtcgtctggaatttacgacccagaacgttataaaacttctgctcgcctgatttgtggtcaacgaaggtggtccattcgaggaattcaccgagaggaagtttctctgcgatatcctgtactttccaacgctcattgatacccttctgctgaggacgatcgtcatatttccattcaggaacatctctgataacatccaggactttatgcaggtcagctaaacgagaacccttaacaccatacttacctgcttgcttacggacatatccaagataagccttcatgtcagtagtataaaaacgagctcggttgtcttgaatgaatttccatacttcaggaaggtcagatgcaactaccaattccggtggagtatgcagcatatccaacgcgacagtttcaccgtcagcagcgagcttgaagaaatactttaagctgaacagctcatggtcgacgtcgtctttcgtatttttggttgcgctgttattagtattacgattagtatgattcatcgcttgacacaacagaacatcacgcggatgaggtacaaagatttctttaaaatccacatctgactcgggagttgaagtaccatacagatgtgaaccaaaataagattttacgattgttttcataagtaaatatgattccctttagcgaatttaatcaaatcatttgaagatttagcacaggcttcaacatgttctttatcagtactcttcttagaattgcgatgaacattcccgattttctgcatagtatggtagtatactacgtcatggaaatgatattcttgaccgtctggatgcggttcgcggcgggcggttttaataacatgtgtatcatacataggaactaatgcccaatcattcccggtattaatgattgctacttggatatccattttgttccatttaaaggcattaacatatccaagaacacgatgaactcggtcaaacattgcgaatttgatttcagaagagcttgccattttcatctgcttaagcaagctcatagagagtttctttttggttgttacgatttcaatttccataacccaccctcataatatatgtctaaatcaatgttatctttgccgctgtacttgccagtcaaaggaataaatttaaccgtaatcttttcgccgtcatcaaaagtaaattcagcaataggatatgtagaaattataccacgttcggttttagcacgaaagacggcccgaaggccgttcacgatataaacttgatcattcttcactagttttaccttctacataatcaatcattgggcagactttccgcttacgggcttttaaatactggacaaataccgatggttcggcttctgcaggaagacccgcttttactcgagcaagttttttggtatactgtttcttattgcgatagcgtttaaatttttctaaaccaaaaataaatccaaacgctatagctgcaaataaaagcacaaatgctgctataaccactgcgccaactggtactgctacaacatttagccaaaaggcggataaactaacacctatccaagcgagaattcctgtctctgccacaatcggccaaccgaacatccatgcaatagaaccaatgaatatagcaattgctgaagagaacagaatatgaagtactgtggtccaaaagtatccacatagagtttttggcattttccatatattgccagatttaaaccataggttcattttgaaatgccaagaatttttattgatattcattataagttatcctgtttcatagttggaatcattgcggtaagatatttgaccagttcaatagcgtcgcttttatcaatagctacacaatctccgtcacgttcaatttcgatgatagtattatgttcatacgtgtgaaataccgtaagatacaaatcaataatatgcgggctttcatcttcaattactgcatcgcctttacgggattttccgtcccatactaatttactcgccatcttttgcctctatcaagaattgaattaatgaatcaatttgtttagtgtcaagatgaattatatcattgccttgttttagcacgatacgactcaactttttagtgaaatacgaattcacaacctttacatgcacatcgctgtacggattatctaaattggtactatcaagaatactttccataattacctcaattgtgaatcttttgaaccgcggcgattataggcagaagtcattactgtatcccactttccttgacattctacacaccgttgacagcctttaaccaacagacgacgagctactgggatttcctcatcacaatcaacacaaaactcttcggattcccgctgttcttggagttgtttctgaagacgggcccattcaatcccgtctgctattgtagcttcacgagttgcaaatccgtcatctgatgggccccatccattcatttcaaactctccagaatcatttgcaccaaattatatgtaaacatcggatactggtattgtaccacaatgtagatgataagtaaaacgtttctcattcttcgccatcatcaaagtcgtagtaatcataatcacaactgtcaagataagaatccataaattcttgttgacggcggaaatcttcagaaggggtcagtctgtctgcatatgcttgatcatctggatcgctgaacttatcttcttgcaattctttaatgaactgttcagcttcttcacgtgtccaaaacccacgattaagattatgaacagaacgcttttcacctggcttgaatacacccatatcatgggcagaccgttcagttgaataactttcagtttggccagcatagttttcatattcacaaatcacttggaagaaaggagatttacgtgaatatacaccacgaagaccaagttctacatcatatgtgcctgaagcaacaatgtaacgcgttatttcgccggttttagtttctgtgcgattaacaccacacacgtgataaaagatttttcctggttgaagctcggtagttaacttaatcataatgtttttctcgtttggttgttgatatgtctatagtatcatgtaatgaagggaagtaaacaactttttgaaaagaaaatgcctcccgaaggaggcggagggtattactgcaatgataacaaatacttagtcttgtagcatagacctgtaatgtcatccagaacactttggagggcggcaggaactgacttgtagataccatcggccttagctagaatgaggtctagcatttcaatggtgtcctttggcagctctttctgcgatggtaaagccggtgtataactcttacctgagaatcctaaccactgctcaccaaaagcatctatcaaatctggaatctcgttaaagaaaacttcatacgctttatgtctggcatacgatttggtatcaaaatgcgctgaatgaaaatacgcctgagacgccataagtaaaccgatgaattcatcttgtggagtaagtttaccgtcctttacaaaatcattgaatttcattatcgagttgtatcctcatgcggttagcatattcttcacctgctgaacgtcctaaagaatcgcaatctttagaacaagactcactcttccatttactttgtataaaagaatagaactgttcagactcttgcttactaggctccttaaatttagcataaacttgtagagctccctcaacatacgagttataatccgaaatgtcgttgtgtgatgcagctgggagtgaaatcccgcagcccaacaccagggctaagcaaatgtgattaaaggccatacggcctcctattatttttgtccagtattacgtttgtgctgaagtacagccttaacttctttgaggtatttgtccagcttacgtttacgggtataatctgcttttgaactgtgctgacgaatttcttcctgaaggtgcgaaataccatgcccaatctcacgacgaagttcgtccagttgttctacagtaagattacgaagttgcttttcacttaaatgctgcatatacacctcatcagttagtaatagtatttatataagtatgtgttacttaatcccaaagccattcgcagatgccttgctcaatagttctagcacctgcttcgtcccagttatattcttcgtcatacttcaatgcgcgtttaatttcggctttatgaaatagacgtgggatcggcatagcataacgggtccaacgtaaagttttccagaatccatcgcgctttgatttagcaattaatttcttggcctctagcggtctttcccgattttcagaaatacgcagttcaacatatttctgttgggtttctttatctttctgagttttaacgtattcgttatagcttttaatataagcaaattcgttattattctgatcgttccatttggaagattttactacatgccagcctttgcggcgaattgttctagacattattacctcgttaagttaaattacctcaacgatagtaaaatcctgatttgaaaaatttaatattcatgaatagatgaccttgcatttacattttggacattcaggttctttggttttaagacgcttggtagcagtctttggagcagtgttgttaatcatatacatgaagacaacgatagcacatcacatattttttcatattaaaccaataacgaaagcaatattacgtatagtaagaatccaactacgaatcctagtactataccaccgactataacaaataagctactcatgtttaatataacacccatttgtattagcaataaagtctttaccttgagctaatactttgcattcggaatcaagacgattttgaagttcttctcgtctatcgctttgaatagatgctgctacacccatccaaatgaatagcatacttaaaactagcatcaggatagtgttatacgttcttggcttcattataaacacctaccagttcgcaccagtgtttacgacaaagagaaacgtatttgtcttcaccaccaagttctactacttcaccatcggtaatagcatttccgttttcgtcaatacgagctaccattgtagccttacgtccacagtggcaaacgcccttgagctcaacaagtttatcggctacagaaagaagagctttagaaccttcgaataactcgccgcgaaaatcagtgcgaagcccatatgccattactggaacatcatacaagtcaacgattttacatagctgaagaacatgttcagcagtcaagaattgtgcttcatctacaaatacacaatgaatatcacgttgtgtttgtgcccacttgaaaaactcaaggatatcaatagattcgtctactgtattagcttcatgacgaagaccaatacgtgatgttacctcggtggcagaatctcgagtatcaatagcaggtttaagaatgagagttcccattcctcgttctttgtagttatgcgccgcggtaagaagattagctgatttgcctgcattcatgctcgcgtagttgaaataaagctgtgccattaaagggtctccataaaatcagaaatagcattcttagaacgaatgagttcatcgtattcttcgggtagaccatttccgtaaatggcactaatagctactacttgctcggcacctgcataatcgtcaatcaactgccacagtttatttttttgctctttagtaatcatctatttacctctaacaagatggatttagcttttagcctcttcatattctaccactgtaatgtcaatatcaggggttgctaaattaataagtttctcaattagttcccaatcaccgccagcaataccagcaccaatctttggaatgtatagaggacgattataaacaatacgaccagaatttagttcatggaatgcattaaaaattgcgccgtaatcaacatttggacctggagcatactgagtatacaaattatagcaatatgcagtgccattcttgtgaatggctcgagtatgagttccaagcttggctaaattattgtcataataacggtcttcatcgatgtcaatatcgagaattggaggatatgctttagcaagctgtcctgctacaccggcacccattgtagtaaagcaattacacccatgagcgatatcgcattcatgcttcatgaataactctacaatattgcccttaatatatccagtaatcatttattcacctatggaattttataagttgcgtattcattaagattattgtatactcttaaaaatatagcattgttacaattaaggatagggtttagcactccttgttctttaggatgcattactccatcaacagaaacaccgtcactctgcattccacatccgcgagcattatattcgacgtgtggaactattacctggtcatctttatctagataattataaaatgacattagcaattttctactgctaggaacaaatgctatttcaatattgttcttgaatggaccgttgctttctattttagtcccctgtgctgcaagtatagtttcaggatagcctgggagcttttcccaggcattaactgaaaatgcgcagcataataaaatagctgcttttttcattttgatgatagtcctgacatataacgagccattaattggtcacgatacattaaacatatattttcgttaggagcattgacacacaaatctttcatgctcttagccttacgatttattagtgttgtccactgggccgggctacgtgaatcttttactccatcgctgaatgctgaatctaattcaagcgctaatatatcaacgcattcagagttcgtattgcaaaatgttttagcgatacgaagtgaatctgtcattgaattttcagcattagcagagaatgccaatactaatccaagaagcgcggcgtactttaccattattccacctttatatgtagcattttatgtttctttaagaaatgagctttctctaggacatctgacgcataagagtttcctcttttgacattccatcctgcattataactagcaagagcttttcgcatattgccgttatgtatatttaaccaatatgaaagctcaatatatgcccactccgcagaattacgtctggatttaagcatttttcttatttcagaatcactaaggtttttaccttccagtttagctctggccttaacggtgggtaagtaattttgaaaaaccccataagaatgatggcctttacctgcctttaaattggctcctgccgaagactctttccatgatatagcagccattatatatcctaagccattattatcatatcggttttgtggaggtttttcctttccggatttttgatattgttcaccaaaattatatgcgtaatgcaagttgtcaagttggacattactgaaagttggctcagacccaaaggccgttgaacacaaggccattagaccgacaagcgcttttttcatgtttacctcaattaatgtgtataacttttgtgctgattttacctttcaaacgtttatcattaacgaatgccatacgacactttatactaggtccttttcccggtcttggaatatccatagtaaaccctagccacagatttccatccgtaatttctaaccgcatgggtttatactcgatattttcatcaatgtcttttgggtcaattggaagccaaggcattgctaaaaattcattaatttctttaaggtgattaggaattttggaaagaacagagaatacatactcttcatcaatttcacgttggatagcacggtccaacaaatgatcagagtacttagtgaagaaaggctctttaccctcggctttcgcccgggcacgaacagataaattcaaagagcgaaatgcttcctcaaacttacgacgcagtttagttctgcgaatgaatacttctgggttagttgacatagttcattctcctttgtttatagggccatagtatcatggcccgcaaggaaagtaaactactttttaatatttttcttctggttgaaacactgaacgacacgcccacattgaggcttccttcaggtgctgaatagcattgcgaatttgagtaatacgctcatgtgctaaatcaaattctttgtcgctcattgtgctaacatctaaattcatgtatttttcaacatgctcttcttctaatgctttaaaaattaatccaagacgaatttccgcgtctttgatagcatttactttaccaatcttttcatcggtatgtggcttatatcctttgatatcttcaattgccattatagtgcctctgtgaaagtacgagcgataacgtcgcgctgctgttccggagtcagggagttgaagcgtaccgcatagccggaaacacgaatggtcagctgcggatatttttccggatgctcaaccgcgtccagcagagtttcacgacgcagcacgttcacgttcaggtgctgaccgccttcaatttttaccgctggctggtattcaatttctacttcacgtgccttgtagccataaaaagtttcagcatccgtaatagtatcttctttaagaacttttgaaacgattactcgtgcgtcatcaccatcttcgatgtaaatggtgcctttaagttcaccttcaagaatttgatatgctttcatatttcctcttaattagattctttattccaaccacgcatgtatgcggtaattacactcattttattccattcgtctgaatgaaactttgcagctgcttctagataagttattttatcttcatgataagtaacttcttcatcagtttctttatcgtattccacaatttcaataggctcgttaactccatatccgcgagtgcctatatacgttgtagcttcttcccactgtttggttgtttcattccaagttccattctgatgggcttcatagaaatgctgctcgccagaattactgaaccaagcacagaagctttcaactaaatgtggaggacaccttataacaatttcagccattgcattgttttctcttgaatgcgttggtcatatgtgattaaacttgaactaatcacgcctttgagcttaccggatataaactcaattctaaaattaggatagcgattcatccacttcgtgttgggagcattagaaatgaattctgcgcctttgaatgggccagacagaaacttgtagcgcttgtactcaagcaggttgccagccgtaaccattgttattaattgcttcatatcggcaaatcctgtattttccatcactgtaatcatatcaacaatttctgtctgtgtcatcattgcattcctatcacgaaaaataaaggtaaggtatcattaggcatagaccatctgatagcttcctggtacatatcatagaacttcatcatatcgggaactttcattggttcttcaatgataattaatgctcttccaaactttcttcctctgaacttataagaggaatcattggatagaaattccctgattgtcatcggaacaattgatttagctatctcgttagccggtaatttattaattaaatgcgatgaattatattctcgtagaataccttccatcagttcagatgattgtgtgtatcgagtagataagattataaccgaaccatcttcaagcaaccaatcggtagcgaattggcataaggctgcggtctttccggtttgtcttccaccatctagacgaagggtaccgtactctcgcataaggcaagacggttcataaaaactgtagttgggattatttaatcgtctgtctgcagcgtctttgaaagcatgcatcagggtcaaataaattggtgttaagtatttcataagctctcttttaatggggccattccttggcgcatggagtgagtccattccgataccttatgtaactggcattgccacacttgggctcgaccttattacaggtaggcgggaatccctcatagaatcatgaggtccaggttattccaatgttgtttaaatgtaaatatgaatatactatcacaattctaggagaaagtaaactgttatttacctttaattactttagctgcttcgatagccgcttgctgaaggtcatccatagacataccgaatttagaagcaaagttatcaattttcttttcgacagcattcaaaggcttggcctgtttaccttcattagcgccaggaagagcgagaatacgctctttgtcaatataaaggcttacaagtttcttacggtctttatctgacaaatcatgaaatgaatgggcctttttatttatagcggcttctaatttacctgcactcactcgcgcttcagtgataaattctttataagttttcatttttaaatccagaaaggtaaaagttttaaattaaatggggccattccttggcacatgtttaatccatcgacacactatgtaaaccccttaccgcacttgcgctcgaccttattacaggtaggaaaagctacttcactcagaggactcgacgttcatgaggagaggtcgtgttcggctttattaggaaattgcttacttaattgatttagcgtaacgaatagcgccgcgatcgtttacgaatgcaattttaccattacgcatgtacatggtaaccgtacgctggtaaccgttagaagttttaccagactgataacctactaatgcaaagttatcttcaccaggtttgttctgcttagacttaatacgcatatgtccatgggccattaaagagcgtgcatcgccagatgctactgctttgcgagaagattcatcttcaaccgaagagacaaaatcatcgaatgaatcaaacttagcatggctcttattatataacttgccgtctactacgtagttatatccaacaacgtccatttcaatttctgtgccatcttctagtgtggcggtcatcttctggccttttttaaatttcagaagattacttccaacagattcagtcattacgccaactgttgctaaacgggattcatttaaaaattcttgataggttttcatttattttccttgataagcagaccaagttccggtccgcattgtttcaattacacgacgagcacgattaggtgtctgacgataccaacgtgaatttgcaagttccttggcagcagcatcccattttttagtgagtaataacttcattgaagctgggaacccggctacaccagacacacccatttggaataccatgttaatcagagcagctctacgaacatcatctaatacattatataccgggtttaatgtagcattagcaacaatacctttaattgccttctcaacatctttggcaaaaattacttctgcctcagcctgagtaatttgaccaccagtagaacgacctaccagtttgtccagattagaaatagccaaagattttgacgggtctttagtcagtaagtgaccaataccgatagtccaatacccttcgctatctttataaattttgctgtcgtatccttcatcaatacgcagcatgccaaaaatatccataaggacctcctattaattataggagtatttatttggccctgcacttggctatgaataactcaaggctgcacttctcgtatggtgtccatttatctttccaccacacataatctcttctatcgtcctctggaatttcattaaatccgggatacagcttttctgctatgtaatatgttgattttgtatactcgccgtcaccgaagacgtatcgtgatttcaatagtatacgcgacattttatctctaggatgaaatatgctaacccattttccatcgtgaataaatcgtagctcatgcttataaatgtgtggaatgcctaattcaacggcttcttccataataacctcactgagctgtgctatacatttgtgtcatgattttatacaaacttggtcccatcacatatttccactggcttggtttaattaaagcaaatgcatcgatttcaggaaaattaattccattttcatctttatggtaagctgtacaacggcaatttctgaacatttctgggctcacagggagcatatatccaaacagatggatatccttgttgcttgcataatcatgtcgtccaaggtcatataagaggtcttggtcaaactcggtaaatccagtctcttccttgcattcgcgaatagcagcctcttttggtgtttcaccaggctcaacatgtccttttggaatatcccatctagagcctctgccctggatatatgtatttgtcatacgacccatgaaaagccgtttgtcatcggtaaagaataaaattcctgcactgagctctttcattggcattcgttccagctttcttcaagaatatcttccatggcagtatagaccatagactctaatacaccatcacagttatatgaaccctctaccgagaaatcacagataggtccattaataccaagcagttcttctttaagtgaaatctcgataccgctcagtgattcattatcgctgtaacacagaaggcgagtatcaccattttcaaattttacatgcactgcaacagccattatttcatctccttaatccaggataaagtttcattgcgagagtcatctttagatttttctttctttactttgggcttatcaaatacaccccgctgtcgttgggaaacgaattgcaaccaacgagcaagcattgcaaaccaagttccaacacctgacatccaacctagatagtacaatgtatcaccaaatactggtgaaaagaagtagaatccccagaatatcccaacaccaacaaatgttgagaaggaaaacaggataagcagaaataggaagaaatacaagaaatcatcgtctttaatcattccacgataacaagttttaatcattttctgcagctcctaatccaggtgttgaaatcttctttttctttccacttcttgtatttcatacggtaagctaaaaatgtgcagcaattaatcaacgcgataattagcatccacatgaggctgaatacgaaaacacctaaaaataaaagcataatcataaactctgagacgttcaatccaaagaatgtccctccaacaattacaaaagcacaatataaaatccatgtcacgattccaaaagctggcgccagcccatcttggttccaaaacccgtcaggtttacattcattcattttcttctcacctctttaataaactcaaacgactttttgcggttccattcaagagttaaattcttgcactgttctttccattcagcctttcgttcacagttatgcttaacatactttacccaacgaaatagctcaattaatcctagaccaagtaaacctattaatccccatgtaagtaatagtacattcactaatgatgtactgctaatttcagccaaattcattacgtcgattatgataagcgttatcatagttccagcagcacagaccatccccggaattagaacataatcagtttggtcaaatttatagacataattataaacgggaggttcacttggcagatataaattactcatttctgcaccctctcgcggcagtatttgataaattcatcaatgattaattgtttgcctaccatgttgttagagtcaaacatacccatgacttttggtggtaattcattaacgcagtaatttaaataattgctataatcatcctgagatgtcacgtatttaaccagattaataccgagacgataactagttttattatagataatctcgataactactgtatatgttgtggagctagaagtaaaatattcatcggcattagtacgggctgattttaaatttgatggagaatcgttgaaagaataaattccgtaccgaagtgcaaaaatatccacaagcttaactccgtcggaaatagacgaaatactggaaattaagtttttcagcttgtagtagtctttaagaacgatagcccgcggcaaaactgtggtgttatacccgttatagcgagttttccaattttcaggccgagtatcaggatgagcaaatttttcgagaacatcagtgatttctgttgggaatcctgctgcaattaattctttaatttgaggtgttgccattggaatatctccagcgcattcatataacattttattatccaagttaggggcccgaaggccccggtaaaattacttcagactttccagatattcctggacatcagcagtggtggtttcaataccaggctgagtaccgctgaaggtttcaactttcatcatgatgtcttgtacatctactttagcgagttccgcgatttcaatcacgtcatcagcagaggtaatacccagagcagaagcattacgggtctcacggatgtattcgagtttcactgccaaatcaagacgctggtcatcaagcttaactacagtttcttcaatttgggcccgcatttctttatattcggcagctttatcacgtaaagccttagcagtacgacgatacagaagacccagtttagcatgggtttctacattcataccttctgccatcaagcgacgaatttcacgctctttggaagcacctgcctggtctttttcgtcagcaagtttcagcagacgcttttcttcatttaccgatttaacatgcgtggtacgcagtttagtgatttcatcaataatacgatttgctgcagtggtgtactggtcttcaacagaagtgttctgtgcaacaaaggtaccgaatttagaacggatgaattcaacaagttttttcagaatagacattttatttcctttcaatagttatggtggttttattcgtacggattaatccaatcataaacatatggtttaatgattagaccctgttcatttttgctgcgctcgaatatctcgatataatcagtaacgtatgattctaatccgagaataagtacagactctttgccttcttctactgttgctttaattaaacgctcgatggctattttagcttcaagacgaatatcagcaagagtttttggaacttcatttgtatgcattaatgagttcctccattttgtccaaaactgcgatatcaacaagacgattaacctccgggtcatcggcaaattcattgtaagttgaaatcaccaggttctcgatagttttcagtgcagccattcgttcttcaccggatggaaaatttggagtttcaccaaacagcctagcaaaagatttaaaataagtttgcgctactaatttcaacttatcttgatacataccaatttcctcagtaggtggggagttcattataactccccaaaattattagcagttaattaccgcttcaattcgtttaaccaaagcaggaacagttttagcaaacttgatagccatttgaaccgtagcagcttcttcatggtaaactcgaacatagtactcttcaacagcaggccaatctttgcgaacgtgtttaatcaaatctttcagttcacgggtttctgctacgctgaacactgcattctcatgttcgcctttaatccaaaccgcgcgataacgatcaggagtaccgtattgattataaccacgttcaatttggataaagttgaatttagacattttattctccgttactctgttttgttttgatggagctatagtaaccgagttaactggcgttgtaaacaactttgtgcacaaattttcaaataattttagggaatctggaaggactttctggagagtagaatggatttatacagcttgggatatagaaatgccctagatgatttctagggcaataggatttcattatacggtataggataacccagtttggcgacttagttcaacaagatgatgacgcagctgagacagcagaacttttacttcgccaatgtgttgtgtctcatgggcagatggcttagatccttgtgacgcgcgatatttgtatagattatcgagataaacctcaattgatttgtagagggctccattgtcacgtactagcggaatcatctggtcgattgcgctgaacagttcgccagaaccaataatgctaccatattttccacgaacttttagacctggaacatctttcggagcttctttaacaactggcttaacaggttctgctttaggtgcttgtggcgcaggagttgcttttgtggttggcgcagatttttgcccagtcagagatttgaatgcattctgtactttatagtagtcaccaggattgttagtgctgatgccataaagcttttctacggacgcagcaaatttcataaaatctccacgctcaccttttggtaccatgtccatagctgactgccatttaccctttgtcatccgtacggatgcttcgtttaaaaattctttaaaattcattataaattcctaagtattagtgttgatttactatatactatttatactaaaaagccccgtccgaagacagggctctgagaatcgacagcatcacctactggcagatgacctgcgaaattcatttctttggactcggaggcatcagtctcatccaaagaagtatagcgtcaggaggttatgcttgcgacagggaacaaccggctagcggtaatggacgaaccattctcttctatctgacgactcaacgagggcatacgcaagtttcccttcgaattacattacatcgtattcttcaactagatactgataataggaatcgtttgcttcaagttcttccgcatatgatgttgcttcggatttagtgtgaaaaatcttaagaggcaaagaatattcttcatagccatattcacagttccagttattttttactacagcatatactttcatattttcctcattaatttttggtatgggtaggaatcgaacctacaagccattcagcaccagggcctcacgctctacctatttgagctatcacataccagaatttggtgccgattgcaggagtcgaacccgcggcatcttcattacaagtgaagcgctctaccaactgagctaaatcggcgtggtatccccacctggactcgaaccagggactagggtttagaagacccttgttatatcctcttaactatagggacatttggtgcgtcgaacgagactcgaactcgtacgggtttaatcccgggagattttaagtctcctttgtctaccaattccaacatcgacgcaaatatttgttcaggcaggactcgaacctgcacgactgattccgtcggcgatttaccaccatcgccagcatatgatgcaatatgcgagctcaaaaggtgtccgtcaccatgtctaccgatttcaacactgaacaagataattatattactgattatttatagcatttctcaaacgataaagttgattacagaattcgcgttcagtcaaaatcgtttcagaaattttatttttacccatactgtgagtgagcgtagcattccgggtagcagccaaagcttttctgaatccttcatttttactaagtgcatcatatgctcctgttagtaaattctgatatgcttctgaagctcgatgaataggaacacctttccaataaagcgtttgtgttggccaccaacgtttcttcttacctttaaacttagcggactttccgactagtgtacatacatgtgcttgcatttcaggcgaagaaaatttgagggactgcaagaatccctccattgatgcgcattctacgccatcatagataaatttatgaggagcgaaattactcaaagcacatgatggatatgaactacctgaaccgatatccattacttttccttcacgtatttcaaccaatcaacttttaatgggctttctttctgcttatacgtaattccaacatggaatgcaatcggtgcgtcaggaatacgaatttcttcttcaatgttgaagatttctactttctcaaatactcgcatgaaatcatagtcatattcaattggattacccagccaagcctgaatagcatacataacttcatttgagcaagaataatggttatctaaataagcatcaaactcttcatctgtgcaatcatatgcaggaacatcaacaccaaagaatttcttggaaaattcaggagttacatacttctgttcagtatgaagcttttcaagaattgcttcatggttgtaatcattatttccaaggcattcaccacgccgaccattagaagagaaccattcaagaacatgaattacttgattaatctcttccttttctaagccataaaccatttgggtagaataccggtcagcatcattttcccaagtggtaattgccattgctaagcctttaggaataacttgtccaaatttaatatgcatttcaatttccttagttgataatttggtgaccctggcaaagactcgaacatgcaaccaatcccttatgaggggaacgctctaccaattgagctacagggcctttatagaaatcttatgacttttataaaagccctccgaagagggcgccttgtcgggcttatccacctgctaggcagaattactcacacataaaatcagctacttcccagaagtcatttttaactgctactttaaccaccggataaatttcagatgttttaatagaaacaattacatcacctgcgacagtttctaccagaccaacgattttctcgctgcgagcaacaaatttactcaccggatgaaatttaccggtagcagcgaacatagcttcttggtcaacaatcagtgcgatacgtttcattctttttccttgtttgttttgatgtagtaataataacaggttattcttgtagcattaaatctcgaaaatcgttccgttttcccacattgttgtgaacataggagaaaccttaacgaatgatttgcttcgcattgcaacgtagtcgttatctactttagccaatcctgaagcaatatcagtaatgcggccacacttcatagaaccgcgaccacctttattgtatgtgcgttctccgtagaaaacgatatcaccaacttgtacttctcggcctttagaatctttcatcatattttgcctgctgaattcgtttaaaatcgttaacaagttcttttgggtccaacgcattgttaaatggaagaacttgacgtagtttacttactttacaaccagagtgataagcaataacctcttgaatatcacgctcactgaagtattcatatttaatcagtgaatcatatcggcatttaatccatacccacatacctttgcgttcatcaaatgcatatgcaaagtcagcgttaatcattaaatcccgtttagcaaaagatgaaagccctaatgctaaattaaccggtccatccaaagacagcttcaccgtaatagcatttactttatttgcaacaccaataaaaatattcattctatttccttcgcttgttttggccttcttgtcgtgcacgagaacgtcctgctttatgcagtgattcgtaatatgctcggcgtctatcaatgttttctgtacgatatgctttcccgaaatgggatgttttgaagccgtaatatttcataatataattctcaatggcaagtgattggacggtatgcccggcctcgaaccgagtcacatggactttgcagaatccgtgtgtttaatatatcacccatactcgatagcatatctgaacgagactgcaatcccgctactcagcttacaccatcttgtattgtgtcataccgataatttggtctccatagaatgactcgaacattcgacctctccatcccaaatggagcgctctaccagactgagctatacggagtaattttgatttaaaattcttcttgcttgagtgtgacttacaccaatatgtttagcatatttagataattcgcctcgtttagaaaaatcatataatttagaaatttccattctgtaagctctttcatctgtactaactctagctaagtttaattcggatatctttttcttgaattcagccgaatggtgttttcctgcaaatccgcttggcttaccagccatattatctttccatgtaggtaaatccaaggatttcactgattttgaaatctttttcttatgctcatctgataaaggtttattagcacaagattttccaacttttgacatattagttcttcgttgttcggacaagatttcattattacatatgtggtcccatccgccttcaccaccaagctttaagttatatgtatcaggccttttaataaattcttcatttactaggtgtctttccgcatcatacatatctttagcattatcaaaagtttcgagaatttctttttcaaaattttctttgccgtactttttaatagcacgctttaaattcttaccagaacccatgtatccatcttccaacttagaagtagaatgaactccaatataaaacttttgatttattttatttgtaattttataaagatagtaatgcatatcagttcctattaaaagaaccgagcgtctctcgacgagtcacaatttggagcatccaaagggaatcgaacccttatcaagtgagtggaagtcacctataatagccgttatacgatggatgcaaatttggcaggccctgaaggaatcgaaccctcatcactgggtttggagcccagcataatagccgttatactaagaacctgttatttggtgggagtaactggactcgaaccagtcaccgctcgattatcggtcgagagctctaccaaatgagctatactcccatggaaagctaatcatctaattgttgatgtaccactgctatgggcagcgtttaactttcataaatttggcggagagtaaaggagttgaaccctcaccgtttccgatggcccggatttcaagtccggtttgctaccactagcgctactctccaatatttggtgaaggaagtgccatatagacacaattcgcttagcgacaacccagcatgactgtgggtcgtgtatttttccaccattccttcattgttggggtgaccggcggaatttgaatccgcgactacgagaatcacaatctcgagttctaccaactgaactacggccacatcaatattcactccatccatcatgaggacttcatacgaaattaagagaagaatgatcagttcaacccctgtagacgcgttgaatgaatattaatttggctggactatctggattcgaaccagagataccggagtcaaaggccggtgacttaaccgcttgtctatagtccaattatttggaggcggaggcaggactcgaacctgcgcgtgtcgggatatgagcccaacattctaccaactgaagttactccgcatttatccgggttcttgaagtactaacaagtagcttgatgtagaacacgctaaagatataatcttacgaatatagagcttattccgtgggaacaaacagcttcgtcctcggcattatctcacaggactcaaactcatcttcaagaactgccacgttcttatttggcggacctaacggaattcgaatccgtgactctcgcgtgacaggcgagtattttaaccgctgaaactataggtccataattcgctttcagagatactctggcacgatgccgaagcaaaggggaacaggactctcatcaccttggtaccagatgaatcttgtttagcactctgttctaagatgtatccctgaaagcgaactttcaacgccgtaagaaattataacatgaacaagcattaagcaggatgaaatcatactccttaatacaaacgccatgccagggatttctgtgccgacgattttatcagaacgtcttctgacttcttcatttggcgggccgtgcaggtatcgaacctgcctagtcatttctgacacggattaacagtccgtcgcttaccctctcagccaacgacccgaatttggtgggacaccgaagactcgaacttcggacacccggattaaaagtccggtgctctaaccaactgagctagtatccctaaatttggtggggagtaatggagtcgaaccactcgagccttttgagcaacagatttacagtctgtcccgctacccctacggtctaactccccaatgggtaattttatttatactgctctaaaattaatcagagcagttgatagattaataataacaaagaaaacctaaagcatattacacaatcggtgagctctttgatttaaccaggaatacccgatgtggtgaatccatatgagagagcaatacccggtgctcaggaattggacttgtatggaaaggaaccacacgataacctttaggagtaaatcctagcaaaataccaacgcttgctgcagaaagtgacccaccacagtagtatgataccaaatcaccaggctggatttcattgtcaagagaatcggttttgacatgcttaggcgtaactaaatcactaggaattggaacgccttgtgcatcatagtattcatgggcaagaagcttataattctcttgatagaaagtattaaacgcagctctgatattcatcacaatttcctcacaattaatctttgtatgcttcagttgaacctttagcaacggtctcaaatcgggaattcagtatctcaaaatagtcttgatacgttccctggagggcttcatagcattcttctaccgtagaatagacacctctgatttggtcagagccaggagcaggataataattagaccaagttaaaagtgcatacattacttacgtttccagctataatgagccaaaataagaagcactgcaatagcaagtagtgatgaatgcagtgctgccagtagtgcacctagtcctacgcccaaagtaacataatcatacttagttacttcttcacggtgtaaatcatagtttttgatgaaccactgcttaatctttttcatgtgctattttatccattatgaaagaaatgatacccattagaaatgcaacacttaacactgatactgtttcaggaagagacataaaggctgcaccgataatgccaaaacctaacgctcccatgcagatagttgatgcaacatttctaattaattcacaacgtttcattttattctcctcaagttgatagggttatagtatcactactacaacccgttgtaaacaactttattcagcgccagcggcttttaaaagctttttaagattagcagaacctcgggcagaaaaagttaccttaccatctttttcaccgatgctgccggtcaatttagaaagtttatcgctaggaacttttttaaaatcggctaatgtcccgtcaacggtttttgtaacaatcggcagttcatcatcctgtcttttagcttctgtaataaattcttggtacgttttcatgttgcttccgtttggttagtttgttttgatggagctatagtatcaccactaggaccggttgtaaacaactttgtgaaataaattcctatttcaaatcttctgaccagtccagttttagtggctcttggtactctctatcaagcactacaggtacttgaacttcaccctcgaagtgagctggacctacattgtagctgagagtaatgtgcggtgagtaatctgggaaatcatgagttgctcccaaagctcttgcatattggtgacggaattttaagtattctgaatctagcttaagaactagcgtacgtccgtcttgtgtgtcccatacttcaagtttacctgatgtagcaacttcaaaacttcctgaagcacaaacgtatggaacatgaactcttgaatagcatatcgtcgtatgaattttatgacgaggaactggattagggaccttcaactcacgctgaaggtcctcaatagcatcaagagttttctcagagaatttagcagctacatatagaccagtgctaaaatcactgaagttcattaggcatcagcttcttcagtggtttcttctgcgaactgtgcttcgatttttgcaacgaggtcatcaagtttaacctgaccgtcttcgctgatttcaacgccggatacagcaatcagcttctgcagtacttcttcatactgtgcacgcagagcagaaaggccttggatagtttcagacaggtcaaatacacgaactttcagagtatcgacttgggcttgcagttgttcagtagtcatttttgaattcctaatatagtgttgatttttgaataaagttcttctagagaaccgtcgttagttattacgatatcgccttcgcgaatcggaagtccacgctctgtgacgtgagtatcttttttagaaccttcttgctcaggacgaactacatgaataactgtagcacccatcgccctggctacatcaagttcatggtcttggcgggtatctgggacaatgaaataatcataatcaccaaaagtatcagccataaccaaagtgaatcgttttacccaatacatgcgatcgagcttatcacagacaatgtcagtcccaagggtctgcatgagacgacgaattgaccatggctcaacaggtttatttattacaactttacggatgacttccatcgtatcaccgtcaagtattttacgtttgttatcataaaccacaccaggtaaaggcaaatcatgatgaacatattcaatcgcgttcgccatgatacgaatcacgtctttagtagacagatttaaatcttgttcacgatcgtaatcaataccttcaatcatcgaccgagtaatgcgaggaaactgacgtgatgtatcgcgataccactcagtaagcattgcatcagccaacgcatctttaattggacctgctaactgatgctttgttgcgttatagttatccataatgtagtcagcagttgtatctttgccactacgttttttaccaatcaaaaataaaagcttcaaattattacctcatagaaggatgcattcccataactttctgttgatactgggattcgcgagtatcattgacagaaggtctaccagtaattattataccatctttttcaacttcgatgtatttgtactgcaaagttgctacacataccattgctgggtcggattcttcggttaaagaatactcaatttcagataaatcactcacccaacctccgatgtagcggacagttaatactatatcatgtttatcgttatcaagaacatgcattaaaactgcgccaggaaatccttcaccgccgttattccatccagacttgtctcggtcaatgtagttttgacagcttaacatccatttgtacatttgtacccatgaatcaagattttcatctactaaaaatctaacaggaacagcgtcaaactcaaaagtagacccaggcaatttagcacgatgcatgccttgaggcgagcctacagtatcagtagcaggaatatgaattccaggaactacagctgtttgaagattagctttaaacgcttgggtgaggcccccatcagggacctctaatataaagttagttgtgttagtttgattaaacagtccagtagacattatgatttccatacagaagtagcagagtagcgtttgcctttcgacatgaactgctgcagtggtaacatgactacattcgcccaatcagccggttttatctcaattaaagcaccctttatattaccaggaatatatgctttaatcattttgtcagcgccagcaaatcctttaacttggctccagtttatctttaatctggtcttattagatatcactggcgtattagcatactgtttaagaagttcttctaaaaactgctgacgagcctttggcggaatgtagtgaaggtttaacccatacatcaatgtggttgtaccttgctttccaagaccaagataaactatcaaaggaaatttatcccagaatggaagagtgtctttgtgcttagcgtcatacatgtaagcatatagctttccaggttgaggcttggttacagaatgaccacgtatatttttctttatagtttctgcaaaccatttagcagatttattgtttactgctgcgccttcattacgaattttatctttgatagagcttcgaaatgaatttaccatcacaagagcacgctcctgtttggtcattttgttagcaggttttttctcaatttctgctactttaattgccgttttaattcttgatgcatgacgagccattgctttactgaacgtagcaggatttattcctttgctttcagcgaatgatttagacgtcatgccttttttacgagcagcagagtattcaactcctaatgctacccattgattttcactacgggatttagctttaggcgattctgcagcttcagtgataaattcaaatatagccatcagcctttccatcctaattttttaagtgaatcttcggtaattaacctaaattctatacccattttactggcagtagcttgagctgctttccacttatcaacgtttacagaccatgtgtaaatttcatcaatgtaccgtttcttcgctgatgtcgtcaactttgtgggtttgaccggaggtctagtttctttcttcggcttaacttcaaaaaagaactgttgaccattagaaaacttagcccagaaatccatgaaataacggcgtttctttccatcagcattgctgaagtatggaattaccacgcattctgagttccaactaactacatctgggtggttatctaaccaccgcatcatgaaattgctcccaagtagatcggtatgtgatcttacgagggtcccccttatatttgcttaagttttttggtaaaaattttccgctatacgccattaggcttctccttacatttgtcaaagtgccaacacttcattccacgaggttttcctgatttgccacagtgaggacatgttactacaggttgagattctgaaacagccctaagctttgctcgagtttcttccgatctcttctttccggtgttagctaaatttaatttattttggtgctctttagttctatttttagctgcagtagacatgttttgtttcattgtatcgctttttgaaacacctgtcatagaaatactgcgcttttcatttgattctaatgtctgagactttccagtaagagctgcagacagtttagctgaccattcctttgacctttgacttcgcttctttcctgttaatatcacagaattagcaatagaaactcttttgcgaatccattcatatgatttgttatttcttcctgctaatttagaagacatgatatgaactgcgtatgataacttgtgattatctggataaatcttagctaaaagctgatgcgcaacataatgttcagctgcagtcaaatctacgaggttatcttcatcatcagtaccacccatacatcttggtacaatatgatgtcgttctttatatccttccaagctgcgagatttgcctctctcaataagctgatcataaattttacgataattcatattattctcctcagtagttgatagggtaataataccataaaccactcgtcatgtatactacaactttataaatactgttattaatatttataagaggataaactatgctcttctcattttttagtccgatagattattctgcaaagaccgtaaaaggtgctaaggcaaaagctatcccaaccgctgacatatttcgtaattatcgcaaatattttgacactgtggcagaaaactatcttttacaaacatattacataagtggagctcctagaccagaagaattagcatatattctttatggaaatagtcagctgtactggattcttttaatgtgtaataatgtatatgacccgtttagagattggattaaaacccaggatgcatgctatcaatttgcacaacaaaaatatgcagatgtaggtggagaccaaatactctatcacgtggatgcaaacggcaatcgttattataacctcgagcaatatcctgaaaattcaggcatttggtatgataaaggggactttaatcaccagtaccctcaatatactggggctttagctggtgttgacatttatgaagactctattatagaaaatgaaaaactgcgccaaataaacattatcaatcctagtgatattgaggcatttctttctgatattatacgagaaatggaaaaagcacctgacagcgaatacgaatcaggccggtacaaatcccagactacaatcggagaagttttatgattgaaatgaatgattcattaaaatggtttaccggtgttgttgaagacagacaagacccgttgaaacaaggaagagtgcgagtacgtgtttatgggcttcatccatttgaaaaggtgcaaggagctataaccggtcttcctaccgaagaccttccttggatgtcagtgattcagcctactaactcagctggaatttccggagttggctcgtctataactggaatggtggaaggaacatcggtatttggcttatggcttgatgaattcaaaacagcaggattagtaataggaacatattctgcgcacagaaaaactaagccaaactacacggaaggtttttctgaccccacaggtcaatatcctagacaggttgggtcagataccaacccactagttcaaggcgatgaaactgggtatagtgctataccaaacatcatccaagatagaaacttggatattggcattaatcctgacgatgctgacctaagcgatattcctgaagacccaaatcctgcaattacaataacagatatgcttaatagggatgaaggtcttagattgaaagtctattgggatacagaaggatatcctactgtaggtattggacaccttatcatggcacaaaaagtacgtgatatgtctgtcattaataaaactttatctaatcaggttggtcgtactgttacaggaaatcccggtatcattacaatggacgaagcagttgcactatttaagaaagatcgtgataaaatgctttctgatattaaaacgaattcacgggtaggacctgtatatgctaaagtcaacaaatcaaggcaaatggctttagaaaatatgagttttcaaatgggcgtaggtggattagcaaaatttggtaaaatgcttgatgccatgctcattggtgattggaaaaccgcttatacagaagcaagaaactctgtttggtttaatcagacaaaaggtcgtgcttctcgtgtttccatgattattctaacgggtaatatggaatcatatggagttcctgctccaaagccagaaggaaaaaacctgtctgcggcttatgtagaaccgaagtctggtggtaatcctgaagacccatggaccccagaggattcaagaattctttttaaagagcccgaatcttcatataatggtcaatatccatatgtacatacgatggaaacagaatcaggccatatccaagaatttgatgatacgcctggctatgaacgctatcgtattgttcatccaaccggttcatatgaagaggttgctcctgatggacgtcgtaccagaaaaactgtagccgatttatatgacatgactcagggcgatggaaatattttaatctctggggataagaaggttaacgttggagggaacgagacctattataacatgtataatcgtcgacagcaaattgatggcgataacacgctttatgtacgtggaaatgaaactaaaacgattgaaggtgatggtactatttttgtcaagggtaacattaagatagtcgttgaaggaaatgctgatatccaagtcaatggtgatgccactactaaagtagatggcaaccacgacgtgaccgtcggtggtaatttaacttggcaggtagcaggtactgtgaattggaatgttggtggggcttggactgaaacaatggcttctatgagctcaatcgcccaaggccaatacactgttgatggttcacgaattgatgtaggttaatcatggctgatatacttcctattaataccacgttacgcgaagtaatagaaggtgaatacgttgagcagtactttactgctcaattatctaccaacgaaacattaaaatcaataaatattatcgactatcaaccagtatctgatatctctgtgtctgaaacctattataaaggtaattataactcagtttttacttttggaaacgatgtgcttaaataccgtgaaggtgatgagctaaagtccgcttcagcgtgggaggatttacctaatcccaaaactgctgatttgtatctatggaaagcccccagaacactagagaagacatttacctatacagttgagataatatatacagtgacagaagaatcgtctggaggttcatccggaggttctagcgctccaatcataacagaacataaaaagcaaaagatttactctcaaaccgttaaaggcaactggagtagatggggcgaccaacttcgtgcttacgtatatgcggggaattaaatggctggtctttcatatgataaatgcataactgccgggcatagtgcgtatcctccgacagaagtaaatgctacacaaagtaaagtattcactggtggaatagcggtattagttgatggcgactcaattaccccacacaccaagacggttgaccctcatgatacgcatggaggagttgttcaacctcgcacatccaaggtatttgtaacaggcaaaaaagctgttcaaatggccgatccaatttcttgtggcgacactgtcgcgcaatcaagctcaaaggtattcatacactaatggctattaaagaacctttaaattatcagttaacgcgtactgcaaacgctatcccagacgcatttactggagcaacattcgatgaaattaaaaatcagcttattaactggcttagcggtcaaaaagagtttcaggactttgattttgctggttcgcgtttaaacgtgctattagacttattagcatataacacgctttacatacagcaatttagtaatactgctttatacgaaagctttatcggaacagctaacttgagaagttccgttgttcaagcagctcagcaaaacgggtatttgccaagttccaaatcagcggctactgcgtctattatgcttgaggtaactcatccaaatccagagccagcaataaaaatacctcgtggaaccaagtttttagcatatgcacgagattcatcagtagacccatacaactttgttgttactgaaaatgttattgcgctaagagatacttcagcaccagaaggggttaatagatatcttcctattgtcaatttggcgcagggacgtattattcgtactcagttgtcatatgacccgaagaaacctattgttattcgcgatcagtcaattgaccgcaagcaggttaagctgtgggtggatggcgctgaatggactaactggacagaccggtcaatggttcatgcttcgtctatttcaacgatttattatatgcgtgaaactgtcgatggaaataccgaattcttctttggtgaaggcgtggcagaagcctctgtagcaggaggagttcttgaaagtaatttcattggtggattaaaacctactaagggtgcgcaagtcgttattgaatatattcgtactgatggtgaagctgcgaatggtgcgactgatttcagctatgctgataccctgcaatatatcgtagtaaacaaaatcattgaaaactggtcagattctcctgattatgttggtgctgatggtggtggggaacctgaagacatcgagcgtattcgtgagctcgcccagattaagcgcgaatctcaaatgcgttgcgtgtctaaaactgactatgaatcattcgttagttcacgctttggttctatcgtacaagcagtgcaatgctttactgatcaggacaaacccggatatgcatttatcgcaattaaaccaaaatctgggttgcagttaactgcggttcaacgagaagacattcaggattatctaaaacctttctgtcttgctccgattactccttcggtaatgagtccagactacttgttcatccgtcacaatattaaagcttcttatgcattgaataagttgcaagaatcagagcagtggttacagtcaaaaattatagactcgattaatagatattatgttgatgaagttgaaatgttcaacaaaaatttcagtaaatctaagttgttgacttacattgatgacactgaccactcaatcatcggttcttctgtggatattcagatggttcgtgaaattgtcaactatttcactcttcctagcgcaggtattaaatactataatactattactccgcggacgttacgttctggtgatttggtctttactgttaccccaactgctgaaccgtattcagttaatatcgttggaactgacccagataaaaatggcaaaggaaatatggttattggaccatttaaaccaggtgacattaaagagaatactcatatccagccatatactgaaaacgattttgatagaactaccgtcggcgaaagaactcgttggtacaaaatcggtgaagtagattattatggtgataatatttactggagccttggagctattggagccgatcctcttcagtttgaagaccagagtattgagctttattctactcctacccaggatatcgtcttcgcccgcgatggaacacttatcgtatttgagaatgaccttcgtcctcaatacacaactattaaattggagcctattacagcttaatgaagtataatgaaatttatgatagtttaattaaaagaggcctcgaaagaggccttaataaaaagaagcttgattatcatacagaaaaacatcacattattcctaagtgtatgggaggagttaataataattctaactatgtattgctaactcccagagaacattttgtagctcatcaattgttagtaaaaatatataaagatactaagtatttctataagttagttagagctctcaacgcgatgtcaatgtttaatgataaatattctagacccaacgctaaagaatatgaatgggtacgaactttatgttataacgcgaataaattgactaatgtgggaagaaagcataaacctgaaactctacgtctgttctcggagcaacgtagaggtgctaataacccaatgtatggaagaaagggtgaattgtctccatcatttggtaaaaagaggagtaaagaatctaatgataagatatggttaaatcgaagcagaaatattagtcagaaagcaaaatataatatttcaaaggggaaacgaacatctcctatatggaaagaacctatgtataatgaattgtttaatttatacataagtaatccggtaggaggatgcgcgtttagaactaaagccgtgtctttaggatatcctaatacttcataccacagactagtacaagaatttaaggaaattactcaatgacaattgcaccgttcgtcaccagcttacgaattcataagctatctgcgaatcaggtcaatattcgttgggatgacgttggtgcaaacttctactattttgtagaactggccgaaactcgaaacagagcgggggaagttatccccgctgataacttgagttggtcttcactgggttataccgcggataatgattggttcgaacaaaatcgtattgaaccgcttacttattataaaatgcgtgttcaaactacgtcagcagggtttgagccgtctgaatgggttgaaacagaagagttccaaacttttgaagaaaacgcatacacatttgagcatatgcaagaattcagtttagtgaaagaattcattaaacagaagttttctttaaacaacatgtcgtatgttaacttcaacacatctgccatgatggcatctttgatgactgagtcttttcagtttagtcctgaatattctcatttatcagctattgaaaacttcgttgtaggtgaatctggatatcatgaaattcagggacctattgaagcagtgtgtgttgataaaaatagaactatgctgggagaaatagacggaattttgtatctgtttgaaagattccaacatatggttaaagtatcaaacgataaaggacagaactggcaatacgttcagttatttaatgaccgtgtaggaaatcctgtttcacgagtagtaatttatcaatcaagtaccacatcatatgttttaggctatgataaaatcttttacggaagaaaatcatctgacgtacgctggtcatcaaatgaggttaaatttagcgataacgaagtcacgttcgctaaattgggagaccagttaaaactgggatttgaagtagagttatttggtacatatgcatcactacctgctgatgttaccaaatatgcagaagcctttacatgcaatgatgaccacttatatgtagttgcaaaggatacagtacgcagagttaaattaaaagatgctccaatagacactgaccctttaagccctacatttggtgaaaaagtgtttgaaaaggaagtatctcatataacaggcaatcctaaatctgtatgctttaaaatggattccgttggaggcaaaatctttgcccttattaccggggaagttaaaaccttaggattagacccaacagacccaaggaacgttgtggattctgcaactaaaggcgtctatgtttaccaggaaggcacaaatacttggaagcgtgtatttggtaataccgatgaagaaaaacgtcgtatagagcatttatggacttctatgtcaactgacggaaaggaaatattcttttcatcagctaattttaagacaacagagtacgctcaggatattgagcttgagacgaaatatccagaactaatttctactgcagttaaaaatgttaatccaattcagtatcactctgataagcattatcacatgatgagtttcagagcagatgaattttcaggatgggaaacatttgttcctggacctatgaggttttatgctgaaccttggtttgtctggatggctcgtgaaggcaacagatgctggataagtacagctgaccatgcagttgtcatttataatgatattctttatcaaaaaagagtagatgcagcggcgcagggaactaccgagcgtattctatcggaagtgtgggataaaggtgacgcaacgttttattgccctccagtttcatttaatggatttttgcagtatgcttctggcatcatgtttcacgaaccagacggaaaactgataggctattacgcatttgactaccgtgttcgtgaccaggtaacgcttaactggaaaccaactgatgtaatgtttaaggcgtttctgcagaaccaaacacgggaagaagactggacacctgaacatactccaggcttacgtgacccagatttgcgtccgtatcttactaaaatgatgccggatagttacttgctacaagatagtaattttgagcacttttgtaagtactatctccaattcctttcagatggaaatggaacacattacaacagtctcgttaatcttgttaagaacaaatatcctcgcgaagaaaatgcatgggaatatctgtggtcagaagtttataaacgcaacatttatctgagtaaagacgctcgtgacgctgtcgtccgtttctttgaagcacgcaagaatgatttctatgctactaaaggaattgaagactcatataagttcctgtttaaacttctttataacgaagacgtcgaaatcgatattgagtcaaagaacactaccgaatatgacattattgttgaaagtacaaatatttctgacgatttagttggtcgtacgatttatactgcttccggtcgtagtaatgtgacttatatcgagagagaataccgggatggtcgtctgttatggcgtattactattcataacttatcaggacggttcattgaaggccaggaaattaaatcagagcgtacggactttgagggtattatagttcaaggtgtccgtggaaaggatatgctgagtaataacattgattatataaaccgcagccgttcttactatgttatgaaaattaagtctcagcttcctacttctcgtttccgcgacgatgtattaaggtttgttcatccggtaggtttcggtttcattggtataacattgctgacaatgtttatcaatagtggcttaaatatgaagcatgttgagactatcataaataaactcaagaactataaatgggatgcaggactgccatcagtttatcctgatagagttgctattatcgcctcagatgatacaatagaaagggatccaataactaatgagcctagatattcttctcgtgctcaagctggcgaacctttcccattacctgctaactataatcaagaaaataataatagtgttatcgctggacaaaacccaggacaaagacgtaaacctctgagtcctacatttgaccaatcagcagtaacgtttgccaattatcgtgatttagttaaccaacgtcttaaagacgatgcaggtaatcctcgcgatcctgaaaatccgacacaggtaaaaattgatgagtaattcaacaagagcaagttcaacgcgtagcacgatttatcgtgctatcattacatctaagtttagaactgaaaagatgtacacattttataaatcgattggtccgggaacggaccaaaacacactgtatgtttcatttggcaaaagcactccgtggtcagataacgaatctgaacccggatttgcacctccatatcccgctgataatggagatggggtagttgatgtttggacaaatatgatgggcgcggtcaaaattgaatcatcaatgcttgattgcgttgttccaagaagagactggggtgatactagatatcctaacccgcgtacatttttgattggtgatattgttgttgctaactctgcgccatataacagaactgacgctggatttggatggatggtatatagatgtattgatgttccaaaagacggaatgtgttcaattggaaatcttacaagcaaagatgaatgtattaagcttggaggtaaatggacaccatcagctatttcaggttcagctcctcgtggtcgtggtgatgcaaatggtactgtcgatttaggtgatggatatctttgggaatatctatatgaaatcccagctgatgtatcaatcaacagatgcacaaatgaatatattgtagttccttggccagaagagattcaagaatctccggctcgttggggatttcaaaacaacttaacatggcagcaaaatgactttaatttaatttatcgcatgaagtgcaatacgattagatttaaagcatatcttgacgcaatttatttcccagaatttagtcttccaggaaatactgggtttagacagctgtcaattataactaatccgcttgaagttaagccaatgccaaattcacctaatgttaaggctgaaaaaggctggtatagtgcttctggtcttgaaagacagtcaggtgaaatgatttacatggaaaatcggcaacctattatacgttcaatggaccaaacagaagagttaaatttaattttcgagttttaattatggggagcctttggctccccatttttatataaataagactatactttgatatgaggttaacctatgtatacagataagggtaaaaaaataattgacgtcggtgagattggtaatgcttctaccggcgacattctgtatgatggcggtgtgaaaattaatgataacttcgacgccatttacaacgccttcgccgaccaacgattatttgcagctggcggcggagcattgaaccaaaaaattcatgcaacaagctattaccaaaagataaaatttggagatgctaactctgcagggacagttccaatggggtcatgcatagatgctgattgttcagaaggcgcagttcaaatacgtctttcaaaaggtaaagcgggagaagctgtattcgttgtaaatagtaatggctcagcatcaaaagctagatccataaaaataacaacaaacggcgaaggcgtagcagatgcatttaaagacggatcgcgagagttgattatcaacacgccaagatgcagaattgagctatggtgtgttgaggtaaaagctaacggtgctgctgtttgggattattcaatttcaagtatgtttggcagcacatattcgccattagaagctacatataatttaacaagttctcctattaatatccgcattggatataatgatgattactccaccgttaaattgttattaagcttcagtgcaaatccgggtggtcaaaccatcaaaaggcaatcatctgaagtcatgcttatgattgacccgactattacttcatcagcgccaaacggaagagtatttgacactgaatatgcagtgttaagaagtggtgaatcatctgaaaatgaaaagatgtattctatttcatactctattaacgcgcagaaagatttaatatgcacagcttcaacatcttatggaaacgcacgtttggcagttaaagttattgctacacagaccgtaggggtatctcaataatgaaacaaaatttgatagtaggccaatcagtagatgatgggtctggtgattacctccgtaaaggtggtcttaaaattaataacaactttgatgatttatattcagagttaggtgatggttcagttccattcgcagcaggtgcatggaaaacttttaaagctagccctactggaactactttaaatgctaagtttggtcaggcctttgctattaatacccaggcagcaagagttaacgttcagcttccaaagggtacagccaacgactataacaaagttattaaacttcgtgatgtttggtcaacctggcgattaagcccaatcacagttattcctgctcaaggcgatacattaaaaggttcagcttctcctaaaattttcaatactaacttccaagatttggaattagtttattgcgcccctggccgctgggaatatattgaaaataaaacggtagataagctaactaacggtaacttaagtactgtagcgaaaaaatcaattattgctactgcgggtcagactgactttcttaacatttttgatggcgtagaatataacgaagactcgcttaatgtatatcgtcgtggtaatattttatattacggtgaaaccagtgttatggataaagccaatgctgattacggttctcctggaacagtagcaggtcaattggtagaattaaacggtaaagacattcgtttaaaagttccatgcgttgaaggggaagtaataacatttgaaaccttcctagatggaattggtgtttatcggtcttcatacaacaagttggctatccagatacgagattcagcccagactacatcccagacgattcctgggtcaatgatagtagataaccttgctactctccgcagaatcactctggatgacatgggtgtacttccaggcgtaggggtaaatcctaactcgcttgaaatttcattgaacggaaaggaattactcgaagctggaactgctggtcttcctttattttattgtgaaggcgcagaaggtggatacgcagaagactgtataaacaatggtggtcaatgggtaaattctaaccaagattatagactggaatttgactcaactggtactaacgtcgaagctattatttttggtgaggcgtttgaagataaagaccttcttaccgtccgttggttcaataataacatcggtactactatggatatcaatgatatcatggcagaaaccgaccaagtgtatatgaatgctgagcaattagtaactctaaaaaatcgcattgaatacacaaattatgatgaacctaatcagaaaaatatgcgtccggttgctgacgatattatgattaaagtcaataatattgcagcattttttgacgtaatttatccgattggcacgatttatgaaaacgctcacaaccacgcaaaccctgctgactatatgggatttggggtgtggaagctttattcacaaggccgtgttactgctggttggaataatgattcatctgatccttatttttcgcgtaacaacaataacttaaacgaaaatggtcagccatcattaacagcaggtggaacggttggagatttgacatttacgttaggaaaagaacacattcctgaactaatgtcaagagataaagttctaatttcagaccctgaacatggaagcgtagttatcggtggatgtcaattagacccagacgcgcagggaccaggttattctaaataccgtgaagacactgttgcggtaaacaacggtgtagttccaaatgacatcactaaaattcagccaacaatcaccgtttatcgttggattagggtaggttaaaatgacgattgaaactaaaactcgtgaaggagctaaagttaattcaagattagctgctttttcagaatatcgcgttgacccgcaaaatattgcggtaggaaatacggctcctatagggagcctaacctttgaacaaatggatttaggggtttggtatccaaatactgaagctgctattaatgatttgatgtcattgcagtcagcagaaattggaactattatttgcaatgacactggaatatctccacagcccgcacagcaaattacgcgtgctactttttcaggtgtcgttgcgttagagccaaaagaagacggctctgtcggtgacccagtaataattcatattcttggcttaccaattagaattgcaaacggtgatgactttgcagcagtagcaacacgttggtatgataaagtaaaagaattagaagctgttggaaaggttgttcaacaggttactcaatcgccggcaacaccccagtatgttgatattattcatttagattatcagaaccataattttgaaacatataaaaagtatggtttaactgttgaatttactattacttcaccagctaaagcaggttatgggcaatgggatgctatcggcaacgaatctaaaacattcggcgcgaacacatttactttccactattttagaaggatgggataatggcccagaataactataatcactacagtgatttggccaaatatacgatatttgacccaacaaatacacaatggcctgttgctataaaagacgtccaatcagcgttagagctgattggtagctgggcaagaactgataccggattacctgtagcatctcctacagtagccggtgtaattcgcacagcaacacaggctgaagttgatgctggaactattggtaatgctgcggtaactcctgctacattaaaatccacagttacccgtcctgaagcaactacagcagttcttggcttaacacgatatgctactaatactgaagccgcagcattaaccgcaggaaatagaactattaccgcggcggctctcggtcatgtgtttaaaaccgtaaaagcccaagaaaacgtagatggaactgttaggttaactactgcggctcaagcgcaagcaggaactgacgaaactaccgcagtaactcctaagcgtgttgtagaaatgattggaaagttcagcgttagtcctcctagttatacctctgcgacagaaagcaacttgggattagttcgtgtcgcaacccaagcccaggtagcagcaggcgctgttcacgatggatacgcagtaactccaaaaaccttcatggaatcaaaagcgtctgacagtgtatttggtatagtaaaatttgctaaagactcagatgtggcttcagctacttctaacaatttggctgttactccaaaaagtcttcaagcgctaaaatccaccaaggataaatatggattaaccagattatcaggttctccaactactgatgcttcattggcagcggctgcaacagatgcagtctttaaaacccgtagaataaacggaaaaactcttgacaatgacataacgattactaacaatgatattaattgttatacaagacaagaatctgacgggcgttacatgccagctggaaccagagtaggtaatgttacttgggttgaaggtcaatcttggattagtcgaggtgcaacgtttacatgtaatgcaccatgggaagcttctagtagattagctctaaatgttaatgtaaaatttgagcgtaacaacgacggatatgacaatcgtattttcagatttgttgtaatagttaacggttcccaatggggcggtgaacttactcttaacatcgaaaatactaaaggcggacgaaatggtcattcatggagatttgaagcttacgcatctagcaactttttcttcaataacattcctccaaatgccactgttcaaataagaccaacagaagacagtcgtattatattttatgactgcatgcttacattctgtacaaatagaccgtaaggaacaatatgaccaaactagtagattcgcttccgttcgtagacggaattccagacgattttcaacagagaattaactggataaaaaatacagagcctcttaatggggcttcaacccgctatggaaatgatggagaactgaatagagcttctgttcaaatccagaaaaacgttgttcaggtacataacgatttgaacaacgttggaactgctgtagaaaatattcaagtagatgtagaccaaatcaaaaaatcgttagaaattacaggttcttctgacgccattgagcaggtttatatcaataaaaagaatattgaaaagcatgatggacaaattcttaaattagaagaagacaccgaaaaacttcgaactgaccttgattttctcgaagaggatgtaggtgtttatgattctagtaaagatgactattacagaacagttcgtgataatatagtttgggttaaacgtgaaattggtgcgtatcctgggcaagatattaacggacagccgaagcaagactctccgggttctggtatgaaataccgaatcatcaataatgcgtcagctatagtaaaacatgacgagcgtattcaggcgctagaggatgcatacaatgattcagacgtaggttctctgactattgaagtaaacgacctgcgtaaagaagttggtcctaaatccggagctacgtcagcttcaatttatgcaaggcttgtgaataacgctgatgctatttccgcagctaataatgaaatctttgctattaaccaagccattgattttaccaatccagtaaaaattggagctcgtactactagattagaaaacgattatcgtatagttgacgcaacacttaactctgcacaaaccgggttagttcctcgtgtcaataatattgatgctcgtttagggtcttctgataagcctgatactattgaaggaaaaattagttctctttcaactgaccaagggtacatttctgatgttgtaggacgtgatacttcatcagggcttcagggtcaagtagcatggataaaccaacaggttggtattgttcctagcgagcagccgattcctcctgggtcaattttagcgagaatgaccaatgttgaaggtatgcaaaactctcaacagtctgctattcaggacattcaagtagaacttggcaataacaatgaagggttaaagggttctgtatttacattacagactcaaatgaatggtgacttttcgtcagaaaacccagttcaacgtgatggtgtatacgctactgtagtagaattgcaagataaattcgtgactgcagttactgacgtagaacaagctggagcatacctccgtaaacagggcgaatggtttaaaaaaccttcatcaataggtgaattcagtaaagaagatttcactgttgatttaagttctgatgcattggtaaatcctaactcattggtcgctgctccattcaatgctggcattcgtattgtcgatgacattgttgttgatgacgatggcgtattttgcgtagaaactgatacggttatcgaagcttctgattcagataaaggcgtgaaaattgttattctcgttaataacattgaggtgttttcctacggacttggtgttaaagcagtaacgggcgagcagttgattaaaaccaagaaactcattgagttttcatctggtgatgcaatcaaaatcgtgtatagagctgcttcagaagaatcgcaggttcttgttaaaattaaatctttggatattactattcatccagctgtataacaaaaggggaccttcgggtccctttttcgtataaataggaatataaagaggagttcatatgtcatacaacacgtacaacccaaaaacgcttaaagacgctatacttcgacgtctaggagcgccggtaattaatgtagaagtaactgaagaccaaatttatgattgtattcaacgagcattagagttgtatggtgaataccactttaacggattgaataaaggttatcaggttttttatattggaaaagacgaagctgacaacgcaagatttttaaacggcgtgtttgatttgcgcggtcgtaatgtatttgctgtcacccaaattgttagaacaaatgtaggttcattaacttcaatggatggtaatgcgacatatccatggtttactgactttctaatgggaatggcaggaattaatggcggaatggggtcaagctgtaataaaagctatgggccaaacgctttcggtgctgaccttggctattttacacaattgatgacttactggtcaatgatgcaagatttacttgctcctctcccagattattggtataactctgataatgaaatgcttaaagtaatgggcaacttcatgaagggtgacatcattgtctgtgaatgctggaccaaatcatttatgaatacagatgtgatggtaggcaatacagcaggatatggattcgccggagcccaaactgctgaccactggggtttaggagatagataccagaatcctgaccttcgcaataacggccaatatgctggtgaaggcaatacaaatagagaaggtgcatataataatcgttgggtaaaagattatgctacagcattaactaaaaagctgtggggtgaaattctttttaaacatcagggtctgcaattggcaggtggagttacagttgatggtcaaacacttaaggtagaggcccaagaagaaatcgagaggctccgagaggaacttgatttacttgacccgggttgtcctattctgttggggtaaaagatgtctacatttgattctaggctcttcgctaaactcgaagattatcgaggatataataaaactaatgagactgaaattctcaatccttatgtgaatttttacaatcataaaaatagccaaacgttagcagatgctttatcggctgaggctattcaaatgagaggaattgagttttatttccttcctcgtgaatataacaatcctgatttgctttttggagaagacccatcaagtaaattcaccaaagcttggaaatttgctgcttatttagattcatttgaaggatattctggcgataacacattctttagtaaatttggtatgatggttaatgatgaagtcaatctgactattaatcctaatttattcaagcatcaaactaataattctgaaccaaaagccggtgatctaatttattttcctatggataactcattattcgaaattaactgggttcagccatacgatccattttatcagttaggtcaaaatgttcaacgcaagattactgcacaaaaatacatttattctggtgagcagcttcagccagaattgcaacgtaatgaaggcattaatattcctgaattttctgagcttgatttagaaccaatcaaaaatatagatgctcttgctgatatttctgatgtgcaatacgcagaaagtgacgcaatcaataaagaagccgctgaatatgttcatccgtattatgttaataacggaagaggacttgaatctcctcctaaagcagattcatttgatgacggatttttcgaataaataaaataaagatgggacctttgggtcccttaggagaaatcatgtttggacattggtataattcgtccttacgccgatacattgtattgcttggagatttattttctcatgtacaaattgctcgttggcgtgaagacactggactaaaatatattaaagtacctatcacttatgcttcaaaggaaaagttcctttctcagcttggaaaatggactgctattcagtctaccgagaataaagcaaaaatagaaactgttttgccaagaatgaatttgcacttggttgatatgcaatacaacgcgatgtataaaacatcacagctgaatagaacaaaatcatataaaactccttcaaaaattacatctcaatataatcctactcctattaagatgatttttgaattaggaatttatacacgcaatcaagatgatatgtatcaaatcatcgagcaaatcgttccttattttcagcctcacttcaatacgaccataactgagctttacgacaaagacacaagttttaatcgtgatgttagaattgtattacagtcattttctccggatgaagctgttgatggagacaatatcactcgtcgtagattagaatggtcattaatgtttgaagtcaatggttggctgtatccgcctgtagctgaaattgatggcgaaattagaaccatttatttagatttcttcgctaacagcaaagagttaactccagaaggaaactttgaatcagtagatagcgaagttactccacgagatgttcagcatgaagattggaatggttctagtaaacaaacgtattctcatgatattcctattccggtaaatccggaggctcctggaccgagaggtgaaaaatgagtgaattacaattagatatggctaaattattagacatcgaaggaattcctggaatagaaggacaagaaattccggtttatgaaaaactcgaattagttgaggttaaatctaacccaaatgaccgtaagcctgacctcgaagatgactattcggtcgttcgtaagaacatgcactttcaacagcaaatgttaatggacgcagctaaaatatttttggaaactgctaagaatgctgactctcctagacatatggaagtatttgcaactcttatgggtcagatgactacaaccaacaaagaaattcttaagcttcataaagaaatgaaagacattacttctgagcaggttggcaccggaaagggagctaatcctcagcaaggaatgaatattcaaaatgcaacagtctttgtagggtctaccgctgatatgatggatgaattcggtgatgcctatgaagcacaagaagctcgagagaaaatagtaaatggaacagactcaaccgtttaacgttctgagcgatgcccatcctttaaatgacgggaaactgacggttattcgtcacccgtctgaaatggaaacgaaaattgaaaacggagttcgtttctttaaatcgcaatgggatgataagtggtatcctgagaagtttgaagactatcttaagttgcatgggatagttaaaattcgtttgcaaggtgaagacccagctcatttccaaacgtttaaggacaaaaacaataagcgcacccgctatatgggattaccaaaccttaaacgagcaaatattaaaatgcagttgacgcgtgaaatagttgcagaatggaagaaatgccgagatgatattgtgtacttcgcagagacctactgtgcaattactcacattgactatggtaccattaaagtccagcttcgtgattaccagagggacatgctggaaatcatggcagccaaacgtatgacttgttgtaacctcagtcgtcagctcggtaaaactactgtagtagcaatctttcttgcgcacttcgtgtgttttaataaggataaagcagtaggtattcttgcgcataaaggctcaatgtctgcggaagttctcgaccgtactaagcaagcaattgaattacttcctgactttcttcagcctggtattgttgaatggaacaaaggctcaatcgaattagataatggctcatctattggggcatacgcttcgagtcctgatgccgttcgtggtaactcatttgcaatgatttacattgacgaatgtgcgtttattccaaacttcatcgatgcatggcttgctatccaacctgttatttcatcaggtcgtcgttctaaaattattatcacgactacaccaagtggattaaaccacttctatgatatttggactgcagctgttgaaggtaaatccggctttacgccttatactgcaatttggaactcggttaaagaacgtctatataacgacgaagatatgtttgatgatgggtggcaatggtcacttcaaactatcagtgcttcttctcttgaacagtttaaacaagagcactgtgcggaatttcatggcacatccggtactctcatttccggtatgaaacttgccaatatggattggattgaagttactcctgactcgcacgggttttataaatttaaagaagcggaagcagaccacaaatatattgcaactcttgactctgctgaaggacgcggtcaggattaccatgcactaaatattattgacgtgactacatctgaatgggaacaagttggagtattacattctaatacaatttctcacttaatcctcccggatatagttattaaatatctaatggagtacaacgaagctccgatctatatagaacttaactctacaggtgtttctgtagcgaagagtctttatatggatttagaatatgagaatgtcatttgcgattcaatagttgatttaggaatgaaacagacgaaaaggtcaaaagccgtcggatgttctgcactaaaagaccttatcgaaaaggataaactcattattcaccatcgtgctactgttcaagaatttcgtactttctctgagaaaggagtatcctgggcggcagaagatggatatcatgacgatttaattatgtcactcgtaattttcgcatggttaacaacacagcaaaaatttgctgatttcgtggataaagatgaaatgcgtttagcatctgaagtttttaaacgcgaattagaagatatgaacgacgattacgctcctgtagtgttcgttgacgccgtgaatagcgcagaatatgcgcctcaagaacatggtctttcatttgtataaataataaaaagcaaacaacattgaggatatatcatgcctttagtctctcctggaattgagctcaaagaaacgagcgtacagagcacggtagtacttaacgctacaggtcgtgccgcaattgtcgggaagttccaatggggtcctgcatatcaagttactcaaatcactaatgaagttgaactggttgatatgtttggcggccctaataaccaaactgctgattactttatgtcagcaatgaactttctgcaatatggtaatgatctacgcaccgtccgtgtagttaaccgtgaagctgctaaaaacgcatctccgctggttgataatattgaatggactatcactactgctggtagtaactatgaagttggtgataagattacggttaaatatgcagaccaaactgtagatgacaccggttcagttactgaagtagatagtgacggaaaaattaagtcggtgttcattccgacatcgaagattattgcatatgcaaaaagcattaatcagtacccagatttagggtcttcgtggacaactaccattacttcacagagttctggtgtttccgctgtcattactttaggtaaaattatttctgagtctacagttttactgactgagcatgaaactgcccatgaagaaatgacaaaaaccgaattccagactgcgcttgcgcaatataaaatgcctggaattgtagctgcgtatccgggcgagctcggaaaccaactggaaattgaaatcgtatcaaaagctgcatttgataaaggtgaacagctgacgatttatccggctggtggaaaacgcgcttcgactgcaaaagctgtatttggatatggtcctcagaccgatactcagtacgctatcattgttcgtagagatggcgcggtagttgaatcaactgtgttatcaacaagtcgtcaagataaagacatctacggaaataacatctttatggacgattatttctccaaaggttcttcacgttatatatttgctaccgcgcaaggatggcctgaaggattttccggtgttattcgtctgggtggtggggtttcagctaatgaatcagttactgctggcgatttaattcaaggttgggatttatttggtgaccgtgaagcactgcgggtaaaccttctgattgctggtgcttgtgctggtgaaacggatgaaatcgcaagtacagtgcaaaaacatgtgtcgtctattgcagatgaacgtcaagattgtttagcactcatttcaccaccaaggtcaacgattgtaaatattcctctgacccgtgctgttgataatttaattgattggcgtcaaggtgaaggaagctacgactctgcaaacatgaacatcaatactacgtacgcagcaattgatggtaactataaatatcagtatgataaatataacgacgtaaaccgttgggttccgttagctgctgatattgcaggcctgtgtgctcgtacagatgatgttgctcaaccttggatgtcaccggctggttatcgtcgtggtcagattctgaactgcattaaacttgcgattgaacctcgtcaagcacatcgtgaccgtatgtatcaagcaggtattaacccggtaacgggtcaaggtaccggtgatggtttcattctgtttggtgataagactgcaactactgttccaacgccgtttgaccgaattaacgttcgtcgtctgtttaacatgctgaagaacaatatcggtgattcttctaagtggcagctgttcgagttaaacgataactttacccgttcttctttccgtatggaaacaagccaatacttggcgggtattaaagctctgggtggtgtatatgacttccgagttgtatgtgataccacgaacaacacccctgctgttatcgatcgcaacgagtttgtagcgagcttctatatcaaaccggcgcgcagtataaattatattacgcttaacttcgttgctacggcaactggtgcagatttcgatgagttgatcggaccacagtaatatgaaccccaggacattctggggtcatctaacctttagatgataaattatattaccgcacactttaatagcctctatgatgatgtagtcaatcgagaggctatataaatatctataggaaacaacgatggaattaacagacatcacccgtgcgtttgaatctggtgactttgcacgtcctaacctgtttgaggtagaaattccttacctgggtcgtaacttcagtttcaaatgtaaagcagcaccgatgccggcaggtatcgtagaaaaagttccagttgggtacatgaaccgtaagattaacgtcgctggtgaccgtacttatgacgactggactgttaccatctataacgatgataaacacgaagtacgtaaggcaattattgcttggcaggctcaggcccacgctcaaggcaatgatatctctggtatgactccagccgattacaaaaaggttgctacggtacgccagtttagtcgtgatggcaaaactatcacaaatgaacacaccattactggtctgtggccaactaacgttggtgaagtacagatggactgggattcgaataacgaggtagaaacgtttgaaactacctttgccatcgactggtgggaataatgctatggggcttcggccccgtatcgaagttctgtgagttatttgcttaaatatctgacaaaacttcgatataaatatacttatagataatttcggagactccaatggcctttcatattttggacttattcgctccgtgggaaaaacgcgacgaagctgaatataagcaacaaatcaacaatgacctagagtcaatcactgctccaaaatttgatgatggagctcgtgaagttgaatcaaacgaaaacgaaatccagtacaattcattcaaccaaatgatgtttggttccaatgaacctggaatgaaaacaactgctgatttaatcaacacttatcgtagtttaatgaataactacgaagttgacaatgctgttgaagaaatagtttctgacgcagttgtatacgaagacggtcatccagtagtttctcttgatttagattctaccgacttcagtcaagcaattaaagaccgcattcttgaagaatttaatacagttttaacatgccttaatttcgagcgaaaaggagccgaccatttccgccgttggtatgttgactcaagaatattcttccataaaatcgtcaacacaaagaaaatgaaagacggaattcaggaactgagacgtcttgacccgcgcaacttacaattcatccgtgaaatcgttaccgctgatgacgctggtactaaaatcgttaaggggtacaaagagtatttcatttacgatactggcaaagaaagctattatgcagatggcagattatattccgccggaacgaaaattaaaattccacgcgatgctatcgtatatgcacattctggactagttgattgttcaggtcaaaacatcattggttatttacaccgagccgttaaacctgccaaccagttaaagctattagaagatgcgttggtaatttatcgtattactcgtgctcctgaccgtcgtgtgttttacatcgacactggtaatatgccttctcgtaaagcggcagcacacatgcagcatattatgaacacgatgaaaaaccgtgttgtatatgatgcgtcaactggtaagattaaaaaccaacagcataatatgtcaatgacagaagactattggttgcagcgtagagatggtaaagcagttactgaagtagatactcttcctggtatgtccggtatgagtgatatggatgacgtccgttactttagaacagcgttatacatggcattgcgagttcctctttcgcgcatgccggatgcaaataatcaaggcggtgtgcagtttgatgctggtacagcaatcactcgtgacgaacttgattttgccaaatttattcgtagattacagcataaatttgaagagattatgcttgatccacttcgcactaatctaattcttaaaaaagttttgtctaaagatgagtgggaagacgaaataaataatattaagattgtgttccataaagactcatatttcaccgagttgaaagatgctgaagttatggagcgtagaatcaatatgctcacaatggctgagccgtttatcggtaagtatatttctcacaagacagcaatgaaagatttccttcagatgtctgatgaagaaattgaacaagaagccaagcaaattgaattagagtctaaagaggctcgcttccaagaccaagaaaatgaagaggatttctaatggaaaattatatttccgcaattgaatccagagacctcgtagcagccaaaaaagcttttggtgcaattatggctgaacggacatctggtttaattgaagagcgcaaaaaatttatcgcagcgtctgtcatgattgagggtgaagagcccgttgacgatgaagatgaagacgacgaagatgaagataagtctgagaaagacgacgacgaagaggacgagtaatgcttatactgcctgaaaatcatgaattagttatcgacgctgtcgaagcttttcttcctgaagcacaggcacgttttgataagttgtccgcagcgctttctaaagatgatataaataaaattgtagagaacatggttacttctgagcctgatttagcaattgctttaggttcaattaacgaatctctacaattaaatgaatttatcgttaagcacgttgattctaaaggtactattacccgtaccaaagatcgtaaaacacgtgagcgtaacgcgtttcaaacaaccggactttctaaagctaaacgccgtcaaatcgcgcgtaaagcagtaaaatcaaaacgtgctaatccatcggctcaaactcgtggattacgtaaacgtaagaaagcacttaaacgccgtcaggctctggggctaagttaatggaaaacctcaatgaacaacttttaattgagcattggggtcaaccgggcgatgtaattgatggtaaacccatgctggaatctattatcgttgaaggcgaaaatgaatctggcttaaaacctggtctgtatatcgaaggtgtttttatgcaggcagaagtagtaaaccgtaataaacgtctttatccaaaacgcattcttgagactgcggtaagccgttatattaaggaacaggttgctactcgtcaggctctaggagaattaaaccatccacctcgtgcaaatgttgacccgatgcaagccgcaatcattatcgaagatatgtggtggaaaggcaacgatgtttatgggcgtgcaagaatcatcgaaggagaccacggtccaggtgataaattagccgctaacatccgtgctggttggattcctggtgtatcaagccgtgggctcggttctttaaaagactcaggaaaaggatataacatcgtacaagaaggctttcgtctgactgttggtgtagacgcagtttggggtcctagtgctccggatgcatgggtacaaccgaaacaaatttcggaaaatacctcggcacaagttgccaatagtgctgatgatgcttttatggctctcgcagagaagttaaaagcgttataaataattatgtaacttaacacaggacatcaaaaatgcttaaagaacttttaatgaccgaagctaaaactatcgatgcttccgtcgctcttgacagtattttcgaatcagttcagctttctccggaagctaaagctaacttcagcactgtattcgaagcaacagtcaaaaaacacgcagtagctctggcagaatctcacattgaaaagattgctgagaaagcagaagaaaaagtagaagaagaaaaagaaaaagctaaagaagaagctcgcgaagagctgaaagaagctgcttctaaatactttgaccatatcgctgccgaatggatggcggaaaatcagctggcggttgatcgtggtattaaggctgaactgtttgaatccatgtttagcggtatgaaagaactgtttgttgagcacaatgttgtaattcctgaagaatcagtagacgtagtcgctgaaatggaagaagaacttgctgagcaaaaagcagaaactgctcgtttatttgaagaagtttctaaacgtgatgcttatatcaattacgcccaacgcgagtatgctattcaagaagcaacccgtgaattgactgatactcaaaaagagaaagtagtttctctgacagagggtatggattattctgactcgttttcaactaagctgaaagctattgttgaaatggtgcagggttctgtagagcagtctgtaacggaatctgccgatataaatactatcgacaaagaagcagacggtttaaacttcacaactgaagcagtcgaagaaactcctgcgactaaaaccccatccgttatggatgcttatgtagcccaagcggctcgtctttcttaatttaaaaggttatacaacacatgaaaaagaataaacttatcgaaaaatggcagccgctgcttgagaacgaagctctgccggaaattgttggcgctagcaaaaaagctctgatcgctaagatttttgaaaaccaggaagctgatattaatcaggctccggaataccgcgatgaaaaaatcgctgaagcatttggttctttcctgtctgaagcagaaattggcggtgaccacggttatgatgcacagaacatcgcagctggtcagacctctggtgctgtaacccagattggaccggcagttatgggtatggttcgtcgtgctatccctaacctgattgctttcgatatctgtggtgtacagccgatgtctaacccaaccggtcaggtattcgctctccgcgctgtttacggcaaagacccgctggctgctggtgctaaagaagctttccatccgatgtacgctccggatgcaatgttctctggtcagggtgcaaccgagaaatttgaagcagttaaagctggtgatgctctgactgttggtgatatcgttgttcacgatttcgcacagaccggtcgtgctcatctgcaggttgttgaagatttcactgtagacgctggtgctaccgatgctgctaaactggacgctgcagttactgctgctctggaagctggtaaagttgtagaaatcgccgaaggtatggctacctctgttgctgaactgcaagaagcctttaacggttcgaaagataacccgtggaatgaaatgggcttccgtatcgataaacaaaccatcgaagcgaaatctcgtcagctgaaagcacagtattcaatcgaactggctcaggacctccgtgctgttcacggtatggacgctgatgctgaactgagttcaatcctggctactgaaattatgctggaaatcaaccgtgaagttgtcgactggattaactactccgctcaggttggtaaatctggtatgacccagactgttggttctaaagccggtgtattcgacttccaagacccgattgatatccgcggtgctcgttgggcaggtgaaagctttaaagctctgctgttccagattgacaaagaatccgctgaaatcgctcgtcagaccggtcgcggtgaaggtaacttcattatcgcttcccgtaacgtagttaacgtactggcagctgttgatactaacgtatctccggcagctcagggtctgggtcgtggttataacaccgacaccactaaagcagtatttgctggtgttctgggtggtcgctaccgtgtatacatcgaccagtatgctcgtcaggattacttcaccatcggttataaaggtgctaacgaaatggatgctggtatctactatgctccgtatgttgcactgaccccgctgcgtggttccgatccgaagaacttccaaccggtcatggggttcaaaacccgttacggtatcggtattaacccgttcgccgattctgctgctcaacagccgaaaggtcgtattacctctggtatgccttctatcgtcaactctgttggtaagaatgcttacttccgtcgtgtatgggttaaaggtatctaataccaataagggagccttcgggctccctttagttgttttaatggatataaataaacttataaatccacagaggaaagcgcaatggctaaaatcaacgaacttctgcgcgagtcaactacaacgagtagcaacttaattggtcgccctaatctcgttgcattaacgcgcgcaactactaaattaatctataccgatcttgttgctacacagcgtactaaacagcctgtagcagcgctatatggtatcaaatatcttaaccctaatggtgatttgacatttgcaacaggtgcaacctatgcaggtcaaatcggagccacagaacgtgagtcaattgaagaactcactatggcaaataaagactcattcaataaagacgatatgttcaaatatcagaatgtggtctttaaagtacttaaagatagcccgtttactgatacaacagaaaccgatgaatttggacttgtatctgaagctgtagcagctaataatattcgtatgctgtcagatgctgcagtcactgaaaaatttgaaggacctgattcagacccaatcaccgaagccagttttaaaattgataaatggcagacccaggttaaatcacgtaagcttaaaacagatttaacggtagaattagctcaagatttagaagctaatgggttcgatgctccagaacttattgatgatttacttgctactgaaatggcagaagacattaataaagacatcctgcaatcattgattacggtttcttctcggtttaaagtagctggtgtatccgataaaggtgtattagatttaactaagcaggattctgctccggaacaaggtcgtactctgtatcgtttcatttgtgaaatgaattcagcagttcaacgtaatacttcttattctggtacttatgcagtagcatctactcgttgtgctgcggtgcttgcagcttccggttggttaacacagaagaatgatggaagtattccggaaaacgcatacggtatgctgaataacggtttacctctttattgtgatactaacagtccggttgattacgttattgttggtgttaaggcagaatttggtgggaaagaaactgtaggttctttattttatgcgccatataccgaaggcttggatttagacgaccctgagcatgttggtgcatttaaggttattgttgacccagctagcttgcagccttctgttgctttactggtacgatatgcgctgtcagttaacccatatactataggattggacgaggacgaagctcgtgtgattaatgctgcggatatggataagatggcaggaagaagtaagatgtctgtactgctcggtgttaagttacctaagcttattgcggactaatttgcggggagcttcggctccccttttttgctataaactaaatatgtcaaacctcggggagtattcctcctcgagggatttaaacacgttcttatcatagagattgacgcattctattccatgtctacgggctatatcaacagctactctcgtccctccagatacactcccgcatcttttttcaggcgcccaatataataccttatctacaggctcagtgcattctaggcccaatacctgcatagaattccgtgcaaatagtgtctgtactatcttcgagcattcatcccagtacgacgtaacttctctcgccttaatgatgcttttgattttggcttcgtttgataattcagaccatacaacaacacctgtatcaggaacatggccacaaaagccagaataaggaataatcctacaagaatttgacctatcgtatttcgccaaccacgcttcatctgaacccggagctccacctgaatatgaaaaatgcccctcttccgagaggcgttgaccgattatagtcattagactcagaactctgcgtggcgcttctcttgaaccaatcagcgccagcctcattattctaaaacctcatgccatttgctacgaatagtgttttgaattaaagtagtcagttctttcttaacagcagaaggattatcagcgaatagcatgtcatgaccttcacgagctgcttcgttgatgatatctttcatagtcagtcccataactcgaccaaaatctttggcagttacagtaccaatatgagacagaacgttacttacacggttccaggttacatactcggaaaagatttccagaacacgcttatcagtatcagtgagttcaaccttagctttaataggcttatcagatttagctttctcgctgaacttagaattcttacacttaatagctacacgggtaccgttattaaagaatttaggattaaccggtttaagaacatagccttcagctacaccggtttcagaagaagcctgtggaccgaacacatgtttatttgcatgttcaaggtcagtcgtgtcaacaagttcattatagtaattgacaatagatttaaagtcatttacatactgagatagctcagcgaatgaaccacgaccaagcagtggagctaatttaagaccaagaccagtagcaaacgattctactacataatcgtcccaataaactttttcgttaccggaatccgacaggatatcaaacacgtagaaatctttatcaccataatctacgcccttctgaataccaccgccagcaaattcaccgaagatttgaacagatactaaatccatggtgttcagcatgttctgcatcttaacgaaagaatccttgtacttcttcatgataatctcatgaccaaagaagctttcaccttctaaaataggaccagtacgcttagccggaacgatttcggtaggggtaataatcacactgaagttagtgccatgaattttctcacgagccacccactcaacggtatgcatatcaaaaccagcaccacgaatcttctcgatgaacttaccgttgtaatgattctcaagactagaatattttgcaaacattataatttccttagaatgtgattttcataaagtcagtatcaccgttacgctgggaactggtataatttgtaacaaatccttcatcatgcaaataattaagaacacttgtaatgtgtttcttaactagactactcggatacataattaactcacgcttacccgctaaagcggttttctcaatctgagttaatacttcttcttttgctgccgataattcttctgtagcaacattaatagcagtattagccattctatcggcaaggttcataatttttctctcaataaataaaataaaaccaggagtccatctatcttggacaagggtaatggtatcagaggatttcccctgagcccattataccacatcgatttttaaagcaattaataaccgctcggtacgaagcgatacatgatatatccgcttttagttagcatgatttcaaattgacttttgcttccaacctcaagtactaatggaatatctttatccattagcatccaatcaatttttccataccgttcattaatcaaatccgttattttacgtgcaccacttttatagtagtaagaactctgaacagccatcattttactaacaaatttagatgcaaacaaccagacatttaccccattagcagctggcgtaaatttcttagaaagcatttcttcaaatcgttctactacaattgggtctactttagacattataaagtcctcatgtgtttaacaagtttcttatgacgagattttataccaacgtttgttaagcgtttccgatatacgactttttctttttgcttaaaccgttcgtgtgctttctcaactgagacccacaatttagcagcttccgctggagtgatatctaatgctctcgcaatttcttgaaaatctttaccgctttcatgcattaagtgagcttgtagtgctttcataataacctcatctatgtgacgaggacataataaaccaatccgtgaatagcaaaaaagggagcccgaaggctcccgaatattaaggatagataatacccgcttccagcgcagtacgatgaacaatgtatccatttctagattcttgtacatcgacttctggataatcatctagcattttagccagagtataccgatgcaggtaatagtcgctgtcagggtcgtcgagtttccaatctttgccctcaacagtcattcgctggatttcatccattacccaccatccgcaccagatataggctgttccacggaacggtagaggatgaatatacggaagttctccgtctggctcaggggctactcttttggtaatagttacatcgccagttttagtgactgtaatcggggtgtaatcttctgcggaaacctcaacagaaacctcaatcacttgagaccctatatcagacgtgtcaatcactaaagtgctagtagaaccttctacaggagaaccgtctttggtccaagaataaaccccagttgcaccttctggagcaccgataacgttggctttaaaagatgcttcagacccttgttctgccgtaatagactcaggagtcaaagtaacagaaacaccactcattgtctttttagtaaaagcaacagcaatacctttagttgcagttccattattataatctggagcagaaaccgttacttcacaattcaatgtgtagctggtttccgttgactcggttaaggtaattgttttacccgtttggccagaaataacagaagagccacgtttccaaacataagcaatgcttgctcctgacggggcgccagtaacatcagctgtgactacttgggattgaccaatttctttagaaacagaagttgggctcaaagttaaagtaatggccggcatagttttgttcttaactgtcagagtagtttctgcttcagctgtttcgggatcgccttcagccggagtaacagtagcaactactttaacggtcttactacctgcaggtcctgcagcaacataattcatagctgcggtaacagaagattgttttacaccatttacggtccatacaaacgtttctgtgccttcagctgcggctccagaagttgttgcagtaaaattggttgttgctccaatgactgccgaagcagccaaaggagcaatagatacgctataagccataggtgttccttattttaaagttacaaatgaagaattacgtgtttcacgaatcataacagacccgtttcttttgatgtaatagattaaactaaacagtgtctggtgtgctgatgggtgttcaaacgacgttggccgagatttccaatctggggtatctttaatccattggtaaatccaccatggaagagtaatatatcctgggttcttacctagcaattgcatgtttggactaaagtttttaggaagctcaatggtttcatcagttttaacaattttaactactttgtccattgctttgaagaattcttcagggtccgtagtactaattggaatgtttgtaagttttccttcatcatcgatatggataacgctgtctccaataggagcttcagcataaaatcctttatcattgatagaaggagtttttacttcaaatccagggtcatttactttgggtgtttctttataaaaatctgggtcaatatcatgaattttaacacttgcacttactggagcatcaaacagtagttttgcttcatcagacgcttcatcattgaaaagtgcttttccttcaatttcatcatctgcttggattaaatcagcaattgatagaccatcgttgtcttctggcataggctcatcggccaatttagccagttctttttctaagtcagcaaccatattgtcaaatgagcgggtcttcttcagtttaataccgaaggttttggcatattcgtcgagcttgtctttagcttcttttttatcgagtgcctgaatttctttaatatagtctttatctagcattgggtgtgcctcatgtaatgtataaatatgattgtatttataaactgaggatagtacagtgcacgacatccaagtcaaatttaaagattttagtcatgttcatattgagtgtgatgactcaattttctatgaactcagagactattttagcttcgaagccgatggatacagattcaacccgaaatatcgttatggacattgggatggaagaattcgtctgctagattataatcgtctcttaccgtttggtcttgttggccaaattagaaaattcgctgaccaattcggatataaagtttatttcgatccaactatattcgagcaagaaactctttcacgggaggattttgacaattggttatcgactaaagaaatttattcaggattaactaagattgagccacactggtatcagaaagatgctgtatatgaaggtctagttaatcgacgtagaattcttaatcttccaacgtctgccggtaagtctcttattcaggcattacttgctcgttattatgtagaaaattacgaaggcaaaattcttatcatcgttcctaccacagcgttagttgaccagatgattgatgatttttgtgattatcgtttatttcctcgcaatgctatgttgggtattcgaggtggtactgctcgtgattcgaatgcattagtttatgtatctacctggcagaccgctgttaagcagcctaaagaatggttttctcaattcggcatgatgatgaatgatgaatgtcatcttgcaacgggtaagtcaatttcaacaatcattgcgggtctcaccaattgcatgtttaagtacggactgtctggttctcttaaagacggcaaagctaatatcatgcaatatgttggcatgtttggtgaaatcttccgtccggtatcaacttctaagttaatggaagacggacaagtaactgagcttaaaattaatacaatcttcttaagatatccagatgcagccgcaaatgctttaaaaggaaaaacgtatcaagaagaaattaaattcatcaccaatgttaagaaaagaaaccgttgggttgctaatttagctgctaagctagcatcgcgtgatgaaaacgcttttgtgatgtttaaacatgtagctcacggtaaagagctattcgagatgattaaagctactggtcatgagcaagtttattacgtatcaggtgaagttaatactgaaacacgtaatgctttaaaggctatggcagaaaacggaaagggaattattatcgtcgcaagttacggtgtattctctacaggtatttctgtaaaaaacctgcatcatgtaattttagctcatcccgttaaatcgaagattatcgttctccaaacaattggtcgtgttcttcgtaaacacaaagataaatctttagctactgtctgggatatcatcgacgacctcggtgtaaagccgaaatccgccaatgctaaaaagaaatacacgcatttgaattattgcttaaaacatgcattagagcgtattcaacgatatgctgatgaaaaatttaactacgtaatgaaaacggtaaatctatgattaaatttgaagatatttacgaagccacaattcgtgaggctactatcgataacttcatgagtaaaattaatgcttgccaaaccttagatggtctgaaagaactcgagaagtattacgataagcgctctaaagaaactactcttgctgattctgatgacatcattgtgcgggatgctttggcggggcgtagacaggctcttgaagctgattctgaagatgacgaagacgaagacttctgatataaaaaagccccaaccgaaaggaaggggcaaagccaattggctacatcaacactagactaaattaaaagttgcgtttcttgtaattgctcttctgtgtcttcagtgacaggcaattcaatcgcataattatagcaagctccgggatgaaccgggcctttgtctgtgtggacaaccaatgcttcatcgattggtcctttacagacgacacataccgtattcgacatgattgtctccttagtttacaagtttatttattacgcgccagcttcaaactgacgaaggtcaataatgtgcttaatgctaaaacctcgtgacttgatagcatccattgcatcgctacagaactccaaaagaattccccaatattgcaatttagtatctacacccaagatttctttatcagcgcttaaaacagttttcatttctgatttttcatatacatccatgcatacttcaccaccaacctcgccacggccagtgtaataatccaaccgtgctttaagattttgctttttgagggcatctaatcttaacatctcttttcgacaggtcgagtgcttacgcacccatttaccatacagaacggggttattagccgcttcatactgtagtttagtctggtcgataatcaaatcattatccaattcatcctgtaattcttctaatctcattctatctccactctactgtttctttggaaggactagtcccattatactctactgctagagttagcattactacgcatctgtatgcgtatacgttctagcgtatcggggtcgtctactatagaaaactgcacggtgacaattatagcattatcgtcatataacggaagcacatcaactgatagacgattaatcctaggctcataattacgcacagcagagactatattacgctttatcgtatcaccagttaatggagtcatgttttcaaataattcgtttgtgatatcacaaccaaacgctgggtcaaatggccgagacccctttcttgtggttattattccaagaaggctgtttttaactgatcgagctcctactgtttttgacacgtcagtgtcccaagcaagtcgcatttctgggtcaaggtcagaatagagtttatcgatattgctcatgacataatcttaaagaattctttaagccccttaattacatgaatgtgagaaattccgcattcacaagtaatgggaactgccaattgaacctgtggcttcaatagcatatttttaatgttaactacatcttcggttgtaatagcagaatataaatcatcgatttctgcatcgtttaaatcattaaagtaaatctgctcatttccaaccacgatataatctatgcattttgatatcatcattggaatgtcggaatcgtcaaaaagattaggatacttgaactttatcttgaatccctttaagtcataccagaggtcttctggaggatcgatttgcgcatgtgtataatttaatggcacaggaattttacgcccacaggtgcaattccaggtcacctcatgattaacctcgcctatactatgcgcccaaagtataactataagtaattccgattcttgtttgtttaacccagtagcattagtacattctctgagcaatgctttaacacattcatcgattgtaccgtttttcttcgctgcaattaaattagcgtattcttctagtgtaaaagctcggcactggatattcttgccatttattcttgtttcaaatttatatgtgatgttcatatccactcctcttattcaattatttataaatagtataaagaggattaccttatggccaacatagttagatgcgaattaccagatggtgtccaacgttttaagccatttaccgtagaagattatagagaccttttattggttagaaacgacatgaacaccaagtctgaagaagaccaaaaacagcttatagcagaattaatggatgattattttcatgaccatcctgtcgagtatcgtccttatatatttcttaaagtatttttgtcaagtattggtaaaactaaaataccagtcagaatgaagtgcccaaaatgcggaaaatataagcagtatctttttaatcttaatcagcctccgttgacaaatccgaaagtagaggttgcaggattaacgcttaagttcaaaaaacctatagaaataattgatgatacaggtaaaatgattttagacaacattatatctgtgaaggattcatctggggaataccagtggaatgaattaagcgatagtaataaattgacagttatcgatgctatagatgttgaaaccttggaaaagattttatcgcagatgaagccgtttaactttgagctaaagacgtcatgctgtgataccacgacagtattaaaatatgataacattgttgatatctttaagctattgctacatcctgacgagattttcacattttaccaaattaaccatagattggtttctcaaggtaaatatgacttgaattctataatgaaaatgctgcctatcgaacgtggcataaccttatcgcttattgaaaaggaccttaaatcatgacagcacaaagattaggatatcctaatataagcataaaattatattctggatatgatgcgtggctagctaatagattcgttgaattagcagctacatttattacattaacaatgagagattcattacgcgggactaatgaaggtctgcttcagttttatgattcgaaaaatatgcacacgcgtatgaacggtgatgaactggttcaaatatctgttgcaaacagtaacacatcaagaacacaaactcgaatttacggaattaaacactttacagttggtgttgatgataaaggcgatagcattatcacccttcagcttggaacgctgcatgacataatgaatctcaagttcagtagagcgttttttagttctgcatatgaaactataaaagaaatgataggcgcgatgtatgttgaccaaccattgattgctcctcctatcaacggaattaacgcttacgtcccacgagttccatggactagtactctcaaagattacttacgatacgttagaaacgtaggcatttctactgataacgaccaatttatttttgcctgggaagatatcactgggattaacatgatggattatgaatcaatgatatcccaggacccaaatgtattcatgttcggggctcctcaaacaataggtcagtttgcagcaggattaaaatatccattagcatgggattttgaatggcttgttaagtcaaatagatataatagaaatcccatgaaaaacgcaacattttatgcacactcatttgttgacaaagatgttacccgaattattaatggagaaggccaaaacagcgtattcattaatagatcaggcggatattctgacatgatttttaggaatggctatgaagaagcactacgcatttctacgatggctcaatatgacgggtatgctcaaactaagtgttacggtaattttgaactaactccaggaatgaaaatcaactttgttgatttaaaggaccagttcagaactgacttttatatagatgaagttatccatgaaatatcaaataacacatctataactaacttatatatgttcacaaacggctctgcccttgaacctgtagatttgattaaggtgaaaaatgaacttaaacgtgattcttcctattaagaaaatagtaataaatgaaaagacgatatcaattccaaaactggggttaaagcaccataatctgatgaaagatgttaagggtccagatgaaaacatgaatcttcttttggattcaatttgtccaggattaacagcagccgaatctgatattgttgtattacatttattagcatttaacaacagaataaaagaaactgctgttaaagatgattttacctacgatttgaataaggtttacatttgccagcgattaactcaaaggttagatggtaaagaattcaaattcagagctcctcctcgttattccaaactaggttcagtagattcaattttgagcgaatttcttgaatcagtagatggaaaaccaatggatataaactttatgaagcttccagcttttgtgacaaagtgggctgatgacttagtaaacactatagccattgatggacctgaaggaccaatcaaaggcatgcttaacgtaatggaaatatttgaatgactaagaaatcagaaatgaattcaatgcgtagaagagttattgctgactcggctccacagaaaaaggctgagtctcaagctgatgctcagattaatacgctagaagatattggtcgtcgcttagacgaccaacaagcatctactgatttgatttcggatgtaatagaaactaaatcaaacgaaattatcaaatcggtagaagatgtttcagctggtgttgaattaactgctgaagcttcagaacgcacaacagatgctgtctctaaactaaatgataccgcatcgttaattaatgataagctcacgaaacttgccgacttgttatctaaaaagcatgatgttcagcaagatgtccaaaagactggtactggaacatcattagaaacgataacagaacaagtcccggatgctcctactcagcagccgctagaggaattactcgaaagacttattcctcctcaggatggcagacgtcctgacgcggatttctttcctagcacagaagagcaagaggaaaaagctgagcctaaaaaggaaactgaggacaagaataaaaagtttcttgacctaaaatttggagaattaattaaaagcgttaaatctggttttggaaaaactatttcattaacagataaaattagcagtatgctgtttagttatactgttagcgctttggcccaaatggcgaaaactgccgccatggttttgggtgtgataatgcttatagatttaattaaagttcattttaattattggactaaattattcgaaaagaactttgttgaatttaacaagcaagccaaagaatggggtccgctattaacagcaataagcgagatgtcgaatgaaatagtaaaatcattcgtcaagggagattggggcggattagctaaagccataggttctggcttggttgatgtaattgacaagctcggagaaactattatgctcggaatgagtaagcttcttgctggaatgttacgcgcattaggatttaacgattcggcagataacattgaaggcgctgctttagacagatttcaaactgttactggagcagaactcgatgaagaagatgctaaaatgagagcaaaatatgttgaccgtcaagaaagagaatatgacgaacaacctgaatggaaaagaaagctttctgctaagttccaaaaattcaccggtcagattgatgacgatgaatataacaaactgctgagcggagagaaaaagcagtcagcgtatgcagacttgccagaagaagaacgcctcaaaatcatcacagctcgtaataatgctgaagcagaaatgaagagaacaaaagcatatgttgaaaaaactgatgcatctgattccactcgattagactctgctaaggatgcagtacaaagcacaaccaccagatataaagaattggagaaattatctccagaagttgcaaaagatttaaaggttgaattagaccaattgcaaaagcttcttgattctaaaatatcagaacctgctccaactgccgaagctatacctgcagcagaacaacctgaggttaaacagtctgcttctattaaagccgccgcggatagtcgtgaagctgctcgtacacgtgaatctaatacacagtcgcaacctattcaggttaataccgctgtaaataagaatagcacatacgtttatagaacgcctccacagacttcgacagctgctcctggaatgcaaggcgctatgaaaacctcttaaggaaaaataatgatttttgaagaactggccgatggccttgaaaacatcaaaaaatcaggaactcgaatttcccaaggtaaatctaaactgacgaatgcgccaaccactaaggtggcgcagttcccagctgaacgttcagctgggaatgattccgcccaagatatgagagtacatgacttatatcgcaatgggttattattcacagcatatgattttaaaggaagaacaactcctgatttgcgttcatttagacgagatgtaatgttatcgtctgtattcgattcaccaatgtcagcattggctaattcatcaagctctaccactagtactgcaccagtagctaatattctattaccgcggtctaagtcagacgttgattcagttagccataaatttaatgatgttggggattctcttgttacgcgtggcggcggtactgctaccggtgtattaagcaacgtggcttctactgcggtgtttgggtcgatagagtctttaacgcagggattaatggccgataatggtgaacaaatttataacaccgctcgtagtatgtatgccggacctgacaatagaacgaaagtgtttacttgggatttaactcctaggtctgcagatgaccttatacaaattattcgcatctatgaaatttttaactactattcttacggtgtgacgggaaattcatcatacgcaaaagaagttaaagctgctattgatgaatggtataaaggaactcttaaatccgcagctccagatggggctaaagtagaaaacacagtgtttgagcaaataacatcgtttttaagcaatgttattgtagtttctaacccaacgatttggactgttcgtaattttggatattctacatcaatggatggtagagaggatatatttgggccatgccaaattcagagtatccgctttgataaaacgccgaacggacatttcaatggtttagcaattgctcctaaccttccaagcacgtttacgcttgaaattactatgcgtgaaatacttactcttaatagaggtaacgtttatatcggaggtattgaataatgtttactctcgaagaatttaagagtcaagctgctgatatcgatttccagagaactaatatgttctctgttgtattcgctactgtaccctctagtaaaacccaggctcttctaaacgactttggtggagagctgtataataatatgggtttagatggaaattggcttggattgacaccaggtgaattcaatcagggtataacaactatagtgacacaaggaactcggcaagttgttcgtaaatcaggtgtgaatacatttatgattggcgcaatgactcaacgtgtggtgcagtcattattaggagaatttacggtaggtacttatctgctcgatttctttaatatggcatttccaacagcaggattgatggtttattctgctaaaataccagagaacagattatcatatgaaatggataagttccataacgctcctaatataaaaatcacaggaagagatatggaaccgctggttctttcatttaggatggacccagaagcaagcaactaccgggcaatgcaagattgggtaaatgctgttgaagacccagtgactggtctgcgaggattgccacaagacgtagaatgtgatatccaagttaaccttcatgctagaaatggattacctcatactgtatgcttgttctcaggggctatgcctgtagcgtgtggagctcccgaatttacatatgatggagaaaacacgatagcagtgtttgatgtcacgtttgcatatcgtagcatgcaaacaggttcggttggaaaacaagctgctatggattggttggaagataaggctattcagaaaattgagacgattaatccaaatcagggcttgagtgcgtctgcttcaagattgtctcgtttaggcggggctggtggtggaatttctaatatcactactacaacaagtagaataatttaggggccgtaaggcccctttgttttatgcaatgcagccaataaaccctggctcagtgcgaagaagttccatttcgtctgtggtccaaactactttaacaggaatgataccttctgctttaccgtttagaaccgcttcgacaaacgatggttcagttggcttacggaagatatcttgaataagaaccgtcggagtaccttcgttaaacccttcaagcatgataagaacttcttcattgaacttctctgcatctttaacatcagcagaccattcaataccgttaaagcgaaatacgtgtttcatatcaatttcctcattggtttgtgtaagtctatagtatcacgtccttgtgataagtaaacaactttatgcaagtttttctgggataccatccaggttgatagcaccagccagtagctccatggtacgcgtgtagctaaccttatctgtagaacggtctggcgaaaagtaaatctcatttaaaaagcctttgaacttgctttcttcaagaggttccactttgccctgttccatcaagatgtcaccatcatagagatgaacggattcatcgatttgctctggaggaactaccgtcatttctaccatgaatgtcttgttattcgctacaccaactccatttctaaaaggagttccccataccttgttaactttcattgccaacccgcgaggaagaataacttcagcctcatcgctaaagcttgacaagacacccgggataactaccttaactttatcggccccatgaataacgaatccaaacttaaactcatcaccataggcaacttcctcgcctctatcaactctttccaagttgtctgttccaataacggaagatactgcatcaatagttgtttctttgttttctaaatcagaactaggtgcgtctggcattaatgaatcaccagcatttgaataagcaccaaagataattggacttaacgaagtagaaacatagttctggaaataaaacattttagactcaatgttatctttaaagtcttcatattttcctcgctgaccgcgatacaaaagagtgcctggttcaagacgcaaacctttttcaaaggcagaatcgagcggacgaattttcttgtcaataatcggatcgcctaagctttccataccaataagatagttattaacaaatgaataaccagaaccgcagtaatggtgtattgcatctctttcttcttcgcttaaacgagattgcatttcacggttatattcaattgctttggatatagaatcgccaacaattgacacataagcggatatcatataattgacaagattttggtattgacgtaaagctccgaaatcgtcagctggaggcatatcaaatccacgagtagctacttcaacgattttacgcattgtttccatagatgcaggatttttagcttgagcaataacgtcagcaacgtctgaaattcgttgttcagcgattttcattttgtctgaacccgaaggaatgaaaaccttccagtcgtcatgcattctagacatttggcctacaaataatctctcaactgcatcgccaaaattacttccatatccgccacgaacacgatagtgcttgatatcatcaacataaaaaggaattgatttttctaatccggctttgatatctttttggaggtctaccgtatcgccttctgcgtttagtactggagtgttagtagttaattcgtaccagcgttcacgtttattttctggccaatcttcatcaacatatgaaacaaatttgccgtactgtgctcggattaaatcttttcgagacactttcattttactcattacagcgagttcagatttcttgtcttctttttcgccaatggaattagccaatgcttcggctttggtaacgttttcgccggtttctttagacacataaacttcgcctactttggaatctactttggtgtaaagttcttctgaaatttcaggaattccttcaatctcttcaagtttcttacctttacgaaccataatagaataagcatacttacctttgtagtaagccatatctttcattagattgaaacgaccgccggtgcgagtagtaatcaaccgagcaagaatgcgttgaatagctttatcctgtccttgcattttcttcggattaaagcggaacattaccgcatcagctttaatttgcttaactactttgttgacggtctcaaaaatggtattgatagcaccaatcgggtcttggcctaaaccacctttaagcgcgccgatgttgcctttttccgacacagagaaaacatagacctggatgaatttatcacccatcttgatgttcttaactgcatcaccttgacctgacccttgtactaaccgaatcattaaattgttattacccggcaccttaatcaaaaagacctgtggtaccttaagttttggcttaacgttctcgacgggatagattttactattctcttcatcgaaaacttcatttaaaagttccatgacatatcctcgtttgtttattctatttatacgaaaaaaggcccgaaggccttaattaattattgttactgtacgccaaacttgtagtccatttacagactcatactcttcaatgttttctttgaagtttcttaatgtgttaatgttattaaactcaagaacttctgtgtgaacagaaataccaccacgtccgtcaagagatttagcaatcacttcgtataaaactttcattttattcctgttgcctcagtaaagttaacaccaaacgcggcttcgaatgtattagccacttctttatcatatctacgctgtttaatgataggtaagaataatcctactgtaccatcatcacgaccttcagcagttacccatccattgcattcaagttcccagatagttcccggaagagaatctctgagcttccataaatgagtacggtcaagttcatgtaattcttcgggcttatctttaagacctgacccagcgttaacacgaatacgaccacattctgatacgaacattaagccgcccattttaccaggttgttttctatgctcgtacgaaccgacacatttcaaatctacggtgataacctctttaaatttaacgaggttcttagaacgcttatcttcccaataagcaccgatattcttaaggataataccttcgagaccttggtctacgtatgtcttatagatagcccgagcttcatggatgttatgtacgacacggttttcaattagaataaccttgtcatagcctttgctcatcatttccaatgcacggaagcgtacatcataagcaaatccaggaactttaccttcggaatatactacatcaagcggaacataatcccaaacttggaatctcataccttccgcttcttcagcagagattgttcctttgattgctttattagccaatccgtttgattctgtacgagccgtctgttggaattccttagccttacttagctcaggaagctcaggctctttaaacatatcaaacaggtcgttttcttcttctttcacttcgacatgatataccaactcgccgtcaatcatcacaccattaggatggcgttctcgggcttctttggtcatctcgataagttgacgcttaagtttatctagacccaggtattcattaccggaacgagtaagaagagttacatcatctaaatcatctccgcggatttcagcgaagcaccgggctccatcggctttaagctgagcgaatgcaggaaatttaatatatgatagcgctttctcagaataagctgatgctaacatctgtggcatctcaggaattaatttcttccataccttgttagcaatagaacctgaagcgccgcaacgcatatccttaagaaggacacggaccagtacactagcatcaccctcgttcatcttagagagcaaatctactagcccctggattgccatattaccagtaagtactcgtgctgccagaatgtcttggaggtaatctagaccatcagaaaacgtctttgaaggaacatttggatatttaacgggagtatattctggaactttcttaataaagaatttaaatcgcccggaatacgccagcagataagctcgttttaaatcaacgttatctttattgtcaataagaatttgggttttagctttagaacccttagcatcttcaattgctttgatgatatcaaaaatcattattcacctaattcttctgaaagttcgcttacgctacgatgataagttaatccatcgatataaacaaacccgttattgatgcattcattccaaatcgggcacgcctttgcttcacgccaaattggattccaacgataaaactgattaacatgaccgtaatcacatgataaccaacgtttacccaccttagtatgaactacaaacattattcctccttgggtatggtcattataccatacccagattgttagcaattaatttggtggttatcacatgtaatacgaccgttattccaccagtcgtttccaggaggaacatgcggaccaggactaaacggaatgataggttgtttccaccaatctcctggaacttgtcgtggaggccaattaaaaggatgttgctctttacgaatttggtctttgatagcttcttcccacaatccagaaagagacttctgcggtttcttaacggatttcagagattccaggcaagttacaatttgatgccaatcttcaaccataattccaggagcagtcactgaaccttctcgctcaccacgaggcatataaaacacacgagtttcagtgtcttcaaatactttgctggccgcagcaatatgtttaggcaaatcatctacatagcagacgatgcgatcgccgtattttactttagccttttccagtaaagcatctttagattcatcataatcgcagaccatgatttctgtaaatgcatcagggaacaaagcatttagattgaaacgacgattaaggttagcatctactgagttaccaagagccgtgatagcgacaaaatcgtatttttctttgagcttattaactgtagctaaagcatcagcatacggagcaagataacgaataaaatcgctgttgttgtacttcagaagcagcttaacagccagttcttcttcacaatcaaacagctcagcgggtttaatgaatttttcagtagtcatcatatcaaggatatgctctaccggaagattatatttttgggcaaaataaggcagaccactttgccacttaacgatgattccatcaacatcggttgcgattactggctttgacattcggggaaattcctcaatgcttgtttaaatttggcaacgctatttgcggcaccggtgaaattgaaccagattaaccctggagcgtccgcgggttctatatcaattatttctatattataatactcagcagtctttagcatttccctggtgatacgtcgggcaaccatatgaccgaagtgaggattaatagacatcgtcgttagcagcccttaattgagtaattggataaagctcggattctgcatggattgaacgattgccatcaacccaattaacttcataccacggttcaactgagtaggctttaatggctggagccgtatcacatacaactccaggaattccatttgctaatcttactgtactgaagatatgatatttcatgcatcaagtctcactgcccattcaggcaattcaaagaaatccggagcatcaatttcatactcaacggtgtgttgtttaacgttagctgacatgatatcaaccattgggtggtttttcaaactgcaagaaaaaataccagctttaggtttaggcacggatacaatcatgttgatttcctcaaaatttagttatgaatttttctttcggcattttagcatttgagccatcactgtcagaatacccaattggcatagttgcattaatgaattcaattttagcatttataacattaatgctcagagaatctacaccgtcaatcatacgaaattcaggagggcaatacttatcaatgtatgctttcacaccatttttattagcaggtgtaccatcgcgggtatcgctgataatggtttcaacttttttctttcgtgaatcatagaaagctgatacaatcatttcaatttcctcttaaaacgggcgaatattaacgtgaaccacagggacagcaaaaggttgcatgattacaacttttgtgtctttagttgcattcaggcgttgtacttttgcaagattaacagcttcttcctttgtcaatccacctttgtaggtatcatttcctttatttgaggtccaaacaccccaatcattgcttccatcgtcggtcttcggttcaagttctttgtagatggtttcttcaaaataatgctgaaattcttgattagtaataatacaccacatgtgagaaaagcgaacttcatctacactaacgcgtttgcattctccatctggcttaatgatttcaaattcaactaatccggtattttccgcatatttaaaggttctggtaattttaattggattattaccgatttgctcaaaaacacccttgataagagcgcctggagacaagcttggagtctttttaagcttatagaatttacctttttccattatcatttcctcaatagtggggccgaagccccgagttagttaaaacttgatttcgtttgaaacgatatcccagattgcttcacgttgttcttcggttgttttacgaccgaggatgtggcgcagataaattttaacaagcagctgacgatttgtgttccaagacggatgtgaagataaatcacgtttacgaacttcatcatgaaatccaactttgatttcagaaccgttgaactgaatatccagagtaggaccattttcaaagctaaagaatacgtagttatcttcccagtacatatcgatttgagctactgtgccgttgttgtgttcccacagcaaagtagtagaaacgtcccaagcattgttctgtacgtatttgcggttgaagttagtgaagttcatttttattctccgtagtttgtttatctgtttgggtggtacaggtctatagtaacccagaccacccaagaagtaaacaacttttattcaaaaacttcagacatttttcacctctacagtttttacagtttttacttctgcaaatccgatgcttttaaacagttcatacttggtagtttctggaacgatatcggttagctcaaggatgatttcttttgcttcttccagagtaaagatgcttcttccgtccttaacgaccggtgctggtttaatagcagctgatacttcaaaaaccacgtagcggtcagtagtactttgattttcaaacgctcctatttgcacaacccgtccttcttctaactcgtgagaagaaaataagcatgacagagaccggtcatattcatctcctatggtttttgccgaaatgattttaccagtttcggttttaatcttaacaacccggcccagcgaatcaagttctaatggcgtccagccttgaactccaacaacggtggcaatgagatagttaattgtgttcttagcgtctttccatctacggtaagtttctggggaaatgcaatatactcggtttttgctgtaattcattttgatatcctcaaagatggggccgaagccccagtcaagattactgtttagtccaattatccatgtttaatttaccaacctttttcatttgttcaattaaagcatcggcacgattacgaccattttcataccaggttacatcttctgagtaaccgtcttcttcatctgtgtaggtttcagaacgaatacgaccaacaactggagtgttcagaacatatacagaacccgtgaaccagtttgttaaagtgatatgccagcagaaatcatctgatggaccgtccggtgtcatgcatggaacgatatcaccttgaactttagacaaaatccacattttctcatggacagtttgagctttgtaaccgtcatggtctttagtcttgatagttgcgttcaggttgatggtattcattttattctccgttgtccgtttgggtggtacaggtctatagtaaccttgttgaacttagaagtaaacaacttttttcattctgcggaaaataaaaaagggactcccgaaggagtccctgaacttatgctttcggcttaccaaaacgagaagcatcatcgcgaagaaccgcacgagcccgacgcatgattttctcaaccgtctgattgatacgcttgttcgacccacgcttgtagccagcgcgtttagaggtaccaacaacttcttttactgcagtttttgctttagcttgtttagccattttatcatcttccattttggagaaatacatgggagcacgttcttccgaggttcaacttctttcgacagttctttcggttgtagctcccgcaagccctcaagggggtacgtttaaactcttatctgttgcacaccgttagcttaaaggttccgggtccgatttatcggggataagatatacaccgatggatgtataggccttgaggcgtactcccgattggccatcgcctcggggtagcatgcacttgccgtttattttctagctgcactttggtagcaaatcaccgttggtttcgggtgttttacgtggggataaccaacaacgtccacatcatacgttacccatgcgtacacatggtgggcgtacaaattacttcagcgttaccacaaagtggcgaacagctttgcgagcagcagaaccaagatgcttagcatacttcagttcgtccatcgcttctaaagtatcacgaaattcagcttgtgctgggttcaggtgtttaaaccctttcagaacttccagtgcttctgcatagatatcgattgaagcaccgtagttttcgtgaccggaattccatgcattacgttggagttccagagctttagtaagttgtttgttcattgaatcgttcctcaaatgaggttaaaatttggtggacggtaaccgaggtttagctcgggcatccaccgcgtagaattgctcgggtaactaattgtccgacgcccaattcatattattatttatatacgcatgcaagggacttataatgacaagtcacaaacttctgccgaatttctttgggtttcttcacacctgctgctactaacggatgaggtacgtttctgatattaccaacaggcagtggagtcaaatcaccgacttcaacaaatcctttcggtacatcatcaccgatagaatagatttcacacatatccggcagttgtccttgttcttcttttccaagaataataccggaaggagaaacaatttcatcaccttgctgagcaggttcagatacgagaattacatactcgcctagagctttaattggaagttccatgtgttacctttattgtttgaccatgtagttatattaacatggtcagtttaaagcaaattacttaccgatcatctgcagcagatgctcaactttcataccatttaccgagataagtttatcaaaggtaaatgagcgccaaccttctttctcagtatcatataccggaagtgaagtagtgctttctgctcgggcagatttaatagtgctttctaccaaatcagatggaataatatctttatcacgagtacagcgcagagtacgaatagtgccatcagctttttcaaacacaatctgggattcgcccatgctcagcacagccttcagagtttcacgaatatggatgttttgttcagtagtcagtttcattttgatgtctctttaatagttttgataattacagatttgcgcttggataattcttttaataatcgaactgcttgatcttcaaatttaaatgttgctaatggtttccatttaaaccaataccggcgttctactgagtatgatataacaacatcaccacttaggttaagtttattaatttcaacaattctaagtttcattattcaattccacagaattctttaatgttataccaattcaacttatccaaattacgttttggaacattgaacacctcgattccagcagaacgaagaatatcgtcccaaccgggttcgttcttgtcgtatgtttcgcagtatactaattttttaataccagactgagcgatggcttttgcacaatctggacatggagacagtgtgacatacattgttgctccatcaatactactgccgttccgggcagcaaaaagaatagcattaagctcagcatggatttcattgactttagaccatgcagagtgggctgctcgatgttctttgagcaatccgacttttttgacttggaatccgtcttgacgcaatcctgtagatttgtaaggaatttcaccaatccaaccttgttctgctgcatggtcacaacagttcacaccaccagaaggtgaaccgttatagccagtagaaataattcgtccgttcttttcaattactgcgccgactttccacgagcagcattttgactcttgagatacgagatacgcaatttgtagtaccgtcgacgctttcatttaaatcaccagataagttgtgttatttgttttaaccaattttaactcgtcagtaggagaagcaaaactctctactcgagaagtacgaatgcctgtaccatctggaaacggatgattccctcgttcaagaacatcggaaaagacataaccataaagaggttggccttccttaacattaacgttactgtacaaaatagcatcatattcttcgcgtggaattgaccaaacaccttggtcagaaccaataacagcactgatcagccgaatgccatttgggctgatttctgctttaatgccacgagcatgttcaattaaaagagcttctaccgcttcacgtaaagtcattagatatgtcctaaaatgttagtcatttcaacttggcctgttccggttaaagccaattgagtgtgttgattgctctttccattattaactgtaatgatataagcatcaacatagttaaaggatgactctcgtcggagagtcactttacttccaggaacccggtttgctacttcctgtgcgaagattttaaccttcgaaataaattcatcatgcgaaaatttagcgtcagacaacataagtctcaacctgttgggtttcaaaattagcaataattccaacgataaaccagtcgtgttcaccttcgccgcaagaaattttaatttcagacgaaccgcctgaccggtcaatagaaaatttaataacttcgccgtttggaataagtgcattcattgcagataaaaactctgcatgcattttggctacttcagatggagtaaactcatctgttaaatgattagcaacaacttgcgtaaatgatacttttactacttcggaatactttggaaacattatactttcctctaaaaatcaccgtgggctacttgccagcattcaacaccgatacgacgccacatttcaactacctgcgccctgtcatctactgcaagtttgacattataacgatcagcaattcggtcccagaagatttcttcttttaccacatcgtctttgcgtgaatcgccttgcttacgttggaagtgttcgcctgtttcgccaacatggtccaacaaccatttcttcgtaatgcgttgataaacagtagggtcttctttagtaccagactctctgccggaaacagtaagaattttatatcctttgttacgaagcattttaagaaattcaattaccatttcctttggatggtctttaccacatttggccaagtcataaggagaacgatgattgttatctgctaacgtgccatcaaggtcaaagataactgcttttggcaatgattcatctggaatgtacaaatcatacggatgcatcttagagtagaagctacggagcacttcaataggaactgcattcgcgccacgatagaggttacgcttaactagttcagtccaaggaacgtcaaagcgtttaatttcccacttgacaccatcaatttcatatgccaactcttgccacttcttgatagtcgttggattaaggttagtatcagcaatgatgacacctttagtggtttccatctcgagtagagtcttcgccatagaaaactggcatacagatacagacttctcacgaagcttagaatatttgtaatcattacgtttatcaaggccaaagatgccttcacgcaaatcatcacgagacaaaacataccaaccgggattagctgctacgtattcgttagcccaggttgttttaccagagcctggagccccttgtgtcaaaaccaattttttcattatacatccttaagagtgtcaataaaatcatgaagagccttagacttttcaccccaatttgcacgatatttttctttaattgctcgcaatggcttattcattgacagtatatcatttttgtcataattttcagctgcgcgtccaaacacgatgcacgccaattcattttcagcaattaaccctttaagtgtttcatactgttctcggttcattataataccatcacttaacgcaacgaggttctttaaggtcagaacgataataacatatcattccgttagcatctttagtataacgtaaaatgtcattcatccagatgcgatactcttgagactcttcaaacggcataccaacccaggctttaccgtcaattacttttacttcccaatgtccttcccatttttgaattgggtctggccactcaggatgcaaaaccgggacatccggtgcactagaagaacatccaacaagtaggctgataatacccatggctaatagacttcgtttcatctggtagcctcctggatatcttctgcaaacttattgaagcttgcattaatctgtttttcaactaacccaggtttagctgcaactacgtttccacgcttagcatctttattcattttagcgttggaagtatcacgagctgctcggttttcctgatagcctttataggttgtctgcagattttttatagaaacaccgatattttctatttcttttgcttgtcgatcagattcatcttggacgactttgaggtcagctttaagattttctacccgccacgaaagatatttcaatccaccgacggataatgctaacacaccaatcatcaaccaagttgtgtttattttgagcatagtttaaggataacctctacgatatcatcacgggataatcccgaaatgaggatgtgacgatcagaactttccgaaggagaacacttgaagcaagcttctacatattctgccatctcagaataattcagctcgcgatgcataatgccaagacgatgtttgccataaatcgggtcaacgattacatagcatttgcatccgttggcatgaacgtttggttgagtgatgtttttaaacacctctgcaccatacttcgcgagatgattatctaggaaatcaatcatttcatctacggcttcaggcaaggcttcggcacgctgctcgttcacacgattagtgtactctttttgcttcttacgagcagcttccttgcgtgccatatgcgttcgtaggtcagtgacgaatcccactttcttggtgccattccacacaaaatcccgtcagaatgagtaccatatttgttaacaaccatatctaaagtaattgcttgcatatccatttcattatcctcatcagttggtgtaagtctatagtatcacaccttgatgaggatgtaaacaactattcttcagaaatttcaatttctttttcgtactcttttggaacatatccagcccagtacttcaagaacactttttcgaggtctttaagcagtttatcaacatctacagttccttcgtacatgttcatgataacaccaaaaagatgacgctgattaaccgtggctttctgcgcagcaatagcgtagtctttacgagcacgacctctgtattcatcatagaatgactgacatagctcaagtgactttccgaggtaatctagataagcttgctcaaacgcagaaattttcttaattgcgtattcatctccagcaaaaagagaacgcaaatcatcggaatttgcagatacgacagacgcaaacagtctttcatttgacgttattgagtctttagtgtgatgaagagccgagtaccattcggttttaaccttaaatctctgcccagtgtttagaactgcaatgtatccttctacgccttcaagtgcacgaacaccttcaacccaagtgtcggggtcagaaattccataagcattaattaaataaggacgaattttagcattagcgtacaaatcgtcatatttaacatactcgccggttgcgttatcacggacgtttaacacaaacagctgtggctcctggtatgcaagaacaacacgattatcaggtgaaacaaattccatgtttacagtatatccatctagtgctagttcaagaacaacttgatgaagcgaagagtattcttcactattaagcagggcagaagaccttctcgcctggtcactgtagagagatgtttttgacttaaggtatagatacccatcatcaacataagatgatactagagagccatcagccttatccataatgtattctacatcgctaatatcaattcccatcgttaatgggttttcattcaaattaaagaatttttccattggacgagaagcaattcgaattggagtatcaccatccatttcaaacatgatgccccggcactcaagagcatctggttttaaccactcgctgtagcttgcatagtgatatgaaaacactctgaacttaccatccataggaccggtaaaatctttataaaagaattttgcaacttctgagctttcacacagattcattaaatttttatatagctctaacatttctttaccttatgtttgcaattatcgtagtgccatctgatagcaatggcctttgaagttattataccacaatgcgggcatggactgtacaaaggctttttctttcctttttggctttctgaccgcttgagtttagtttcttcagattgtgttttaccggttaaagattttgatatcttttcgcgtgtttctttggcatgagtctttccttgagtgggacttactctgcctttcagtgctttagataaattctttctatgttcttccgttcgtttctttccggagaataagttagatgtataattagaatgctttattctagagctttcataaaatctggaatgaactttaaaattctttccagaagaattacacatcatccaaagagcataattcattttagaattattatgtatctttgataatagcaaatgggcaatgaaatgttcacgtccagtcaataaaactaaattagaaacatcgtcatttcctcctaatgattttggaatgatatgatgagcttcagtataatagtttaattttcctttatcattgcctcgtaatttaccctttgctattaggttatcatatactttaacatagttcatttagctttgttagtatgttgtgtgttccatggaggattgaacttcttaatcagaagaggttcttccaagtccatagtggatattgacatctcgccaagttcattattaatcgaaagattaaaacactgacgagcatagaactctacttttttgccagccattagtgcttcaaaaatcttggcagatttagctgaatcagaggtttggtctttccgattaatagcagttctataataatttatacgtttacgaagattttttgtcttaccaatgtaaaccagctcatcatcaactgcgatggcataaactacgttcaacttgtttgctatcagaattggtttgatggtaaaatctggttctaactcaagttgaacatattttataaaagaaaactcgttagcaatatcattcataataaagaggggccgaagcccctttccttataagtactttttaaatccaattagaacatcatcagtgacatcattgtcaatctgagctaccagataagaacttatctcaacttcctgaggagcagattggactgcatcagagttaagatattcacgaatccagggaataggatgtcgagttggtgcgtcagtgattgggcacggcagaccacagctacgcatgcgagatactgttaagtagtcaatgaagtcatgaagaattttaacgttcagacccggaagaccaccattacggaaaagatggatagcccaatctttttcttggcggttaacttccatgaagattttaattgcttcttgttcacactctttagcaatctcaacccattcttcgccatcagtgccagtttgaagttgacgcagaatgtactgtgtgcccttcagatgaagttgttcatcacgagcaatgaacttcatgattttagcattaccttccatgatttccatatttttatggaagttgaaggtacacgcaaaactaacatagaaacgaatagcttctaatgcgttaataacatgtaagcaaagataaagagatttcattaaatcgcgtttagcttctttaatttcgatattatcttgattaaagcagcgatttttggcattttcccatgcgcgagtcttcgctataacatcatcatagtaaacaccaattgactcagcgcgtttcatgattgcttcgtcaagaacgatttcatcaaagattttagctgggtctacataaaggttacgcatgatatgcgtgtacgaacggctgtgaatggtttcactgaacgtccaagtctggttccaagtatctaggcttgggtcagaaataagtgcagataaaactgctgctggagctcgtccttgaattgaatcaagaagagattggtacttcaagttatcagtgaagatattacgctgatgttctgggagtttttcaaactgaccacggtccatcataacgttaacttcttcaggacgccaaaagaaactcaattgcttctcaatgagttcctcgaatactttatgacgctgaatatcatagcgtgcaattcctagaccagaaccaaagaacatcggttcggtcatgatatctacttgcttggtattaaaaactgtactcattctatttcctattctgtggtgttaaccatccgtggtctaattataattcccttttattaaagcttacaggccgcgcagtcagcagagtcttgaatcatatcatcgttaccggaaccgtcacgggtgttatgatagtaaagagtcttaccgccaaagtaccagaaataaagcaagtcgtccatcattaccgacatttcaacttttcctttagggaaattcgccgggtcgtaataagtattagcagagatgctttggtctacaaatttctgcataatcagaacctggttcagataaggcttattaccctgtttcgcgagctgccaggcataatcataaagggaagcattgtgctcaacatttggaacgacttggttgaagcttccttcttttgattctttaactgacactggtccacgtggtggttcaataccgttggtagagtttgatacctggctagacgattcgcatggcataagcgcagataacgttgaatttcggataccgtatcgcttgagatcttctcgcaggagttcccagtcacagacatagtttggagctgcgagttggtcaattctttcgttgtaccagtcaataggcagttcaccacgtccgtatcgtgtttctttgtaaagcgtgcatggacctttttcgctagcaagtttaacagaggctttgatgagtgcatattgaatacgttccatcatttcgtgagtaatatcattagcatctgcgtatgaagcaaagttgcttgctaaccaagctgcatagttagtaatgccaacacctagtgctcgacggtctttagcttttaacgctttgtctacaggatagtcttggtaatccaaaaggttatccaaagcccttaccattacttctgcgatttcgttgacttcttcttggtcttgccagttgaagttgtcgagtacgaatgctgcgagtgtgcatagcgcgatttcgccatcttcttggccaacatccgaagttggtaacgcaatttcgaggcagaggtttgattgcttaaccgtagccacatcacgaataaaaggaccatattcaccaacgttatctaccatgtacgggtaaattcgagcagtaccagcacgttcagtaaggaacaactcaaacagttcacgagctttaatacgtttctttcttacgtctgggttcttttccagctcttcgtataaagtacggaacgcttgtgcatcacggaagtattctgtgtacagcgtgccaagacatacatcgggactgaacaatgtgatgtaatcattcttaatcaaacgttcaatcatcaggttattaatctgaacaccataatctaaatgacgaatacggttttcatctacacctttgttgttcttaagtacgaggaggttttcaacttccaagtgccagattggatagtacagtgtcgccgcgccaccacggactccaccttgggagcaggatttaactgctgtttggaagtgcttccagaaaggaataactccagtatgtttgacttcaccgaatccaatttttgaaccctctgcgcgaatcatgcctgcattaataccaatacctgcacgcttactgatgtatttcgtaattgatgcagcagcttcgttaattgaattaagactatcaccaccttcaataaccacgcatgaactaaactgacgtgtcggagtacgaacaccagacataattggcgttggcaatgaaatctttttagtagaaactgcatcatagaaacgaataacgtttgctaaacgattttcgccatcatcttggtgcaagcacataccgatcaacataaaggcaaactgtggagtttcatacaattcaccagtgtgacggtcttttacgagatacttctcgataagctgcattgttccagcataagtcatagtgaaatcacgctcatgcttaatataagaatcaagcaaagtaatttcttctgctgaccatttacttagaatttctttatcgtacttatttgcgttgacgcatcgggaaatgtggtcaataaatgcaggtggctcaaactgtccataaacacgcttacggatttcaaacatagctgcattagacgccacatattggtaatccggttcatcaatagaaatgctattcgccgctaccttaacgatagtcttttggatatctgcagtgctcatgccatcacgtagatgggatttaataatttcatataactcgtatgggtctactttggttccttcgcacgcccattcgaggactttaatgattttctgcatgtcaaattcttgactaacacctgagctcttaattacttgcataagtcctctaattcaaatgtatctttaaaaagtttattcactacaagagctattatatcaccatggcaagaaagcggtttgcaggtgcatcctaatctcattcctcttaaagtttctaagtgctctcgctttatttctccgttccgaatcttagcaataaaatcgtccttaaatgccgcaatagcatcaggacgattatcgcaatctttaccgacgtaatttccccacattgttccacgttggatatttacatcgaagtcggaatggtatttattaaccacccgacatatcttcatgttatatcaacttcaaaccagcagattaattgtgttttgccaatagaccattcatatgatttaatgacagataaaacgcgttgttcgatcccgtcaaaaactatcttgtcattaacttcaggcaaatcactagagaatgcatcacacatctcgcctaatattgtttgtcctttacgaacaaatcgaatattcatatagccattttccccttaattgttggatgggatttatatccttcaagaacaaagtcagatggtttcatcattcctgtaacccaagctaattgttcttctgttgctaattcatgaaattctttatcttttactggaggccaataattaatttcaagttcacacagctcttttggcctctcactgttcaatatggttcagataaatgtgagtgttaccaccagtgaataccaaatgcccaggtttaagattggtcattttagcaatgatatgaaccaatgctgcatatgacgcaatattgaaggggaggccaaggaatacatctacagaacgttgataccactggaggtccaaatatcctttacgaacgttgaactgataaagcagatggcacggtggtaatgccattttgtccaaatcaaccgggttccaagcggtcacaatctggcgacggtcagttggcaattgcttgatacggtcaatgaccaattttagttggtcaacgcccatgaaatcacgccactgctttccatacacgggtcctaactcaccaccagaataccccatgtcttttgcctggttttcataattgtcgtcccagacagttttaccttctagtaatgaaccatgctgaataagacgcaattcatgaacattagtagacccctgcaagaaccaaagaagctctgcaatacatgctttccatgcaagacgcttagtagttacagcaggaaaccctttttgtaaatcaaaacgtaactgagtaccaaacttcgcaatagtgccggtaccagttcggtcatccgtctcataaccgttttcaaaaatgtctttaattaattcttggtattcacgcattaaatttttcctgaagaggagtaaagaaaagctgatcaccacgcttttcaaatcgcccaataatagacactacatcatctttgaccatcacattgccatgtgacattccgatgaacatcttcttataatcacgttcaatttcaataggtatatttccatttcggttatatactgtagttgaaccgttataagtgctaagaccattataactgaaaactagaagatgaataccatgcttaaatggaaatcttttccacctcttttggactttgtcttctgatagctgagtgatatcatagtttgcgctcatagaccacctctgaaatgttagtcacttcatcaatatgataccagtgattttctttagtaatgaatcctgattctggccaagtaggagctgctacaaattcagcaggtagagtgacatcagaattcactctatgactttttctgatggttgtttggataaccctatctgcatatggatatgccttctggatgattccggcaccacctatgatagaataattaaggtctctattaaaagtgatagtactgttgtaagaagtatgagcggccataatgtcaccacccaagaaaccgataaattctaattcacttacataagcatctgcaaagaagccatttttagcagttgccaacgcacgactcatgtcttggacaacgattgtcttacgaccaggaagaggtttaggaaaactcataaaagtctttgctccgcaaatcaagatagtatctcgagtacgattagcaaagtttttcatgtcctgggaaatatgtttccatggaagaccatcgcctaaaccgaaagcattttcgtttttgccgtctacggtttttgtaggagcaaatgcataaactatttgaatcatttaaacctcagcaaaattcaactcgttcaacattaccatcttcccacttctgttgaagctcttggagacgtttgatagcgctatcgatattggacattgcacagatagttacccattcacggccatcccaccaaatcaaatcatcgtaatcatctactgcgaaattttccattaaccttgcctcattccacacttaaaacaccggccacctaattgccataggctaccgccgcagtacttacaatcccagtcagttaaaatccacatgacttgtacccactagctttaatcatgttctgaagagttttaaacccttctttaatggcttctgaaatttcctcaaatacttcctttttaagaatatacaacgaacccgcttgattgccagaaagagctgaaatcacaacttggtcattaattaaaaattcgccatatgctgaatcaattttacctgaaacctgattgcctcgggaatgagggtcaaatacgagctcaatatgagttactccaggaatttcatcaaattggcagcgaatgttaacacgcggatatcccgttacactaaatttagacatataaaaataatcctaatataatgccgctaataaaagcggcagtaacagaaattagcaaaactactaattcagcctcaatcatttcttggccttagcaagtttaaatgcttttttgaattcttcaacatcttcaacaggaatccaaaagcctgagccatacccatcttcatagcatgggcagttatcacagtaatcattccaatagacagtttcaccacccatagtgaatggagcttccatttggcacagtacttcttcaacacgctctaattcttctgggtttttatcgcaaatgcagaaattccatttaccacgatattcagaaccaagtttgatgctttgacgttgaagtttcatttttattctccagtagattatggagctatactatcacaagcatagctccttgtaaactactttttgaaaacttttttgatcaagtcaatcatttcttctgcattttctggggtaacgatcaagtccaagcgagtaggaccaggttggattgcactaccattttcatataccggttcgaagtatttgaattcataatcagagatttcaaagtatgcgtctccaaatccttcagcgtcagcagttgttccatctttaaattttacttctgtgatgaaactattatcttcgtcgagcattttagtaggaaagaacgaaccaccatgctcttcaatcatcaagcgcatccggcgatttccgctagatgaaaggtcccactcggcagcaagacttgggataatgcgatattctgtgttcagtttcataatttacccgctaaaagtcgttaatgtatcttcacggcattcatcatccatgccaggaaaatattcttgttcaagccataaccatagtgtaggagtatcaccttctaccgtgatttcgtttcctccccatggggcagatttgttactaacttcaatcaaaccgtatttttcaatggtttcaatgaagtgttcataatcatatatttctacagtaacctgtgccattatcatttcctcaaagtggggaccgaagtcccccaaaggtaattattcttgccagtcttccatcatccaatcgatatcgtcccattcgttggcttctaaccaagcacgaaccgcttctttagaaccacggaggtcaatatttggccaaccgccaccagggccttctttaataactaaatcaaaatcaataccatggtcagtgtcataaaaacgtgaaccatcttcaaaaatcaaatcagtacaaaatcctgatttattgatgtaaggttctgccacgatatcaatgtttaatttacccatgatgttttcctctactcgttttgtttcgatgtagatatagtatcactcatcaactggcttgtaaacaactttgtgaaaatatttttgtagggataaagaaaaagggacccgaaggtccctttatattagaggtcgttcaaaatatcattcagatcgtcatcgccaacactgtcaccagcatcgcccattatatcgtctgcggaacgagaagaggtcggtttggattcaaaatcagacaggtctttgtcaaaggaatccaggtcatcaccaattttatcggcttgagctgctgcttttgccgcggcaccaccaagagctgctgtacccataatctgtttaaatttggcttcgttaacttcaaacgatttaaactgagatggagcaacaatttcgctgaggtcagccatattttcggtcaggaatttctgagtttcttcatcattgatgtttgcaatctcggactgaccaaggaatttacattcatcatagttctggaaaccaccgactttcttaactttcatgacgaagtttgcaccttcatacacacaagttacatcaaccggagtttcacccatatcaacatcgacttcaaccatcgcgttgattttgtccataattttctgaccgaaacggaatttgaatactttaccttcgttttctgggttagccgggtctttaataaccaggatgttagaccagaaagaagttttacgtttcagaagcttatattcagctgggttgctgttataagaatcgtttttactcagatgagcacaaaccgggcaagaatcaaaatcgccgtgggtagaagtacaattttcaatgtaccatttaccgccgtgtttgaaaccgtgattgatcagttttacaaacggcagagagttttcatctttaccaggcaggaagcgaattactgcttgaccattaccagcattatcggtcttcagtttccattcgtttttatcttcattagagaaagaagaaccacctttcagaccggccagttgctgttgaagttgagcaggattttttcttttgaacatgatttattttaccttgattttatttagacagttatttgtgtgacgcgctattgcatttacagaaatacttttcccgcacactggacagttttttctgggcattgttttacctttcatgccgcaaggatgaggttgtgtttgatgtcgtttcttagcaccatcactccaagtttttagaacttgtttacctcttgtattatttattctatcaccattttcataatagcgatgcaatccatttgaaattaatttcttatgctcttctgtctttggaacatctgttaagagttctgatattcttttacaatgatgttcagaatttttctttccaaatctaggagcattttcaccagaaccaccaaatttaccggaagcagtagataaattataaaatagttctgatttagcaacatcataatgtttatgataaaattcttcttcgtcaagagcgttatcacatacatgtagtattttaacatcgggtttttgaagcgaaattgcgttcaaaaatctttcttgttcacatgacgaccaatactcaatatttctgttgtcaaaaataacaccattgacaaaggtgcaatcatgttttgacccaatataatagtaaggtggagttttattctttaccctatcagtaaaggtaaaccaatatacgatattcattggataattatatactaatttctttacaagatttgattatgctaataaagagtttcttagcttcagcaccgtcaacgtttaaaagttttttataagcttttaatttagtagagtaattactccaaactaagttatccgttgcagtatcatgtgtatttattatatctaaaaacgagtcaagcatgatgaatgtctcgaaagatataacgtttgactgcagaagtttgaacacataagatgttccgactttctcattatattcaaaaatatcatgaagcttatctacattaactttcttggcaaaatagtaaatgttctttacatcttccgagaacgttgttttaatctgcttcaacttacctatatattcacgataaaacacaagggcatcagcatcactgatatcgccaatccaagcatcttggttagctacgaggttactcatgaatatcagtgttaactcttttaatgtatatttctcagcgagtttctcaaagaaatatttgtctctacgcttttgataagctttatcagagacccgcataacccagttatacttaacaacgtcatatcgaccggcaaagtgttgtttgagcattaaatataaaagataaacgctcttaccgttaacgtatctgttattatttccaggcatgcggagacgaatcataataaaaagtccagactattcgttttgtgtgtttgactaaatgatggacgaagcatattttcttccaatgcttctgacataattttttctatgattgctggaggaatatatctattgaagtttccctcaggaatagaattttcttctaaccactgagttgttgcttcaagataccccattccaagttctgttaccatagactcaatagtaaatccgttagcttgcttatctaacagctgattaatggattcagagggggaggtatccccctcgtctttaagcgaaaatagagtcataagcttctaccacttcatctttttcagtttcaaaacgatcgcgtgtgcctttatggaacagagcaagcagttgattaaacagtttgccttctacgccaagttctttcttggcgcggtctttaatgtctttgttaagttcaagatagctttctgctttcaacttattacctgaggcttctttaatcatatctcgcagagcctgtccatgtaccgcttcatcaaatactacttgctctttttctttcttagccattatattcaccttaaaagttgttaatttctttcattaatttagacagaccggatttaacaaagtagctataaattttgccacgacccggtaattgatagttattataacaatctaaaatgttagcaacaatgtcttcgcggatgtaatcaaaatcgattaacacgcggttttccaagaaacgcttatactgttcttcagtaagcaaatctttaatgttttcgccagcatcaagacactcttcaacaaacgtcattttcgttgaaggagtacgctcaccatcaacatgagtgtaccaaaaatctgaacgaactttaatagaagcgacgttatctttcttgtcacctttaataattttaaccatacaatctaaagcaggagaaccggttttagattttaccagtttcttctgcattggtgaccattgcttaacattaggatacttatgcaattgagtaaagtcaccatccgaagaaacaatcatgactggatggccttcgagactgaactttttggttaataccgcaatgctgtcatcagcttcagctttatcaatatcaatgacataataaggcatatactgcttaaattcatcaattacagtacgaagaccttcaaagtatccatcccagtcccaattggattcttcacgggctttagcacggttctttttatagtaatatgctacgtcccgacgccaatacccattaactgcgttatcaacgcagatgacaattttagtgtatccatctttcttccacttaaaagcattaaattttaaagtagaaagaataagatgacgaaccataggagtggttagtttgtcaccttctttatacgtatgaagaattgtcgccattgcaatttgtgacaagtcaattaaaatgacgccctcttttacctggtcttcttcagcgaataagcaatttaaatcagacatttgaacctcgttcaattagttagtacagccattataaatacttctataatgaagcataaccccataggagactctatgagcgatttactgaaacaacatttccgtgcaacaaacggcttggacgcaggcggaaataaagttataaatgtggcactagctgaccgcaacgttaaaaccgacggcgtctccgtcgagtacgttattcaagaaaacactatccaaaaatatgacccgacacgtgggtatctcactgattttgctgtgacttatggacgtcgtatctggattgcaaataaagatattccaaagcctgctggagattttaaccaggcgaattggacttctttacgtgttgacccgaactggatttataccgtccgtaaaggagagtttgaaattcaatctggtcagttcatcaacgttgactctaacgctgcaggtaatgctacattactgcttccgttagcaccagatgaaggtgataccatcgtagttcgtgatattggcgggcgtcctggctataacggaatcttaattaaagcacaagatactggtgcgtctatcgtatttggtgaatcgcgtctgcgtgaggtaagacttacacgtccgtattcacaaattatgcttacgtttagtaatggtgcatggcgtgcaagtttaaccgattttggcgatactgccaagatggtagttccgaacgggattgttccgacgcaagttcaggcaggtgataacgtagttcgtcgttatacttccaactcagagattttcattactctgccgttgttcgctaattcaaacgatatcatcaattttactgaccttgacggtacatcgccaattaaccatatgactgtgcgtacgtttgacccaactatctcaattgggactcctggacaaacagaggttcaagtacgtacttcaggtaatgggtttttggtatatgactcgattgacaaaatctggcgtatttttgaaaatgatttacgcacccgagtaagaataattacttctgatgttactttaatgcctaatgagcatatttctgtatttggcgcagataacaatactgttaaaacaattaacgttactttgcctacagacgtagctgttggtgatactgtcacaatcgcaatgaattatatgcgtaaaggacagactgtagtaattaaagcttctgatggtgataccatcgctagtaatttgaatttactgcaatttccaaaacgctcagagtatccacctgatgcagcatgggtgcaatcaagctcaattacctttaacggaactacatcgtatgttcctgttcttgggcttgcatatattgaagataaagcatccggaaaaagctattggattgtaactgaatctgaccctaccgtagaacgagttgatgctaaagacaatacaactagagctcgattaggtgttattgctcttgctacgcaggctcaagctaatgcggagtcaaacccagaaaaagaattagcaattactccagaaaccttaaatggacgtcgttctactgaaacccaaactggtatagcaagaattgcaacttccagcgaagttaatcagtcaacaactgcttcttacttggataatgtaatcgttactcctaaaaagcttaacgaaaggtctgctactgaaacccgtagaggtttagcagagattgcgactaatgctaaaatggatgcaggaacagacgattttacaattgttactcctaagaagttgctttatcgtactacatcagattcacggttaggtgttattcaattagtaaaaactggtggtgctcctaacacaactgctgatcgttcttctgctggcaccggtatattcgatcattctgattacaaaaatgcagttactccaaaaactcttcgtgagtataaagctactgtaaatcagtcaggaatagtttggttagcaactgatagcgaagttagaaacggaactccggcttcttcaaatattcctacagtcgttacaccagaagctttgcataaaaaagttgctactgacggagcaattggattaatccaaatagctacacaaactgaagttaatgctggcggcgtgactaataaagcagttacacctaaaacattaaatgaccgtacagcaactaacgatcgtactggtattgctcgcttcgcgacacctggtgcccagggtgaatttgaagctggtacttcaagtacagtaatggtaaaccctaaattactgttcgataaatttgctaatactgatcgtatccaagttaatactagttctggcttaactattactgggaacctctgggaccattataccatcaacatacaggaagcaagtacttctcaaagaggtacaaccactcttgctactgctgctgaggttagaaccggcaccgacgccaagaaaatagttactgctgccacgctacatgctaaaacagcaactgaaggagctatcggtcttgctcagtatgctacacaggcacaagttgatgcaggcacattaagtgatagaattgttcctcctgcttacttgaaacagactattcaggtaacagagtcatggcaagctacagacagcgttagagggaccgtgaggctatctacaggcgatggaacgtggaaaggtaatgataccaatggctcaactcttccggataacgggtatgcctctaagggcgtcgcagtgtctccgtatgaattgaaccttacactgaaacattacttgcctcgtctcggtaaagcctatgacacaggaatgttaggtggtcaaaccccagacaaatatgctcgtcgcgatatcgcgcagactatttctggagcttggtcatttagtcaggacacttcatttagcaataatatttctgttcagaatattatatatgctaatggtggtgaagtgaagatttctccaacagctgatactggaaatgtgcatgttcgttttcaaaatagagacggaactgaacgcggtataatttatgctgagccacagactgcttcagctggaactttaaaaattcgtgtcaaaaacggaactggaactactgctacaagtcaaacttatgtatttggcggtaacggtacgttagaagttcctaatgaagtatcaactaaaactctgaggtcttctggaaatgcaatagttggcggaactgttatggttaaggacgttcagatgcttgctgtcgagggattgaattcaatattcggtgcccaatcacagtccgcatttattcgttcccgtgacgctgatacacaaatttttgcacaggattcaactggatcgtatccaattttaactaccaaaaactatgcaagactagctgatggccgttatgtcaagaaagctggtgatacaatgaccggcaatcttaacataagcggttctgctatcgtcattacaggttctgaatcatggtatgtgccaacgaatgaaaccgtaataagacaaggttcttggactgctgaaattaaagacgctactaagttaaaaggccttcgtggttatatggttccaatcagaacaccgattgacccgggtaacccaagcactttggtagtgaccggatatgaagaaaagactgctgctggcggtgttttaactcaggttggtgtaactacaaacaatacttatcagctttggacaccttatcctccgacaaccgaaactgctgataagcgtttcgcgcatactgtgtggatgaggatttataatccaaaccttaataagtttgatgattggatgcgagtgttcacgtctgctactcctccgactgcagctgatattggtgctccgagctcagtatcaactcaggttaaaacccttgaagtcctggaatggattaagcttggcccagttaaaatctggccagaccgtccaaaccaaactctcaaatttgaatgggtaggtgattaatggctgaaccaattttaatggcagcctttggcgaggatttcgtggaaacacgaatcctctctgaggcaaactctgtgaagtattggctaaaagcttatgctacgcattctaatgctgttcctaataagccagaattgaatattaatggtgcctttgatatgacctcctccttacggagggggattaatgttgttcaagttaatggtgacagttttattaactttaaaacatttgacgttaccactgatgataataacgctaataacaaagcgtttgtagaatatgcaaatggattaacgtcaggattgtatattataatgacacatgaacgatttcaatccagtccgttaatagacagatggtttaaaaacaagtggtctgcttcttggccaggttctgatttttccaaatcatttccaaactctgcctatgttggagtgctcggagcagcaaaaggacgcatattaattgagtcattttacggaaatgatggtgtagttaaagaagattccagagctaaagtagatactgtatatgataacgttggcgatgtaggatatacaggttgcccttatcgttccattgaagacactaatgagtactcggattctactggatatgaatataaacgttatccagtacaaaatgaatctataagcaaaatagctgattatggattatctcctggagattctgtatttttagtatgtgatatgtatgcatctaaaagccttcttgatgcgggttctacaactagagctagcttgcggtggttcaagggtacatctttattatcttcaaacgtatcattagaagttccaaaaaatggagctgatagatggttaagatttgaaagatttactgctgttcctacggacgctgatggatttactattgtggtatcacgatatccaaaaacgtctgtagttggtgattctaaaatcaaaaaccttgtatttgttcaaacctctcacagcgaaaaacttaacagtgttgttcaagagtttggtgtgaatggtataagaatgaataaaggcgttgaaggagaaaccacagtgattatggaacttccaaattcaaaagtcgatccgagcggtgttattccagttcaatcgttcagagaaacatcagactaaggaagccttcgggcttccttttttcgtataaatagaaaatatataagaggataaactatggccgatttaaaagcaggttcaacagttggtggaaatcctatttggcacgcgggtacttttcctcttgtgccggcaggaaactccctaacttatagaggtaaaaaggtttatactgagatagataaacctcaagcaaatgataacgattttgtatctaaagctaatggtggcacaggttctcaagggttccaaaaagaagttgaatttaaagctggcgttaagatttccgcaacgttttctggtggttcaaacttaaatggattgtattctggtaacggagatggagataccagagaaaaatctaacatggatttgcgttcatggtacggtatcggtatttggaactcatgtacaagtgatggggtccaggggcgtacaatctggttcagtgctaggcgtggtactatcggaacagttggtgatattgtttcaggttcccaagttattgctaatgcttctactccaacagccgctcagcatttaactcgtaaagattatgtcgatgggcgaataaatactgttagcaacgtagctaacgcagcagtcaagaaagctggtgatactatgaccggtgtacttagggctaacgctggcgtagttatagtaaataaagcaacatccggtgaatatgctcctagattagatcaggttatttcacgcggggtaacaatagattttggcacatactaagaggtagccatggccgatcaaaacttaaaacaaatacaatttaaaagaactagcacagagaataaagcaccaggtgcagatatcgtagcccgtggcgaaatagtgttgaatacacatgggcgtactctcgctatctacaccaaagatgaagccgataacgttgttcagcttgcaggtaaaggtgttcctttcttagatactgcaggtaatcttaatgttgatggaactactacgttaaaagacaacgttactatttctccgaataaagcgatcaattttgaagcttctgatttaagcggagcattagtacgtcatatcaccggtaagtgtgctaataatgatggctggtacattggagctggcggtgcatctgaccagggatttcttgaaatcggtacgtatgataacggaaatgaacctatctattttgttcaaagaaccggtggaacgactcaagctgaagttcgtcgtttagcattattagatgggtttggcgatacctctatacctggggaccttcgtttaactggtaaaacagtaaaaatttcaaacggcagcactcttactttggaaatgggtgtaggttctaatgacgcttatattaaaaaccaaagaggtactggcgttcttcaattaactaatgacagcaatttaacgttcagaaattcccaggtttattacgccatgaacggaagaggtcctggtaaatccggtactcttctgacgaatgtagaaaacaatcgtcaagcctggcaatacacaatttcagctgcaactgccacaaccccgcgctgggttaaagtagctacattgaaacacccaggaatggcttcttcacaactggatttaatgattacaggtggcattgattctggacacggaagacattatgttgattttatcacgttatcaggacgcaatttaacatcctggagcactagcaatttagataactgggttgaatggcgcaggatgggttctcctaataaaggaaacgttccagaatattacgttgttaaaaacgatgctgctacagattcagaggcttcatttgatttttacgctaaagttcctcgatacggcaatgggctttatgtcacagtgctgaacactgctggatacaacggccaggatagtggtaaagtaattatctatgaaaccaatcaggacactggtgatactggaccgtccggaagtattcttgtttcaatgaaacagatttttgatagtttagcaaaaccagatttcggtgataccacaggtactcttccggttaaccgtggtggtacaggtgctactaacgtaggagacgctcgaaataacctgggtcttagaactgcggctgttcgtgatgtcggtgaatccagtggaaacgtgatggaagttggtgccttcggtattggtggtcacggaaaatcacttgtagatattacttctgacgttgatttaatgactcgccttaaggctcttggcggtacaacgtttagagccaacgtagcgagtggttataccggggctccttattattcacatggcgcaggtttcttttctagaactggcgatacaatgtctgcgcttaatatagattacgcaactggtaatgtcagagtatttgctataaacgatagcggtttagcaagtggaagagtgaatgctaatatgctttacggtacagcaaacaaaccaactaaggctgacgtcggacttggtaatctgacaaacgatacccaggttaagaaagctggcgacaccatgaccggtgatttaactgctcctaacttgcatgcttctggatcaggaaccgcatcgctttatattaatgcgggaagcggaaatgctcatatatggtttagaacaaacaccaatgaacgtggtgtaatttgggcaactccaaatactgctgatttaggacaaattaatattcgtgcaaaaactactggtggtacttctgctggtgattttagcttccgttctgatggcagatttgatgttcctgtagcagttaaagttggtggagcagcaatgctaaccaaagacggaaacatcacctctggttcaatgtttggcggtaatcttaataactatttgaataccattaaaaacgacattgttgccggcgataataagcaagtaagtaagactggcgatactatgaccggtaacttgactattaacgctaacctaaaagtcgaaaatcctaatggaacatttgttgatttgggttcagagaactcagacaaatacagcagattgacccttgcacgtaaagttggtgatggcgcttccgtagcaatgcttaaaattactcctgaaggatacgtgcaatttggttatcaagatgcagttgctactccatctcctagcaagtacatccgagttaaatctgatggtcttgatgtagaaggggacttggtttttaatcagacatatcgtggtgctgaaaatgcagttgatatttctgataagactaatgaccttaacaacatggttattaaaggcagtgatttaggtactcgtctattatacaagtgtacttctaccggtggcgcttctaatatattgaacagacctacatctgatggtaactttgttcttgaagttctgtctttgcgtaaaatttctgatactgactggtcatgtaagcagacctttactacaaagaatggtaatgttgaaggcacatatgttcgatactgccaaaacggcacatggtccgcatggaaagaggttgtcgctggtgttcaaccgattaatttaggtggtactggagcaacttctgtagctgccgctcgtaataacctcggtgttggtgaatggcaatctgtggcatttggtgtattgaatgtcaacggcgttagtaatgcagacccggccatcacatttaaaaatggggctatggttcgtgaagcccaaggtggtagtctcggcgcgttaatcctgtcggcttctactgcatctccagacggcgcgaaatatattgcttttcgacccttcggtgattcgtctggtactgagattagagtaaaagccaacgggtcaagtgagtcactacttgaatggtcttatggcccaggtattcgttcaaattcatctggcgcttttgttatctacgcaaaaacaggtcaggcactccatttaagaccaaacggtgataattctaaccaagccacagttattgaccaaaatggtaaaatgactgtcggtggtgaatttgaggcccagaactcaaaaatcactggtaatttgaatgtatctgaagataatagaatgattgttcttggcaaaaactctgatattggtttagtcaagaaaagtggtatgccaggaaaaatggctatcggtaaatctaactcgtttactattatggtatcaacaaataccaacaaccaaattaatcctgctgatacgtttaatgacatattcaaagtagatgctgatggaaaccagactgtttacggaaatgcccaagtcaacagacagttaactgtttctagttcagctactgttaatggtattattaatgccaacggaggtattattgttcctactaccaagtatgtacaaattgccgatgctcctacgcagaataaccaagcaacaaataaacagtatgttgatgataaggttgcttctgctattagtaatgctggcgacacgtatcttccattagcgggtggtactgtaactggtaacttgattgttactggaagccagttaaaaagtacatcactctgggttaccggtgatgctgccgttaatggtgttttaactgttgacggaaaggctagatttaatcaagagttcagtgtatctacttcagttaacgtccagaacgatggtaatagccatgtgttcttccgtaaagcaaatggtacagaaaaaggacttctttgggctgacgaccctggtaacgttagtataagagcaggcggcgccattgggccggtgtggaatttctggagcagcggttcctgccaattcccaggagctatttctaactataacggaattagtaccactactaattatcctgcaggaaaacctaatggtacatataacaataccgcaggactagtaactagatttagtaatggtgcttatgcttcaatatacttccaagagtatgtaggaaactatcaccaggctattcttaatgttaacggatttggtcgagacgacaacttctttttccgatccggtggcgacttcttctgtactcgtaatggctcttttgataacgttgagattcgttctgaccgtagagccaaatcggatatcaaagttattgaaaatgctttggaaaaagtagaaaaactaaccggtaatacttatgagcttcacaacacatccggtggtactactcgttctgcgggtttaatcgcacaggaagttcaagaagttcttccggaagcagttactcaggatattgaagcagacgggggtttattgcgtctgaattacaactcagtaattgcacttctcgttgaatctgttaaagagctttctgctgaggttaaagagcttaaatctcaactgaaataatgtaaggggcttcggccccttttaggagaaataattatggcagtaacaggaccatgggtaggaagttcggcaaaggccgttactggtgaaacctggatggcccaggctggagcaaaattgagattggggacacccttttggatgtccaacatgattggaagaaacgtctggaatgctagaataactatttctggtaacaacccagctacaggacctaaggttcgtggcgcttggaaagataagaacagtgcttcatggaacgtgttactcgacgctcgtggggctttatcaggaatttgggaaactgggtttaatttggttgcctttggattatcagagccaagcaaaacgtttggttataatgacgcaattgttctagaaggcagtggaaactttaacgttaactggcgagttgatactgaagacggtaatcaattccattttaatagctcccgagattaccgaggaagacgctgttatagctgtacagacaacaatgctttttggaactggctttatgctaatgatggacgaacattccagctgtcgtttactgcatattaagcataagttagagcaataaatagctctgtaaggagagcaatatgtcaagcaaacaatcaataccattttttgatatgtttcttgggttgctcgagctattattcaaagatggagccacgggaagagttctcttttcccgtgtttttgttgtcatacttttagcattgttggcgtttgctggttataagtcagatagtcttattactgcttacgtcgatagtacatatgacaagtatgataaactggttcaaaaggatagggatacccgatttgataatacagcactcgaacaactccagatagtacatatctcaagtggtgcagatttttctgcggtctttacgttcagacctaaaaacttgaactacttcgtagacttaattgcttatgaggggactttacctagcacggtagattctaaaaacctaggaggatatccaatcgacaaaacgtctgctgaatacagtacgcatttatcgggtagatatttttggacggataaggaattcgttttcttaccgacaaaaagaaaaccacctgaaatatcgtacatgtttagctgtccgtatttcaatttagacaatgtttatgctggaactgttgaaatgtactggtacaattccaaacctgcattatctaacgaaagactaacatcgatatgtggtcaggcggttagagctcttggaagagctaagtgattacttattactatgcatagccatcgttcgatagatagactcaaatccctcgttgtattcttcaacgagaattctcttctcttcgtcagttaactcagaaaccattttacgaaagttgctctgatttaactgacgcccctgctcgttcttgattccaatttcattcaagaacgcaataaattcatctcgcttctccatgatatgttcagcattgaacttagtcagaatagaagcaacagtaacgatttcttggacaatttcaaacttagtcattatttttcctacaacataatggattatgtgattatagtatcatcttgataccgcgttgtaaaccagtttatgccaattcccaacgagaattcaaatcttccttggtagtgatatactcagcaccagaggacatccagagcccgtagcgaccatcttttactttagccgttaaataccattcctttccaattggacgaaccctacgattcatccagtgacatacgtcaattgcctcctgaaaagacaagtcaatcagacttccaagcgcgattttattcattaacgcttcgagatatctttgtgattcaacgacagattctaagttatgactcatgctaaaactacctctccacgattgtctaaaacacgttcaatgtattcaactgcatttataatgtcacctctatcctttgccttaatagtaataattccatacgtataaaagtcggctgacaaactgaatggcttagaagtgtcctggttaaacgtagacattactgcttgctctaagtgttttacttctaagtcattagcccaagagctaagaactttaagcctaacttgtaaagtgtattctactttaattgctgaaagcaattcaacacgtttatgatacgccttggcttcatcttctctgcgtaaagtttcagtattcatagataatctccaatatcataagcatcaacacatttctgaaattgttcaagaacttcttcaggttcaacgttagctataatagctacagtaaaggtaccattattccaatcatgtaccatccaatctccatatccaacattctgaaggtcttccattagttcagaatggatatctgctactaatccagaatggtcccctaatttcttgtggagagcttctaggtcatcacaaataatagttaaagtagtacatttggaattattcagaatgcgcattgtctttacctttgtgtttttgcttacgttttgattctttggcagcgcgctttttatctttatgcgcgcctcctttgttaaagtcattcttcgctactgggttgtacatgtgcaattacctcatttaagcagttgcgtgtaatatcaaaacgcttagcaataccacattcttggatatgtgcttttaaatctccggcatgcacataccccaattccaagataaaccgtttaatttgagccttttctgaacgatttaagctattgaagtaatctgccttggcgcttattgctctcacgctctatcttccttacattcaagttccttgatataatagtcaatatctttaatcatttcttctgtcattattttgtacatttcagcaagaaatggtttagcaccgccattaaatggatggctaaacgggcagatgtattccttatccatgagagttttcatgaatttgctatctgccattttaaacccggcttcattggtatatgtaccccaattatcgtccatcatttctaatgagcgctgaagcgatttacgttgaatttttaaaagcgtaatgttattctttaatgtactaatcattagtataaatcctctgagaataattcattggcgggtcccgatttaggacgaactgtattaacttggcctgcatgtgtagcgatgattaatgcttcttcacgcgtgaagtactcaccccattggtcaacaaatccttgattgtctccatggacatgatcagaaaccaatttatcgcgaaacatatctaaaacgttcgccatatcagcagaataatggcgagtgcctggaactacaattgttccaccagatttcaattcaaaacgatttgctgcacaaacgatacggcgttgaagtaatcgtccatcccaccaatcagctactttaaagcaaatttcaggaatactaacttcttctggttcattaattagagaaccgtgacgagaagcatcaacaaatttattcatttgttcggaaaacttgctcatttaaagaatcctttaattttctgccacaaacttttcttttcacgaataccgatttgccgaataacaggttcaccctgcattttctctaaccattccattgagttaacagcttccgccattggaacaaatttagcaagggccttttggtaattatctacatccatgatatgtttaccatctgcattgtagatagcatagcattttgtgaatttcttatcaatgtatccgataaagtgcccacggaaccatacatcccaacaatcagttgggatattagcattcaagttaactttttctacacaacgctgaagttcattcaatactttaaacttgttcattacagttccttaatagagcggatgatggtttcaatgttttcagcagtacgagcgatatctaagtaagtattgcctgttgcagctacacggcaagacattccgaggtcagtgaagtgtttctgatgctcttcagaaatcttgtaaccgaagatacggaaagtacctttgttgttaacttcaagactacgaataccgaatgtacgtttttccagaactgcgatatagttactacggtaaacagtaagttctttcagaggtaagatatcttccatctcaccgagaagtttcatcatcaggtctttgtgctcattcatgtcttcagtaagaggacgagctttacgagtattgcgtttcttcagaagttcaggcttgttctcttctgcatagataactgctgctttagagatgatgtcctgcgcttcaccagtgatgattaaaccgtcaccagatttctcgatgagacctttcttaatcagaacaccgatgtttgagtttacagaacttgcgttcatggtttcttcaaggatttcacgcagttcagaagaagtgatgaaatcctttttagctacctgaaccaggatagcagcagttttctcgttcagagcatcttcggaagctttgatgatgtaagttactttagacattgtgattctccatgatgttttattcaatttgtttggtatgatactataataacatctgctaaccagcttgtaaaccattttattctgctctctgaaaaattttcttcaaagagcagtaaaaatgctatacgttaaagatcaagaacttatcgccattctcaagtttaagcacccagaaatcatcatatacacaaagaacgacttggtactcttcaccgtcttcatagttacttgcttgaattacctgacgcataggatactcgcgattaacttcgaactcatcgagcaccacaatgttacctttgacatagtggctcagtcgagtgccatcagcttgagtagaaatataaagaatgtttttgatatcagattttaatgatgtaatcattttgtttactccgtgttgttttgatatggctataatacaacaaccgtgtaagcatgtaaacaactttatgaaaataatttagggcattctaaggagggattttggatggatatagatttatatggaaggacctggagatgacctccaggttccctagattaattgaggagcaataaaactagacctaatacggcaattacagaacctataactaaataaaattctatcatagttcttccaggtctttcagatactcagcttcaggagttgtcttttcccagtacttaacctcttgtgctaggcgttttgcttcctgagcaagtttcttggcttcatcatcagtgatgtgatagatgttcattgaaacgagtttttcagaatggtctttgaatagttcattctgttcaatttctttagtcaactgcttacgagttttaccttggataacgatgttacctgcaataacctctttaataaattgagcttttgcctgagcaagattaaacgcctgtttagtttcagctattttatgctcgattcgtttagcggtgaatgtcttacggacttctacaaaatgacgaatcagctcaccggaagttttgaacttgtcgttcagcttaccattctcatcgatgaccacaatgtattgactcattttctcaatgagtttaaaatccttcatgattttagcatgacgctgctcagggtcatcgctcaaagcatagtctttacggaatttcaccttaaagccaaacccggtcttagaacagtcatcatcatatgtgatgtatcctgcatcttccaacgggtcaagtactttttcaacgtaagaagctcgttcaaacttgtatggaatttcactgatatagattgagttccgtgaagtttctttatacacgccgtgcagctcaacagaaccgtcttcagtttgaacgatttttccgttaaatttagggaactgaacttcaggttccatcatttcgccacgaagtgctgctttagtgcattctaaaacagattcaaaactatgcggaagaatagaagttgaataacctgttgcaataccgcgaacaccattcagaagaacagttggaattaccggaagataataagcaggtggaacatgctctttatctttatgcaccggagcgatttctgtgtctttgtagattttacggaagttgtcagaaatccggcagaaaatataacgacttgccgcagcagattgaaccaaacgagaaccgaagttaccttgtccatctaatagaggatagttgttattccatgtgtttgccatcagtgcaccagcatcttgggcagacgtttcaccatgatgatatcctaaatcagctacaccaccggcgacagacgcaagtttgtggaatttttctttattaccacgagccaaatcaagggcacgagcaataacaaaacgctgtacaggtttaaacccatcaatcaagttcggaatagcgcggttttctacagtgtaaatcgcatactcttttgcttcattatcaatgatagatttcaaatcgcgatgacgaagatttgacgccttagccaaatcatcaatagaacctgcttgttttaatagagtgtcaaaaatatccattgtacctaccaaattagtgagccgatttgtactataacatcggaaatgaaaagcacaatataaatcattccgtaaatcattccatagtacaaaaccaaaagaatgatggaaataactgcggcagaaactaggagtttcttaatcatttgtaaactcctacaattttacaaatgcgctcaaacataataaatgctgcagtgaacgcaatgcttccaattactttagtggtaggcacaaggccataccacatgaatgttcctgagcaaatcattaaggccatcagaaacacatagcccatcacgaagaaggttctcattagtatttctgcaaagtaaagatgaagttatcattcagaatacgattcagctcagagtaggtctgcgcatcacttgaatgctgacgagtaaacgccaatgcaagctgacctttgccataaccagtggtgagtggtttcattttattagcaggaatccagaacacaccgtaagtcatgcaattcgagcgcagagtacgacccaactgagaacgtccagaacggatatgagaaagaacactttcaaatcctgcctttgaacgctgtttagctacaaagaaacgagcagatgcaccaatataccctgctttgccatcattgaacatcaaaaaataaaatccttcacgctcagtaatttcacgagatggagcacctgttgcccaatcaccgttacgaatagaaccgatcagttctgcgccagcgttatcgagatcagcaaaagtcataatattacgcatgttaatttcctcagttgattaaagtttattctccgataaggggccgaagccccttctactaccaaaaatatactactgccgttacaccaccaacccaaaacacaagaagacctaaagcaagcagacgatacacgatgtgtcgtttcatttttgaccttcccatacggtttctactaaggatttaaggccatcagtttgaataatatcaatcgcattaatggcaaaataaattccgaatccgaacacggtgacaatccccagtgctaccgcaacaataacagacagaacagctgttctcattaagttaaagcgacgatcaaaactattacgaaccattatattttcctcagataaatgcattaatccaaacgttaaccaaatcccatgcgaaaacaccaatgaaagtaacgataaggcagaatactacaaagatgttcttcagaatcgtaagtaactttttcattttgttctccagtttagctaacaagactatagtatcactggagaacaagaaagtaaactattaaatgcacaaattacgaattttttcttccagagctttgactttctctatgtgctcatcacgagcagcggcagctccattaggatacaacccgccatacgttgaatcaccgttatcacaagcaatgatagtataatgccaattcatagattcaagaatcttatactctttcaaaagctcagctttaatagaagcatttccgcgtttggctcgaagtgattttagctctaagtaactcatgttttactcccgttcagtttgtaaggccatagtatcatggccaatcccggaagtaaacaactttttaaaatttatgcatgatgtacccgccagcaccaactcgcgaaggttttacgacttccatgagctgttcgataccgccactgaacatcggtgtgtaccgtatgacattctgggacacttcttctgcaacgaatataattatacagtctgcgactttatgtttaaacatgggccctagatttattccacttccatctgggaatggaccgtctttaccagttgtaacattaatccatggcttatgatttgctcggtcatgaacaaagtgtgttttaacttcaactctaacaccttggtagtagggatgagctagtacgtcccaggcccattcatacggatcgttgttattatggtcaacaacttgatcgtttacgtatccatcaagaaaatccgctaccacatactctgccggtatagcaattctacatcttttaagaacatcaattctgtcttgagatggatcgatatctaaactatatcttgcagtatcaatgatttttacttttgcttcaccccttagcttattcaaatctagggtaaatgtccggagttggttcaatctctgcagggctttgttcatcaatgccataaattcctctgatatgtaattcaccaaaataaacacgatcgtcgtggttacaagtgtctggttccacaacaaaatcatcaccaagttctacaagttcatcacagtgcaaccaagcatagtgaacatcaccttcatgtttaactacatgatgacaaaacaccgtagcagcatgatgagtaccacgaagattaacaactttagaatgagatacgttaaatggattaatcatgtttcacccataataaaagaggagcccgaaggctccttataattagcgaagttctgaaccccaacgatcagttacatcttctaatactacataaccacatgtacgcattttagcgtcgttgtaatcaaccgggatagatactacatcacgcggatgaactttaactgaaacaatacggtcagaaccactaccgaagtgaccgatgtaagatttagagcagacatgcagacctgctgaacaagtacgctgatcgtcttcatctacctggttacgcggcattgtaacagttttaccgggagagttatcaaacgtgtttgaagcacagtccatataagtggaacgaactactttccaaccaatgaagtgaccatcatcagtgatgtcgatatcgtttgcattcaggaaatcaaacagacgataaactgcacgacgagatgggttcagcatcaggttttccaggaaaggcagataacgtttaaagtcttcgccatcttccatggctcgaacgatacgctcagtcagaccagatttcagctcgatatctttatagaataaagtaccatcttcaattcggacgttaccctgaacgaatttcttgatgccttgttccaggttaatgtggtcaatagcaccagcgatatcaccatctacaagtttctgcagtgcagatttaaacccaggatgttggctatcagcgttataagtagtacggccttcagtaattgaaatgaatttggaacttgctgcccatttaaattcacgctcaactggagcttctactttagcaggaacagctgccgcggcagctcgagcttcgcgttctttaaacacacgccgaatggtgtcacgggaaacaccataattctcggcgagctctttcttagtgtacagaccgtttttgaagtttttaacgattgcatctttttggatttcagacagacaggtaacagccatttattcacctttattttcagaattttgagtagaagctccatcaaggagctccatgatttttacgatatcatcgacgagtttgctgtcagtccgccaagtatccaagacacttgcgatgacaggataatcatctttaaactgttcaatctttttatagaagattgtctcagcatcaccagacagtttattataaattttattacataaagctaaatcatcgttttcatctttgattttactggtacggcaaaccttagcgattttgtttagttttgtcaggaacggatttttcattccagacgcagtaaacttactcgacaagaaattcaatttatcgtaatgcgcaatatttccacagatacggtttccagtagcatttgatggcatgtactggtcataatctaccttatcaatacacttgatgtattggtcgataataaatcggtcaaatgaaagcaatccatcagcttttgccgcggctttcatagcacccggacgaattgcatagaatttcttaattccacacgcttctgccagagaccgcatatctgtgatgctcatattccaccaccaaacattatctgggaaagtgtggatttcatcacgattgcgaccgattgcataaccttcaagctcagcaatttcagatgatactaaagtctgacggtcttcttcccagtacccgtctttatcaatccaatgcagagaaacattaggagattttggacgtttctcttttggaccagtatcataatcaggaagagcttttctctgggcttcaagttcagacacacggaatactacaacttcatcagtatccatgattttcttcagctcatcaatgacatgtaattcatcttcattgtctttgattacagtaatgtgtgcccagattggaactaacccagatttacacagagctcgaaccgtagcaatacgcttacccgctttatcgtcaataagaacgaacgctttagttctatcaaccccgcaaatatcagaaatgtttacttggttatgacgatgccaagaactgcttgacactttacgacgagcaggttcatcgcatgaaacataaactgatacttcgttgtctacataatatgaacgaattttatcgagattatacttcgcaactacttgtttaatatcgcggttcccaatggtaataccacggctctgaagaatagaacgttccttagaactcagcttattgaactcacgcaagaattcacggtcagattcatacgcttcaaacgctttaatatctgcggtaattacctcttcttcaagagcattcacacgcttctggatattagcaattgtttcttcgtcaagagaaagctcttcacgagatggagtaatgtctaattcgccaagagggaaatgaacataaaccttgccataacgattaagcagccaatctgccttaacatctacaccgctgatcggatatacgatttttccataaactgcatacagaccataactttcgtaagagctattaacgctgaaccagtcggtcttatctaccgggaaatattcaatttcacggcgaagagaatctacctttggaggtacagcaccaaaggtacgcaaaatatatgcgatttcataatgccaagtatcaatatcttctactttaaccggaacagtgatttcaagaccagtttcttcgtcttctttcatgtcatcaacgaacattggacgaatagtaggttcgccgcggtttttcatgacagtataacctgtagctttaccatcatgataagacactacgttaaatgtactcgtatagcttaatggtgatttagaaccaagaccaagagcaccgatgaaatcattactattattctttgtggattcaaagaacgttttgtacatcgtcatcatgtcattatgattaagacctggaccataatcacgaattacaaatcgtgggtcaagacgagtaggagccttgatataaaatggacgattttcattaccgttcagtttatgagcatcatcacagttagtagaaagttcacgaacaacagcacgaactttatacttatagagtttgtttgacaagatgtcaaaagctttacccgaggccttaatagtaaacgttgaatcatcagcgtcagaagaaccaatgattacttcatcatcacatttaattttcattttattcctatcaattatgtcgtttaatgatttctgctacttcaagtaactcttctgcagtagcggtattagttgtaaaaattttattatggatttctttgaagcgttctttgaattcctcagctgcttggatgtcaaagaaccgctggatgatacgatattcacgatatatagcatcgttgaataattcttctgatgggatgtaactacgtttcataatattttcctcagtgatttagggaaattatatcactataactttaagcaagaatcctagaatcatctccaagcacttcttgattaaagccatataaatccattcttataaagaaaaagggacccggaggtcccttagattaccacaccctactaactcgaccataaacctcatgtttagaaccatcaatgttttccacccagatagtaacccaggttccgggcagaggtttcttttcagcgaacagatatccatagtcgcctgagatcaaagtaatccaataacgttgcatgttaattccttctaagtaagggcaatagtacccttactatttattctttattcactcatccatgtcttacgtggtgcagcatcattacccataattaattcaaacagttctttccagttttcaggaagagtgactacatcataaaccgggtcttgaataacacgttcgtattcatcttcttcaagagagccaagacctttaatataacgaagtttccaacctttgaaatcatctttatggtcttcatattcaccaagagaatagaaccaacgttgttctttacctttggtgagaataataaccggagttttcacaaagcggattcgaccttgttcaaataattctggccaattactaaagaacgccaaaagacttgggaaaattgaaccaacaccatcaacgtctgcatcagtcatgatggcaatatttcgatagttagtattttcagcgggttcaccgatagtcaaaccagtgattgcacaaatgtcaaatacttccttgttcttcatagcatctgcagcagacattccccatgtattcatgaacttaccacgcaaaggatatccgccatgaagttcacggtcacgagttgtaagtagataaccgatcgcagaatcaccttcggttaagaataaagttgtgtcagcatctttaccatatttgttggctttgatgtgcttagctactttagctttctgcgctttcttggcagctttagtttctgcggctttctctgcagcaagtttacgagctaacatcgcctcaataatcggcatatgaatatcttcggatttcataatagcgttagcaagtttcttataatcaatatcaatatggctacgaatttctccccaaggagaagtcagacgctctttagtctgagaatcaaatcgcatgttagacatatcacgaataaacatgatgacagtcagacattctttaattcgcgctttattaacttctagtttgtacttacgctttaatgctggaataagttcattgctcagttcatcaagaactaggtcaacgtgagtaccaccgtttttggtgtgaatgttattaacatatgaaagttgacggaacccgtcatccgaacgaccgatggcaatagcacaagtatcagaatcctgcactacagcattttcgtcatacatgtgggcgtaagctttaaacttgccttgaacccgtttacccatgaatttaaattcaatatcaggataaactactgctaacgtcatcagacgatcgtgaatgattgattggtcaacatcagtcaatcctgtgctttcaaagtgactgaaatctggaatgaatgatactgcagtaccagtcttatctttgatgaattctttatcttttgctgggtgttcttcccaggagatattttctgagccgttagaacaacgaacgatgatttcatttttaccatcgcatgttgcaccagtaaaagatactgaaaagatgttggttaacgcagaaccgacaccgttcataccaccagttttacgctcagaatcatcaccaaagttaccacccgcacgaggacgagtccatgcggctactggtcctggaatagtttctccttcaggtgttactacaggagcctgcggaagaccacgaccgttatctgttacaataattttgttgcctttaatgtcaactgaaatcttattcgcgtgtttgaaattagtacgaatagcttcatcaacagagttatcaatgatttcatcaataagtttgataataccaggaacatactttactgattggaatttaccaaaaagaaaacggtcatgcgcttcaaacgcagaactaccaatgtacattccgctacgcttaatgatatgttctcggtcactcagaattttaatttcgttcttaatcattacatttcctcggttagtgaaggaattatatcaactattaattatagcaagtaattcttctttgatatacatcaatttaccaagaacctcatggcctcctttaaccgctttatactcgggatatcggggccgctgtcgttcaaacatagtccattgagcatcactaacgttagcgtatgcatatcgagttccgtagtactgttcaatccggtactcgttgttttcattaagtgaaatccactcttcacagacttcataatatttctgcatccaaatagtacgaccattcacgtcattaattggccaccaagcaaacctgtattttccaatagcccgctctactatttttaaatgtcgtttagcacgtctttgcgcagttgtcattccaataatcataatattctcctctggccaacaagactataataccaaaacatggtgtccatgtaaacaactaaatgacccgaaggtcatttattcataacgaattgtgctatttttgagaaaaagccctgagcacactgttccgttaacaggttttcctgttggcccaatagccgtaaagcctgtgtgctgaaaatcatcctctgagcaagaaaagaacttatatccggtgattttgatatcagtaaatcccgcgttatctaacacgcgagttgcgttatcagcgtcagtgcatccaatcatcatgaaggcaagcgctgtaattaaaatctttttcattttaatttaaccctataagttatattacctactttaataacccggatttctccgggtttcatggtaatgcgtgctttagttcccatcaataatcaccactctttaatccatcgtagtgaactgccggagcagaaaccacccgcttcatttgaccttcacacttagggttaaagcagttaacagtatagtcacgatgggaaattttacgcataatttctatcttttttccacagacttcacacttgtaatcatacgttggcattaacagcatccttccatttttgtgttttgactatgatttgctcattcagcgcacgagtaaccatcatggagatttcatcatctgatacatgagtatcatttttatgacgatttctgaaatgcagccaaagtgcatccactacacagttaataacatctgcgcactcgccttcaaattcttctttctgccgccatggacgattaatccaatcacacatttctccagtttctgaagaaagttgcagcatgacattcccaatgctacgattaggaataggataagacatttttgatgcttcaaaaataggagctaaatttaacattgatatgcactctgcagtgctgcaatagcagcgattgcttgaccacgattatgaatagaaagattcataaccaaatcggttggaattacattcgtggaagttccaacttcagtaaagtatttgaattcgctatcaaaaattacaaggtcttcaccgccgacttcatcgcattctgtgccattagcccacgtaattcctgatactctattattttggcggtcaactttagtaacagtaaaactcccgccattttcatagagttcatacacaaagtcttcattaacctcatagcgtgaagaaaattcttcttcagcttcatcattgacgaatttgtactgtacgccttctttaaaattcattacacaatctccatgtattctgggccatcaactgtgattacacgagcaaaggtacgaactgggacgatatcaccatggttcgcgaatacatacaaccaagtccagtgctcttctttaccgaaggttttctctttctgaacaacgattaagtccgggttgaacagaacatcttcaaaagcttcagcagtaatttttacggtattttcagttttcatgttattctcctcagtagttgataagataatagtaccacatccttgtggcaaagtaaacaactttttatactaaaccttgacgttgcgattctgtcggctctacatcggctttaggcagaactgcatagttgccttgaaacactacgtttactagggttttaccgtcttcttcccactcatcagtgacaagaacatttttatgcagcgacagattagtggctgaattagtagaactcaccgattgggtaataacattgtccagtgaattcacgtgtacccacttgcgcagatagctttcgttaaacatagaatcaagcaaatcacgcgattcgagagcaactacgaatttttgcagcgaatacactgctttgtcttcattttccagttgaagcaaatatgaagacattttgttagaacggttaaagattccaacaattacgccttctttaccgatatgcttaccaccaatcactttaacgttttcgcctacaatcaaatttttcatcgtgtttctctcagtttgttaatgtagagccattatataacggctctttcataaagtaaatagctatcggtgagaaatttcacatccaacatcgacgccgaacagatacccagcttcccaccctttagccatcatagccttggccaccagaaccatcgttggagagatttccgggaggatttcccggttgaaccactcttcgaagttttcatcgaactcaaactcttccattagccacgccccttaggtaaactcagtggatcggtatcttctggacttggtgcttcgcttaggcctagagcatagcgttgagcatatttaagcattagaatatctttggcacagtcatggatactatcatgcgcgataaatccgtcgagcgtaccctttggaagaggagtagttgtcaatccgcgtgtcagaagcagtgattcaatcgcggtacgaatatcacgctgattccagaacttacacggctcttctttaaatgtatcaatttcttcttcagaaatcccttgagctctctgcacatcgcgaagacaatctacaaaaatcggaaagtcaaaactctgtccacgacaccaaccaaaggaatcccatggatgaattccattatcaatcagatactgctgggcttctttaattccagcaattactgataaatcatctggcgttgaggcaaggttagcacgggcttcagctgactgcttcttccaccattcaagagtagacttaccaaacaatcggtgacctttctgagatttcaagtcaaacttaatacgatgaccacgcttgaccaattcatcgaagctttccagaacttcagggtcagaatcaaaggtgattagagcaaggtcaatcacagaagagcttgacacatttccgaatgtttcaaaatcaataataaagtctttagccattttgagcctctagcataaatttaatttcgcgtaactggcaaccaatatattcgctcagatacacctttgggtcatatcctgtgaaccaagtaatagcattagcattatctgctatatcacgaagctcattcagaactgtatcaattttaatgttaatagcacgcttaacattatccggtgcttcaaacttagattcttgtaagccaacaatcattgtttgaaggtcttctaatttcaattcaaacatattacc

SEQ ID NO: 2 - DNA, 41222 bp, synthetic construct
  source 1..41222: mol_type = other DNA
atgagtattcagctatcggcccctcaggcattgtttctgaattgcgataacaaatacaaagcctatgtcggcggtttcggcagcggcaagacatttgtcggctgccttgacctgcttacgtttatgctcaagcatccaggtacgcgcctgggttacttcggcccgacatacccggctatccgtgacatcttctacccgacatttgaggaagcggctaacctgctcggccttgatgtgctggttaaatctggcgacaaagaagtcgtggttactcgcggtaagacggtgctcggtacagttatctgccgttctatggataacccaggctcgatagtcggcttcaaaatcgctgctgcggtcgtggatgagcttgatgtattgagccgtgagaaagctgagctggcgtggaacaaaatagtcgcccgtatgcgtctggttatccccggcgtaactaaccacatctctgtcaccacgacaccggaagggttcaagttcgtctacgccaagttcaaagagaacccgacgccgagttactcgatggtgcaggcatccacacacgagaatgcgcggttcctgccaccggattacatcagctcgctgaccgagacttatccggcgcagttgattaacgcgtatctgaatggtgagttcgtcaaccttacctccggcagcgtgtattacgcatatgaccgccgtaagcaccgcagcaaagaggtaattcaaccgggcgacacgttgtacatcgggcaggacttcaacgttacgaagaacgcaagcgccgtgtatgtgcaacgtaaagacggctggcacgcggtggcagaactgaaaggtctgtttgatacgccggacaccgtgcgtgtaattactgagaagtggaagtcgcagggccaccgcatagtcgtttacccggacgccagcggcaagaaccgcaagaccaactcggcgtcaatctcagatattgcgttactccagcaggccggtttcgatgttcgcgctaaatccgccaaccctccggttaaagaccgtgttttagccgtgaataccgcactggaaaaaggtaagctgtgggttaatgaccacttatgccccgagatagcaaagacgctggaacagcaggcatacgacgacaacggagagccagctaaagacggcatcattgaccatatggcggatgctctcggctatcctgtagtttacgagatgccggtggttaaaccagtaatcaacatcccggtgactttcgcactttaagaggacaacaaatggtttccgcaaacattaacgcagggcaagggcagaacgttaaaacccgccaccgccagtacgaagagtatttccctaagtggcagaaggtgcgacatgcgctttctggcgacctgacatcgtatctacgtgacgtcagtaagaacgagccggacccggtttacggtcgccagcgtcaggctgaatacgaagcgggggcaatttgctacaacttcaccaagcgaacgctttcaggcatggtcggcagcgtaatgcgcaaagaccccgagatgattattccgtctcagatggaatacctgaccactaactgtgacgggtcgggcgttggcctgtggcagcacgcacaggatactctgtatgagattgatgctgttggtcgcggtggtttgctggttgacgcccccgcggtagaagtagctaccatggcagagcaaaacgagggtttactaaacccaacaatcgctttctacaccgcagagaatatcatcaactggcgtctccagcgcgtcgggtctgttaatcgtgtggttatggttgtattgcgtgaggaatacgagtacaccgatggcgcggatgagttcagccccaactacggcgagcaataccgcgtccttgatattttcgaaggccagtatcgccagcgtctgtaccgctttaaccagaaaggtgcactgatggaaggtggctatatcgaaatattcccgaaactcggtaatattccggtcggggtgattccgttcacattcattggtgcagggaataacgactcaacccctgacgatgcacctttgctgccgttggctgaacttaatatcgggcacttccgcaacagcgcggacaatgaggagtccagcttcgtcgtaggccagcctactctgttcatcgcccccggtgagaacatgagcatgggacaatggaaagaagccaaccctcacggagtgcgtatggggtcacgttccggccataacatcggttacggcggcaatgcgtttctggtccaggccggtgagaacaacctagccaagcagaacatgttggataaagagaaccaggcaatccagattggtgcacagcttattaccccgacgcagcaaatcaccgcggaatcggcacgcctgcaacgtggtgccgacacgtccgttatggcgacaattgcacgtaacgtaagcatggcgtataccgatgcgctgaagtgggttgctggtatgcttgggcttagtgacggcactgaaattgagttcaaacttaacatggagttcttcctgcaaccaatgaccgcccaggaccgcgctcagtggatggcggatattaacgcgggcctgttaccggctaccgcttactatgctgcgttgcgtaaggcgggggtaactgactggacagacgaggacattcagaacgctatcgaggatgcgccgctgccgttaggtgctgttactcaggtggcgggggagattccgcagtcggcgcagcaacaggacaccactcagccgtaagttcacatatagccccgaaaggggctttcttatagtatgctattaactttagtaccacagggtttaactatgagcttacttacatccctcatcagccatcagatatggctgcaacgcaccgcatccggtgaggtgaaagacctcgcaccgttcattcaggagatgcgggatgaaatcaaacggcaggtgctgttattcggcgacgacgggcgaagcactgcgcggctgaataaactgttacgggaccttgaagaagcactgacagggattacaggtgactggcaaacaaagctgacagaagacctcaaggaactggcggcgtatgaggctgagtggaacgtaaagacactgaccgccaacgtagctgcggaatttgttacgcctaccgctgaacaggtgtgggctgctgccgagtttcaaccgttatcgttgagcgacaagcctgttgacttcactaagctgatgtcaggttggggtgaaacggaagtagcacgtcttgtaaccggcgttaagatgggctttgtacaaggtcaaacaacacggcagattgttaagaatgtagtaggcgccggtgggcgggctgacatctctgagcgtaacgccgctaccgtcatccgcaccgcgctgtctcacgtgtccaacgaagcccgtaacgagacgtaccgccagaacgacgacatcatcgagaagtacgagtgggtgtcaacgcttgacagccgcaccagtacgatttgcagggtcagagacgggatgacgtgggaaattggtaaggggccgatgccccctgcccatccgaactgccggtcgtgcacggctccggtaatcagttccgagttcgacttcctcgataaaggcgcaaaacgcgcggctaaaggcgcggaaggtggcactcaggtaagcgtagacaccacttactacgagttccttaaacaacaaccggcgtggtttcaggaccaggcgcttggtcctgttcgcggtaagattttccgcaacagcggtatatcaccggaagagtttcgcgtaatatctgtagatggtttcgggaatccgctcacgcttaagcagatggcggaactcgataaacgtgttgctgattatctgaaaggggaataatgatgggctttttcaaagtaactgacgtaccgtctcgtcgcgtagtccagtacgcccgcgtgtctggctctggcgagaacgtggtgtttattgaagacgaaagtgtactcggaacaccagtggacgatatgccgtttgcggacaagaccggtattgcgctgccagcggcaggtatgctttacgagattccgtacctggcggatgctggtgatgtgtatttctccgtacaaccgcaggacgctgaactggcagacggcagcgcaaatatcgctgtcgaagttaaggcgggcaaagcaccatatgcgctgacctggtacaaagacgggaaggaagtggtaaacgccccggaagaggctctgtctctgacggttaacgcagttggtgaatacttcgttaaagtcactgatgccgatggtatagaggccgtaagtaaagcagcgaaggttactaagccagaataaactgaagccccgaaaggggctttttagtgcctgtgattattccagttattccactcaattgtaaatgttgtaataaactattcgaatagttgacttttcaccaaaaatgtgctaagctccacctgagcttgtgaagtatgaacaagcgaccgcggcgcgggcaggtaacggagcgggacgtaagtcctgagtgtagttacgctgacgcgttcggaagggccatactctattgcttgtgtaaaaagtaactggtttactgagattacgccgtttctatgtttaaatgataaggtctagcgccccgctttaaggcggggctttacttatcgagaaaggggaaacatgaatcttaaagcaactgtcgtagcgggagcatgtttcatcatcctggcttacgcacacggcatctaccagtatcgcagcggctggaacggaggccgggcgaatctcgtttcgcagcaacagcagaaagcacaggctgagttagctaagaaaacacaacggcagcagcaggatgaatcgaaggccgccgccgctgataacgaaggcaagacgaaatcagaggtaatcacccgtgaagtcgttaagtacattaaaacgcctggccgcagtgtgtgcacttttgaccctgagcgcgtgcagctcaagtcccgcgccgtcgcaaacgccaattccatccccggatacgacgatgatgcagccgccgtgcaaactggcactgccaagtaacgacgcggacgaggatttagctattgacgtccagaacacagaatgtgtacggcaactgagacttaaagtgttcatgttgcgggattacgtgaggaatattctggaatagttgccttgtatgttggaataatttattcttgacatgtaaatccgggtggcccggattccaacgtccaggggacatactgatgagcgaagaagtgaaagacgaaactatcgaacaacaagagactaagaccacgtttaccaaagaagaagttgacgcgctggtatccggtcttaaagctaacaacgagaaactcttgtctgaaaagaaagctgccgccgctgccgcgaaagaagccgcagatgcgaagctgaaagccgaacaggaacgcgcaaaacagaacggcgaacttgaggcattcgagaaaacgttgcgcagtcagtatgagccagtactcgccgataaagacggtaagattagcaaaatggctgagcgtatcctcggcgcggaacgtaaatcagttatcagccagttgtctggaatgttgattgatgagagcgcagcggatattatcgctatgatggtcaagaccgaatttgacggcgatgacgttgtgaccaagttcacaggtgcagacggtaatgtcatcaccaccgacgcagagcaatttaaaaagtatctgcgtgagcacaaagcattttcgcatctgattaaagcagatgcagcaaccggcggcggggcttccggtaacaaaaattctactggcggggccggtggtgcggacgtaatccagcaaaaacttaacgccaaatacggcaaacgaggataacagaatatgtctctgtcagatatgaaggtttataacgacgatatcgtcggtaccactatcgaactgcttggtcagaaaactgaccagtttaacgcagcctccggtggtgcaattgtactgtctaccgcttcatggcgcggtgacttctcccgtgagtctttctttaaccagattgcctccgctaaacgccgcgttgaccgttacgccgctatcgcgtctcaggcagctaccgcgctgactcagggcgagcatgtaggcgttaaagtcgctggcggcttcggaccggtactgttcgagcctgcgcaaatgacttggcttaacgaagacccggcaagcgcgattcgtgctatttccgaaggcttctctgacgcactgttagcggaccagctcaacaccgctgttggcgcagctgttgctgcggtatctggtcaggccgcgctggttaacgacgtatctgcaaccgctggcttgtccctgaacgtgctgaacaacagccacgctaaattcggcgaccagtctcagctgctgattaccgacatcatgactggtgctgcttatcacacgctggtagataaagcgctgactaacgcaaaccagctgttcgttgccggtaacgttatggttgtcgatgttctcggcaagcgttacgtaatctctgacattcctgcgctgtacggggccggtactccgaacaagactaaggtcctgtccgtagttgcaaacggcatcatcgttgataatgcttctgatattatcagcaacattgataccagcaacggtaacacccgcatccagaccacctggcaggcggattacagcttcggcctgaaactgaaaggctatagctgggatgtcgccaacggcggtaaatctccgctggacgcagaactgttcaccgcgaccaactgggacaaagctgttgccgagaacaagcacaccctcggtactctggcaatcgccgacgcggacaagtaatacggttggagtaaaaacaaaggggctacggcccctttttactaggagaaattaaagtggaaattaaatacgtaccaatgccaattaccgttgagcagaagcgagaatataaccgtcaggggttccgtgtggtagatgctcgtttcgcgccagaaggtgccgtggtagaatcgactaaagaagagacaccacgccgccagcgccgggcgaaatcagaggaataatttatgccgctaatcgtggaagacgggtcgatagtacctaacgctgacagttacgttagtctggctgacgcccgcgcgttagcggctaattacggtcttgggttaccggcagacgataccgccgcagaggtggccctgcgcaacggcgctacttatgttgggcttgcggaacctcagatgtgcgggcgtcgcgtatccgctgaacagtctctggcgtacccacgtacaggaacaacactaaacggcttcaccgtagcggataatgttatcccgtcgcagttaatccgggcacaagtaatcgctgcgattacgtatggtgcgggtactgatgttcgggctaactcagatgggcgttccgtgcagactgagcgtgttgagggtgcggtaacagtgacctacttcaacaacggcagcagtggtgctacgaccgcgattaccgctgcggacgacgccttacgcccgttactgtgtggtggtcttaacaatggcttctcgtttaatgtgtaccggggttaaaaatggcgaagactaaatctgagatatttacccttatagggcaggagttacccgacaacacgacggggcttatcactccggccaagctgcgcggtgttcttacgcagagggctgactcacctatttacgccactcctggcgttaaagaggttgaagttctccgtgccgcgtccactgtaatacaagcaccatccgcagtgggcacagcattgcagttaactttcggtcccgcgcatggtagcgcatctgacccggtaatgattaatgcagcgggtctggttacgttcaacactgcgggcaactacaccgttcgcatcaagttacaggcggggcgcactggagcgagcgggacgtccgtcctgttatcgcgcattcttcttaacggcgcacagtacggctcgccagcagctactaaactggtaagtgctgatactacaatcccgattgaatctcgcgtcgttattaacacaaccgcaggccagacgtttgccgttcagattatgcgggatagtgccgggaccaacttcggcggcgtatatccgcaagttgctaccgtaaccgcatggggtacagcaccatccgcattactggttatttcgagactggaggccgcctgatgaataagttcacatgtggtgtagtttttggttttcttaccgcggtagtcttgcacagttacggtgttcttttgacgctgcaagaggtgctaaaatgagcgccgctttcagtaaacgtatgcaaggcgtgggtacgcgcctgctaaccaaattcggtagcacggtatctctgattcgcgctggttcaaaagtatgggatgaagttctcggtgagtacgtctggtctgcggatgaagtgttgccgttgaaggccgttccggttccggtaaacgcgggactggtaaacggtacgacgattcaggctggcgacatgattgttaaagccgattacaacgtcgttccgaagatggaagacaaggtgcaattcggcggcgagcaatggtccatcgtagctattgagaagaagatggttaacgatgacgtcgtggcgtactttattcaggtgagaaaatgagtttcgcgctcgatgtctctaagttcgtggaaaaggcgaagaagaaccctgagaaggtgatgcgtcaggtgtctatcaagctgttttccgctattataaaggcgagtccggtagacacgggccgctttcgtatgaactggatggcatctggcggtactcctgcttccgggattacggacgctacggataaatcaggaaacacagcaaccggaaacgctacgagtttcgtgctgaaagccgctgactggcatgagttcacgctgacaaataatctgccgtatgcgcaacggctggagtatggttggtcgcaacaggcgccagccggggttgtcaggactaatgtgtctcgcttccagcaactcattaacgaagaagccaacaaggtgaaatgatgggctactttgaggacttaacaaaagcgttcgatgttccgctggtagccttcggaaccgccaacggcatcaaggtcgcgcttgaaaacatcgacgcgccgacgtcaaccgatacgccatatctggcaagttacatgttactggcggataccgagcaagcagatttgttcttcacggaacaacgcgcgggtgtttatcaggtcgacattaactacgcatcggtgaaaggtagcgcgccaatcaataaaatggcagacttacttaacacggcattcaaagcaggtaagtcattttctcgtaacgacatctgcgccgaggttcaatcggttagcctggggccgctgattgtagaaaacggatgggccaaacgaccattgtcaattaactttattgcattcaccaagaggctgtgaatatggctacaactccttttaagggcgcgaataccgcgcaattctatgtggcggaagtcaccccgggcgtaacaccgactaacccggtctggtcaccgttgcgtaacactggcggtgttcctgctatcacccgcgacacgctgacctccaacgaactggacggcagccgtgaaactacatccatccgcaccggtaacaaacaggttagcggtgaatacgcgatcgagcttagctcgaaaagccaggatgactggctggctggtgctttaggctctacgtggcaatccggtgtttccctgtccagtctgtcgattaccgtcgcaccggcgggcaagacgttcacacgcgctaccggcagttttatcactgacggagttggggtaggcgacctgattgcatttaccgatttaacaggcgataacgcaaaaccatttattgttactgcagtaacggctacggttgttactggtgcgggcatccaacacaccctgaccaccgagacaaaaactagtaaggctaaaaccggcgacacgctggaaaccggtaacacgtgtaagacgttctctatccttacctggtacaaaggccagtgcggcggtactgacgcgtacacgttaaccaaaggcgtggaagtttctggttttaccatcgaacaggctgttaacgcgatggtaactggcagcttcccattcatcggtcgcagtcaggagattctcactacgccgccgaccggttccaacttctcatctgttacttttggtgatgagccgttctcttcggttgacgtttccgtgttcgatggctctacgccgttgcgttgtgatagccttaccatcaccaacgacaacagcgcgtccgcgcagttcgaactcggcaacactaacgtggcctttgtggaacgtagccgcgcggctaacaccttctccatctccggcaagctgtacgacatggctatgattcagaagtttatcaacgagcaacaggtagagattaactctattctggcgggggtaaacggggctatgtctttcagtttgaaacgtgcagaacttacggcggttacacctgagattggaggacctgagtcaatcactcagtctattgaaggccaggctactggcaaccagtaccagtcgtctattgttatccagcgtatcacctacgcataaaactaaggccccgtttggggccttagttttttttttcttacaaacctaattttaaagcaatgtctataacgttcgatttaacgtcacccggtatgatgtaggtgtcgtaatcttttacaccatcaacgccatacagataaccacggctgtccccctcaaacgtatagccgtcacgatgaaggcgaacgattcgcacgtcatgcccgacggcgacgataggggaaacttcactggcgaatcccccgtcggacactacaaaaacttcgttgccgtcgggcaatcttccggcaagatacttaccgaaataatcgtcaccgaataccggtttaatgaattgctcagaaatggcaatcatgaactgacgccgagacaacccgttaaggaaaccctctggcttttctttccgcgcccggtcgtcgtagccgtcgagaaactcgcggtaagcatcctggcctaacgcagccatagcaatattgaacatcggattcttgaaactggcgacacccttcgcaaagcccatttctaccagcgccctagcaagtgtgtctttcccgcagcccgcaggaccattaagaataattaccttagccattatttatcactcccatgtggttttaagtgtgtagagttcccgttacagtcgtattcagtaactgcgtgagtggttatgccgagttcgcggaaatgctttattaccgctggagagtcgtcgaatgcacacaagattctctccggcccaatagcacgcaacacctcttctttaattacgatgtcttttctgttgtcgtgtttgctgcgcatgattaactgataaaattcgacgcggtggcgctgcaaccacattctggtttctttttccgcgtcatcactacggcctgttaagataataacggcatagcgacgattaagggcgttacacagttcgatgttatctttaatgggtgcatcgtctttgcacgccatgttaaatggtttccacgcccaggtttcgccgtagttatctttcggcagcaggtgtaaacgatgagtaccatctgccaatgtcccgtctaaatcgaaaatcacaatatctttcatccaagcatctccggtgaaatagttaaacgtgcgacctcgccatattcggcgctataagtaattacgtttgcactgcggcccgacatccacccaccgcgggaggcatatgcatctttagccgcgagagtgcggtgttgctcaacaatcatgttacggctttctacaatcttttggtggtgcaggtgacccacgtgggcgtagctgtaaacactctcgccgaacgctttgcggaacttggcgatcataaccggttcgatagcatcgaagcgtgctttatggccgtggtgaaagaacagcgtagttttgccgtgttgcaccatcttgtaaacatccggcgacgtatcgacgaacacacgcggctcattgtcgtacagcgtactaaacatctcagctaaccaaatcattccgctttcgtcgtggttaccttgcacgataagcaagcgaacatttttatgtttaacgagagccatatcaatgacacggcggaccatacgaatcatgtagcgtacaagtttctgatagcgggtgtcagcgtcaagaacatgaccactggcaggtgtaacggcgtccagactatcgaaatgcgcaaggtcgcccagcagattaataactcctgttccggcatccggtgctttctggaacgctgcgtcgaaccagcgggagaacaggtcttccgcaatcttcatgtcccagtcgtcgccgctctcgtcagcccaggccagcataccgagatggaaatcagacacagtgtaaaggttgagtagcttgtcgtctcgtttggcgcgaacggctttaacaggtgcaactggtgtaatctccgacttcatgccttcgattacggctttcatcaattcaacctgacgttcggcatcggtgtcggtcttaacccattgcaacttggtgttgccaaactcatccaccagtgatgacgttcctttaatcttgtagccgtccggtacaaggtaactaacgtcacgcccgtggcctacacctttcttagccagcttcgctttacggatacgaataacgcggtcggagatgccgtatttacgggcgatgtcgatattcttcataccggcgttcaattcttcctgtaactgttcgtcggttattttcttcctggccatgcttattcctcgtgtttaggatttggcctatactagctcacttctctttgacattcgagttgcacgcccagattaagataaatacccacggcagcagaatccagccaagaaacaggttagccatgaatatcgctaacttcgctttatggctacgcatatgggccactaaaaacgggataaaataaactaaaacgataataattaagaagaacatagtaatacctgtcatggtgtagttcctgtttgagttaacattgttggtgtaagtgaatagtatcctattatgttggggtgtgcaagtaatgtgttagaattattttgcgcctagtgtcgcacacgaaaagcgggtggttcccgcctggcgcattaaccttaaccagtaacctcttaaccaaaggattaaataatgaaactttctgatttttattacgaagctgaggccgaaaaaggcgcgcgtatgccgatccccctgaaagatggtacggactcaggggaatggcttaatgttgtttctcctgaggcagacgttgccgttaaggccatgcgagcatttacgctggcgtaccgggcggcgttaggcagactgaaacagcttcgtgataaatgcgaagagacgaaagatttctcggaatacaacattaagatggaagacgcagcgacggaccttaaccgccagttagcacttgaactggttaacggttggagtctcgacgatgaatttaataaagagaacttgaatactcttttctcacagtataaacgactcgccgaacacgttgttgttttccataatggacagcttcgccaattgcaggaaaagtagacgcgttgctccagttcgcccgttggaacttcataacccgccacaaacggcgggaatttgacagtattgccgatgggcataaagctgcgctaattgctatgggggttatgcaagacgcgccggaagcaacgcaggacgccgggccagaatgcccccctgagctactaaccaccttcgagaagtaccgggaaatcaaatttacccgccgagtggatgacgacggcatcaagatgtacccgcgcgaacagttacgatggtcggatttagtggcgtacagcaccgtttcaggccagaatataggcatgtttgaatctgacatcatcatgagcttagacgctattttcgagggtagaaacgatggctgatgtagctagtttagttgtaaaagtatcggagcaaggcgcgaaagctacatcagaccgtcttgataacctttccaagtccgcaaaggtagccggagctgcggtagcgggcctcgcttccatcgtcgccgctaccgcgtacaaggccgcacaggaactggtagactcccaacggcaactggacaagatgtccgccagcctgaaaacactaacaggaagcacgcagggtgcaagacaggcattaagcatcctgcaagacttcgcgcgcgacaccccgtatggtcttgaacaggcggtagaaggattccgtaaacttgtggcgcttggtcttacaccgtcagaagaagcgttgcgctcctacggcaacaccgccgctgctatgggtaaagacctgaatcagatgattgaggccgttgcagacgccagtacatttgaattcgagcgccttaaagagttcggcatcaaggccaagcagaacaaaaacgatgttgaattcacgttccagggcactactacggtggttaagaagagcgctgccgatatcgagcaatacctgctcaacattggtaacgtaaacttcgcgggtgctatggcggaccaggccaacacactcaacggcgctatagccagcgccagcgattcctggtcgcagttaaaaatgacactggctaccagccttgatgttggtgcgcttgcaggacctatccggtacattgatgatttaatccaggaacttaacgcacaggtagcatccggcgaacttgccgccgagatgcgtatgtggggtgacatcgcatcagaagtaggaagcgcgatagagatgtcgttcgatgccgcttttggtttcgtcggtgacgcgataaacggattaaatgaactttgggattttagcagtaaaagtattaccgatagcggcgaacaaacggcgacaaccatcgcggaatcagccgccgatgcgctcgatttcatcgcggaagaatttaccgcgatggagcgcttctttgaagatatggttaaaggggcgcaggacgcaggccgtttagtgaaagcggccctcactccgggggaatcggtagatgtagcaaaaaacatcaacttccaacttggtatggccctggacacccagcgagatgtagcagacctgacgcgtaaaagtttccgtgagcaggtggaggcgcagcaaaatatcatcgcgcttaaacgagcggcatacgacatagacaaagaagccgctaaggaagaagggcttagtaaatttaaggtaactggtaccggtggtgaatccgaagatgatagcaccggcgtaaaagccgctaagaaagctgcggatgctttcgagcgccagaagaaagccgccgaggatttctactatcagtcgatccatcttaatgatgacgtattccagaaaatagaagccaaccaggaacagcagttatccaagctacaagagttttacggcaatcagcttcttagcgaccagcaatacgagaacgccaaaacccagattattctggaggcggacaccgcacgtcgggaagaacttgctaagcgggagaaagaacggcaggaaaagcagcagaaaggcgacgacttcattgctcagattatgggtcagaatgccactgagcttgagcttctagacatccaggaacagcagaaactggcggtagccgataagtaccgtgagcaggggcttattagtgagacgcagtatcaggccgcgcttaacgccatcaacgagcagtacgccacgaaacgtgccgacgcaacggcaaccgcctttggtaacatggcttcaaacatcgggtctgcgttgggcgaggcttctggtgcgtataaagcattcgctatcgtacaggccactatagccacgtacaccgcagctattgaggcgtacaagtcaacggcagctatccctgtagttggcccgttcctggcccctgtagccgctgccgctgccgttggtgcaggtatggcgcaggtttccgctatccggtccgcgcgtgaacagggcggacagttatccgcagggcaggcttccaccatcgcagaacgcggtaaaccagaagttattatgccggctggcgcatctcgtgttcgcacagcacagcagatgaaagaaattatggggcaaaacgggtcttcttccggcccgtctaatgttactatcgtaaacaacacgagttctcaaatcggcaacgtatccactgagcaagatgatgagggccgtttgcgaatcatcatcgaggagcaggtggctgcctctttgcagaacagcaacagcaagattagcaaggcccgcaaagccacaagaaatgcgccggggtttaaataatgaccgacttatatttcccacgtagccttaagcctattgtgtcgaaaggttactcaatgaccagacgtaacaacgtctggagtgtcgatttagccggtggcggggtgcgtcagggccgtgacacatattacgacgtgttccctgttagcgtaaccctgattacatccgcaatggggcgacaggcgtttctgtcattccttgaaaaagtagacggcggtgcgtcaagtttctggatggcgcacgacttcggcatgggtatcgaggattatcaggtaaccattacgtcaaccatcgcggaatccaccgaagacggcattaactggacgattactttcacggcaaccgctgagaaatcgccgttccaggaccttgagaaccagtgcctgattaacaatctgccggatttgtacggttgctatggtgacgggctggggtgtttccttaaagcctacggaactgcacaatcaacgtttccacgaatttgggacccgatgcaatgagccaggaatcagtagaagcagcctatcgctgtaagctggcgtctaacccggacggcgagatggactacatcacgttgcaaatcagccacccgttgctgtcaaagacctactatcttgtgcgcgggctacaggaacttacagcaacactggaaaccggcgaaacaatcacgttcgaacccaccccgatggaggcgtcgggggccgctaacaacagtgatatggaccagacgacgacgtttactctaccggatattctcaatcaactggacgatgagatggataaaatcccgatgagcaataccgagttgccgaaatttgtcttccgccgttacgtcagcaccgacctgtcttacccggctgacggcccggtcgtgtacgagttgcaggccattaaccaggagaagggagagttttctgcggacgtcggtacacctatgctgaaccaacgaagcactggtatactgatgacacctaaagagataccgttattacgcggcctgttgaccacatgaatattaacgactacacgggcataccttacgactttcgtaaacgtaattgctggcatcacgtgcgcattgtacgggcggatgctgggttagagacaccggcgttcgacgtcacaagcccaacggcaattaatgaagcgttcgacgaaggccatcgtgacacgaaggggcttacgaaaatagataagcctgaaaacttctgtgcggtgcttatggggtatcgccgtggtggtcgtatcgtgtggcacgcaggagtatacttcgacgggatggttagccattgcgagcttgcttctcgtcaggtacggcttgacaggctggcggacctcagagacacgtacacggagattgaattttggcgataatcctgcactacacgcgaaacgctgatggcgctttcgaccgtacaaaacacgtcgggatgccgatggagtttgtcgttaaccgtatcccggacggcgtgccggtgcgcgtctacctgggcgagattggcgatgatactgatgtcaccgacgacttcgacgcgcttaaagatgaagacgctgtgtaccacattattgagggtgcgggtagcggggcgctcggtgcggttagtaaggtgtttggttttatccttaagccaatcgccaagttgtttgggttgaacatgtccgcaaacgccaactacacggcgactaacaaccagacaacatcgcctaataacagtctcacagaccgctcaaacaaaccacgcccttacgagcgctcttatgacatctgcgggactgtgcagacaatccctaacgacctgatgcagacgtataaagcgttcaactccacgggtgctttgctggagtattcgtattatgacgcggggcgtgggcatctgcatattgaggctgatggcgtaacggaaggcgacaccctgataagcgacatcacaggttcttctgttgccgtatacgcgccgtatacttccccgaacaacaccgcatcgccgcaactacaaatcggcgacgtcgttgaccagaaactctatgtgacatactccaacgacgacgttgacggtattgtgctgaaagcaccaaacgacatcggagctaacccaagctccgacggcaccgccaaacgtatttcaaacaccggctacatttatgacccgtcgggtgactctgctttttctgagtttcttagcgtcggtgatgtcgcagtgttgagcaatttcgacgttgctgatgtcactaacctgaacggctcgtttgaagttttatacgtcgacgacttcgaagtaagattagcggtaaacagtgcgtctaactgggcagcgttgaccagcgggcagacgtacacgttaacagagcgttcagatacgtttatgggcccgagcaacacctatgacgtatcccttaccgactggtattacatggtgcgcggagaagttgaccgagtacttgctaacgttgccgggcagaacggcctctacaaatacgacggcggctataatcgcaccagcgtaacggtagaactccagtaccagatgattgactctcggcgcaacccattgagcgatatttacacagtacaggctacaattaccggtaatagcacggattacgtcggtacgtctatctacgggcaattgcctactgcatcgcgtttccgcgcccgtatgcgccgtataacgaattttgataaggactataacggtacagtaagcgacgagataaccttcatcaacctgtacgggcagtcgctggacacaaccccacactacggcaaccgaactaccgtgcattgcgcacgtaaacagacgccgcgtgccgccagtatcgacaacccagaactgcgcatgattgcgaccgagatgtgctacaaatatctaggtaatggggtattcgacccagtaatgacgcctaatacacaggcggtgcagtcgctaatcagactggcgcgtgacccggcggttggtaatctggagctgacaacggcaaacatggacaagttactcgccgtgcaggaagagattgaatcttattttggcagcgaattagccgggcaattctgctacacgttcgacgactacgacacgacgatgcaggacattgttcagaccatagctgaagccgtgttctgtactgcgtaccgtaaaggcgcggacattatgctgcgtttcgaccgtccggttgcagggcctgaaatggtgttcacccaccgtagtaagacgaccggtacggagaaatggacccgcacgttcaacgattctacgacctacgatagcctgtcgttctcgtacatcgacccggatacgaacgtacaggaaacgatttatatcccggaagaactcggtgcaaatacggaggaatacgaatcaaagggcgtgcgtaactaccaacaggcatactggctggcgtggcgtcgctaccaacgcaatgtgttaagtaaagttgtcgtagagttcgaagctactgaagagggtgcgctcgccacacccggcggcgtaatcagcgtggttaaaggttcacgtattgcgccacaggacggctatgttgttgccgttaatgggcttacgctgacgctgtcacagcccattacgtttacccccggcgatgaccactccatcattcttaagaaacgcgacggctcggtgcagagtatctctgttatcaaaggaagccacgaccgcgaagtgattatgctctccgcgccggaagaagcaatctacacggggaatagcgcactaaaaactgagttttcattcggcaacgaagcaaggcataatgctcagaagatagttgtttcttcaatcgaccctggcgacgaccgcacggtcaagattactggctacaactatgacgacggattctacaaatacgacggcgtcgcgccatacggcagcggtttctccgacggattcagcaatggttttaattaaagaggactctatatgtcaagcggatgcggtgacgttttaagcctggcggatttacaaaccgccaagaaacatcagattttcgaggccgaggttatcactggcaaatccggcggtgtcgccggtggtgccgatattgattacgcgacaaatcaggttactggacagacccagaagacgttacctgccgtgttgcgtgatgctggttttaaactggcagattttgatttcacgtcaggcggtacactatccgctaacgaccgaaacaccgcagttttgtggccgtcgtcctctggcggtgacggggattggtactattggttgggtgctctaccaaaaattatcccagcgtcatcctccccgcagtccaccggtggcgtggcagatggggcgtggcagcctgtcgggtcggtcatactgcggcagcaaatatctgatgtaaacggtgcaattctgtacccagatttacatgtggcgcgatggaaggacgaatacgacccgcgcgcatggggcgccgtgggcgacggcgtaactgatgatactcaatctatttttaatgtattagcagcttcccccaacaattggattatagacggcaggggtttgacttataaagtttcccaattacctgacattagtaaatttaagaatgctgcattcgtttacgagcgcgtagccgggcaaccgcttacttatgtagctgatggcttctttaacggctcactaactaaggtgacggataccccgttctacaacgcatggacgcaggataaaactttcgtctacgaccatgttatttacgccccgtttatggcgggcgaacgacatggtgttcaaaacttacatgtagcttgggttcgctctggagacgacgggcagacttggtcaatgcctgagtggttgactccaatccatgctgactataatgctagtgtttctacgaacagagttaactaccactgcatgagcatgggtacgtgcggcaaccgattatatgcagttatagaaacccgctacttatctaatatgcggatgaagaaggcagaactttggtcacgcccaatgccgtattttagacacccaaccggcggaataactattagttctggctccactactgctaccattgttatagaaaatcatggcctaaaagcaggagatgcggttaacttctctaatacatcggcaactggcgtatcgggtaatatgacggttgcgtctataattaaccgaaatacgttcactgttacgctctcaagccctgcgagttccaccataaacaatgcgggtgttacctggaacttcgcaacgcgattctgggacagcccgtgggaaattaccgaattgccgggggtagcatactccactaacgctgatttgtgtgtcacggagacacatagttttgcggttatagatgatactaactacactatcgctgtcggctatcacaacggcgatgtgtcccctcggcgtctcggcgtcttgtattttagtaacgtgtatgacaatccaggcgtattcgttcgtcgcactgtcgctcaggcatacgctgataacgcttctgagccgtgcgtgaaaagttatggaggtgtgctctaccttaccacacgcggcacattacctacttcccctggctctacactggcgatgagcaccgattcagggcaaaactggagctacttgcgatttccgaacaatgtacatcactccaatcttccgttcgctaaagtaggtgactatctctacatctttggtacagaacgtgccttcggcgagtgggaaggtggcgagcaagacagccgctatgaaggttcgtatccacggacctttatgtgcaaagttaatgtgtcgtcatggccctcatctttagatgatgttcagtggtttaatattaccgaccaaatataccagggtcatatcgttaacactgctgtcggcgtcggctcggtctgtgttaaagatggctggttgtactatatctttggtggggaagacttcttctctccctggagcatcggggataacagtgcgaagttatggtacaagcatgatgggcatccggctgacttatatagctaccggataaagattgaaggccacccgtatgtgtcacgtgatttcaaatacggagcaactcctaaccgtacactacctgtcgcaatgggtgtagatggtgtccgtcatgtagaagcacctttgacgtttgacaatgatataagcgtgtactccctgcgtgtaacggggttggaatacgatggcacacaacagtctgccgtgcgtgcacggtttgatggtgattacgggctgatttcaaaaacagtcccgactaaaactccatcgggtcaacgactgattgttagtggcggtgatggcgcatccagttccgacggtgcattgctgcaactgtacgggtcgaaccatgcaacgcctaacagggctattatgtatgcgtcaggaggcttctactcatacgacaatttccttccttacttagactcgcaagtgtctttaggttcggcaggtaataggtggactacggtgtacgcgaccaccggtacgataaacacgtctgatggtacacttaagacgaataaagaggaaattgagggacaactccttaccgcatgggaggatatacatgtaatatcttttaagtggcttgaaagcctagcaatcaagggtgacactgcaaggatacacttcggtgtgatagcccaagatgtgcgagacatcttggtcaaccatgggcttatggagaaagattctaccgattgtaaatatgctttcttgtgctacgacccaattgaagctgcgtatgatattgatgaagatggccagactgtacaagtatcccctcccggcggcagatggggggttagggcggaccagatgttcttcatagagattgcctatcagcgtaagaagatgcgcgagttcgagaagaggctggcagcactagaagataaataaaactaaggccccaaacggggccttttctctactcttcggataacttttccagtacaaacgccagttgcgcattagcggcgtctctttgctgccgtagtcgcagaacctcttcttctagttccttgatacgtttttgcaatgctggaatcggggctatgatgttcatttcttacctcttctcttcatataattaagcaattcttcctggaccgatttcttctcgtctgtacgcgcggcaacaacctcgtcaagagtgtctttagcgactatgtgataaaggaacaccgggcgctcgtggccagcctgtttctggcggaccgggcctatacgctcgacaacctgcaaatagtgctcaagattccagccttgcgaaataaacgccagatgatgcccgccgtcctgtaaattcaaaccatgcccggctgacgccgggtgcacgcataagatttcgatttcgccacggttccacgcttccatctgcttattacccttcgcacctttggcgaacgcctgcgcctgcgggaatcgcttaaggatgcgctccagttcatgcttaaactgataagccacaagtaacggtgcgccctgtaactcctcgacaatggactcgagcgcatccagtttcgtatcgtgcactttctcccagtctttcgttgcctcaccgtccggccctgacacatatacggcgccggatgcaatctgcaaacactttgacgtcttcgctgcggcgttagccgcttctacttccccgctctccagttccgcgaataacttctcctccatatcgatgtacgcctggcgtgctttcttcggcaggtctatttcaaccggtacgataatcggcgcttcgcaaccgaaccactcggcagcgtcaatcgtgagactaatgtctttcatcttctgatgaatttcattatctgcacccggtcgcgcatgatactctcgcgccatcgccgacttacctttctggacagagttaaaccatcggtcggtgaatgccgtgtatgaagaaccgaggcgctcgcctgcgtcgataaaccagttctgaccccacaagtctttgaggccgttcggtgacggcgtaccagtaaggttgatgaaacgcttaaccttaccgaatgccactttactaagcgcctttgcccgcttgctgccacctgaacggctacggaaagatttcagtttcgtgctttcatcggcaacaataaccgtaaaaggccagtcgtctttgccgtagtagtcaatcagccactcgataacttcgtagttagtgcacaccacgttagcatctgactccagcgccgcgatgcggcgtttctctgaacctgtcgcatctacgacacgcaggcacgggaatcgccatttctcttgttctgccggccatgtacctgatgcaacgcgcaacggggcgagaattaacacgcggtcgtcgtccgtaagttgcccgttgcggaacaggcggtttaaagtccacaggacgctgccagtcttcccggcgcccatgctcgcccaaatattacagcgatggtgctgcaacatgaacgaggtcatgagcttctggtattcgcgcctttgaaacttactcatttacggcccccataaacgcctttataaattcggcggctacttgcgggacgatggcattgccgtaaccgcgcaatcgtcccactctggcgggtatcccattagccagcgggaatgcgccgggttcaaccggccggaactttccatcacggcatccgagccagtcagcatctgaccagaagccgtggtgcgggttggttgactcgctttcaatccctgctctgttgagtagtccagcctgtcgaatgttctgtccctcccgtccgtgcgaatcactgtctctccactccctctgaagtcgttcgctgtcggtgtaggccagttcgtgcgcgccaaagaagagtcgttctcttttgtgcggtgcgccgacgctacaagctgggagtacagcaaacccgacggcgtagtcttctccttccaggtgagcttgtaaatcgcacatccacgattttgcaattgctgccgcaacctgctccccaaagatgactggagggcggcactcgctgatgaggtcgaggaagaccggcgcgaggtgtctcgggtcgaactgtccgagttgctttcccgccgcgctaaacggttggcaaggcgggcttcccgtccagagaggcgcatcttccggaactcccgcaagtctgagcgcgagaggccagccgccgatacccgcgaaaaaatgacactgggtgaacccgtcaaggtcttctggcttaacttcggtaatgcttctttcatctacaactccaaaaggtatgtgaccctgttttatcaactcacgcagccacgcggctgcgcctttatcccattcattgtaatagttcatttcgccaccagaactaactctttacgcccgaacgccgtaacgttaccggttacatcttcgataaccagtttaccgttcgactcgacgaacaccgtatcaacggcaacaggttgacgtgtcttaacgttgaaaatcatgtcacccggtacgatgtcacgtgctggtttgcggtcatattcgtgtttcatttctcaattccttatattgttggtgtatgactaactataatagttcgctattaggtcgtcaacctgtttaaacgaaccaacgacaaaaacattcgcaccacgtttacgcatacgctcgtgctcacgtaactggtgtgggtctggcttcgtgttttcgtctttcttaacctcgacgaacaagacgatgccgccgggtagaattaccagcaggtcgggagcgccggagcgcccctcataggaaagtttacgaacgaggccgccgatagcctcgaatcgctcttttgcgtatttctggatgcgcccctctttagtcatgggcgcagaatccaggtaatgaaagccccacctagaacggcgacaccgacaaacttaaagaacaggccgtaacagaacatcgcggctattcccgcaccgagtaacagcgcgagcatggttactatcgtccaaaatacaaacattgtcataatacgcacccctcacgtttcgtatgttcaataccgcagcgcgggcagattcgacagtcttcttcataaaaccagtaaattttcattccagcacccacagataaattgcgatgaacatgcccaatatggcaaccatcatgccgtattgaccctcgtgacagtaaacaccggcggcgaatccagccagtaccgcgataatcagtttacttggcataacgcttcatctccgcgccttctgctacaagagggaacccctcggcccactctggtaattcgcacatcaatcgttccagttctgcgacattgtattctggtaaatctggtgtctcgcagataatctcatcgtgaacatgaagcacaatcgggtagccgtttgcttcgacgttcagcagtgcattagccagcaaatcacggcacagcgcctgagtgcagttttccaccagtttaccagagtaggtgtactggaagccccactgacgggttaactggttttcgccctggtacttgatgcgcacgttggtagacaccctcccgtcttcgtctgtctctttcgacacgcttagcccaacacccggataagacataacgcggcccgacggcaacgtcatccgcaaccaccaaccggcgactttgttgccgttgttgtccgtttctacgttgcgcgaaaacttaactccccgcggccctgcggtgaactctttgcccggattgcggatagctgccatagctgcgtcttcaatatcccgccagaaagctactgtttccgggtgtgactcacgccacatacgcttgatagcgtcgcaggtacgccacactttcttatcaagaatataagatggtcggtcatcattttcacctggacgtggtggtcgcttggcttcctgaatacgcgcccactcatatccacgtgcggtagcagcccagatgtggtcagggaaagtcccgtccattgtttttgccatatcaacaaggtcaaggccgaggttcttggcgaactgtacgaatgcgccgacaccacccgcgtagccaagtccaagttcacatgccttaccaatctggcgtaagtctttacgttctttcttaatgtaatccggctccatgccgaacatcttgcctgcggttacgcagtaaatatccagcccggcacggaacgtatcaagcgcggtttcttcgccagccagccacgccaaaccgcggccttcaacgttcgagtagtcggcgacgacaaacttatgtccggcttccgggataatgcagctgcgaaccgtagatgccgttagcttggctacatcaaaacggcgatgtgctcggcccttaagtaatgctgaaatacctttatccagttcatcatcgtgatagtacccacgcgccaggttctgcggctggaagcctttaccagcaaatcgtaacgtacgtttagctccaccatactggatgcaaccgcgacggcggtcgtcagacgagcggcctaacagcagcgggttatatttcgttgacgcagtggatgccaccccgaggcgcatttctataatcgtgcgggcgtcgtccggtaaatcatcgtcagcaagcaggtcgttaagcgtagacttctgcgcgttgtggatgcgatgcgcaggcgccagttcacgcagaatcggcaggaagtccttacctgtaagcgagccgccgtatttacgtcgggcttcttcctgtaactgtgccttgtgtttctccacagcttcaattgcggcttccgccagcgcaacgtcgaccttaaacccgcggtcgttaattaactggtccagttccagtacacggtcttcgaactcggagttaccccaacgcggcaacttatggaacacttcacgcatcgcggtgatgtcgctaacggcgtacttgatgaacagcgcccactcatccgggtgcgtttcagcagtgtagcggcgaattttgtagttcttcggcgtcggtttagagaaacgctgaataagcgctttgcctcgtttgtctttcgcgttgtctgcagacacgccaagcacttcgcacaatgcgtcgagtgaacccggcagcgcgtgacgaaacgcccaaatcatcgtatcaatggtgttgcttacgggaatatcaaaaccccagcagtgcttcatgatgagtctgtcgaacattgagccgttgtgccacaccatcttaatacggctgtttggtttcaccagacggcgtaacgcgcggtgcaaatcacccggcatgtcgccgccgttggtgcaatcccatacctgtacaggctcgtcgtcaaaagcataggtacagataagcacttcggtagtctggtgttcggcataagcgtaggaaccgactttctttaaatcggctttggagaatgtttcaaagtccaggtataaatagctcatttctttttccttaaatccagtgccttcgttttgctgagtcttattttcatacaatcacggcaaatccacacatgcctgtacccggcgcggtactcatccgcgtaccacggaagtggcttcatatatcggtatacgtgcttacagaaaaacattattttcgacccttagtaaaaaggcccaatgaagggccttagttaaattgattcagttattaacggcgacgacgttcgcggcgcggtgcttcatcttcttcgtcgtcttccaggtcgttgacgcttgcagcgactttagaaccaccgaacgctttaccttcgcctacgtatttaatcgccagcaggttaaccccgagaactttatatttctggctgaaccagatttcgacgcttacgttagcgacgcagccgctgtaaacctgttcaccttcaatctgttcgccgtctacattgaagtcctgttctacctgagtctcgccttttttagaggttacaatcagtggctgtttctgtgccttcgctttgaagtagaagccttccgggaagtcttcaaacggattgtcacgctcggcaatgtctttaatcgcgcatttatccatgtgctttccttcgccgtagttggacttcatccacttctctgcggcggctgcgcctaacgcttcttcaactacagcgtaaacagtgtcgtagagcgcatcgatttgagcatggtcagacggcaagatgatagtcgcgctgtactggcctttagtgatcgagccatcatcgttttcacggtctttttcgcgttcgaatacgttaacccaagcagtgtttactttacgcagatttaatttaatacccatcttaatttctcgcttttcagtttactccgggaagctgcccggccagtgattagaactataatagctaactattcaggtgtcaaccctttattccaaatcttcttcactaacccgattccactcaggccgtttatcgtccaccgttgcaacacatggcgcacctggcttacgggtaataaacggctcaagcgctgccatctcatccgcagaaagaacttttgctgcctccgtaggggacatcaatacctcttttttgagaatgtcgccgtgtgacacttcaatcgcatcggcatctttccacgcacgattacccgggcgaccttctaccagtttgtaccctggcactttcttaccggaatgcaatgcggcggacatcgctttctcaaccttgtcgatgtgctggcgtaacagcggcaacttctcatactcaactacgagttgctccgtcgtcagttccagcacaaagtcgtcttcaagttcttccgccagtacagaattaaccgtctttgtacgcgcggcacactgttcagagaaccggcaccactggcaaccatcgaccgacggtttaaagtccgacgctttcaggttcttctttccacggaaataagcatcaagcgctaacagtgcccgtttctgtgcgaacttagcgaacagttccagaccttcgaccgagatatcccactccgacgcacaccccgcgtacggctggaagatgaccaggcgcactactgtgatgttataacgtctcttgagtcggcgataaacaccgagagcgtaaagcataagctgcttgttttctttcgcttcgacgcgatgccgtcctgttttcaggtcaccaataatgagcatgtgctcgtcggtgtttgccagttcctgtacggcaacaaggtcagcagttccgaacgtttcaacgccttcgtagcctgggtgcaacacctcagtaagattgacgcgcatttccagcttagcgtaagtcgctacgtcgataatcgctttgcagtagtcggtgtacttgcgcacctgctcaatcatgtccgccgtaatcagtaccgcgcctttcattgggctgattagcgccttaatctggcctttaccttcatccagcacgtaagcgccgacttcacgctctaatggcagagcagtgcctttgatgtactggttaaggtgcatctccgctatggtgtggcatgcagtccctgtaacggcggctttaccagacgtgttgggaatatctttctcacaggccagtgatgcactgcacgccagccactttttagcgccagacggcgacagtaaggcgtgcacatcgttattgccgccgcgttcctttaaaatcataccctgctctcccactggtcaattaaatgtcgtgtctggtgatggcaatgcatggcccacccgtacatcgactcgaagacataaaagtcaggtttggcgaaagtcgtgcgcttaatctgcgacacgtgacggcctatatctttaggccgtggtactttgcctaagtacgccatctcttccatctggtgcgagccagacggcgcacgtaacagccatagcgcctctgtgctatcccgcctgtctacggcgcggtagagttggtaaatcataattccgaccctcagttaaagcggcccgaaggccgcgggatagttattcttcttcgaaatacttgttcttgattgctgtcaggcgttccaggtattcagccaggtcttcgtctttaatcgcagcaatcttcatcttcttaccggtaaactcttccagcagttcgtcagaatcgtcgcacgcggcatcgcttgggccttcgttaatcgcatcgtcgatagcctgaatctggtcacgaagagactggtagtcgacttcttctttctcttctttctcttcttccggctctggcgttggttcctctactttagctttacgcggcttgcgtttgggcttctcttcttctgccggtttagtgtcaacgacgtcttcaccttctaccgggatttctttcgttacttctttcacaacagtaggctctattgttgcagtttcggcaacgacaacttgtttcgcactgttcgcagcaatcagttcatgtgcaactacgaaacgttccagtaatactaagaatttctctaacattatttattctcctctcgtttggtatgggctaactataatagtgaactattcacttgtcaatgggcttttctaaaataattaatatggtactattcacatatcaactgactaaggagtaattgacatgctaccatctgaactaagcatccgcgtagaacagcgccgtaaagaactcggcatctcccagcgccgtctggcgatcctcaccggcgtttcccagggcgctattaaccagcttgcgcttggggtgactcaggacgtccgcccggcgacgctgtttaaactggcggaagtgctggaagtagacgccaagtggctggcgttcggtgaaggggcttaacgcccctttctttttacctattccaaatcttcctcagtaaccactagcatttcattcggttcgtatattgtcttcggccttaatctatccactattctttcaggtatacgatatgttctcggtactacttcgccattaacatcgcagcctagcattagttcgccatctttcagcattttatcaagatgggtgttagtcacagaaaagtcaccggaacgggccactatctgctgctgggtaaaaccgcgacctgtatcatctgactgttgcaggtcttccagtgctgaaagtattgactccttccttacttcatccctgccgcggttaactttttcctttactttttgtttaccttcgttagttaacccttcttcccgctctttctcctcgtcagttttgaacggctcgaagccccacggcatcagaacaagcgccttgtgtggttccggcaggtcgaggtttacgattgtgccgtattcctctgtgctaccgaggaactccaccgcgcggtactctttcgctggcggtgcttcgcggaactgtaccgactcaagcaccattccaaccgttttctgttgggggccgtgcttaaatttcgagtggtatacgtttatctgacggtcggttgcacgttcgattgtcagttccacgtcgacacccgcatacagcgccccgctgccacgggctttctttccccccttcggtgtatggtgaacaacgcccaccgcggctttggttgcgtcgcgtacttctttcagtatggcgataactttacccatgccgattgtcgtcgacgaactgttctcgtcgaacttatcaatcgtcagggccagcgtctggttaagggtgtcgaatgcgaccataccaataggctcgccgttggcggtttcgcgcatcctgcggattagcgcgggaatttttttatcaccatgcgccgtgagtacctcacccatgtcgatgacatgcacataatctttaccttccctgccatatttagccgcgagtgcgtcaatacgtgtgcgtgtagctgcgccaccttcaccgtcgatatagaaatggtggcaacgctgggtgtctgcccccgcaaaccggtacccggcggcgctaaggtacatcacccccagcgtatagaatgatttatatgtgccggattccccgacgatgtcccagatgcaatccgatggcatgtacccttcaacgacgaaatcagcctttaccggttcaggtaactcgtcatcgtcttcaaggtcttccagtgtacaagttacaggctcctcgttctctgtgcggtgcagttcttcaatctcttcatccggtaaatcaggcagagccgcacgaatgctgttaatactgataggttgcttgtctacgttaagctcgtccggaaggccgcacatacgcagggccaaatgttgtcggcggttaagctcagtgcaagcgccgttgtttgtgtgctggcacacgaagcgcacctctttaccgtcaagcatgatgctggtggagcctttgcctgtatgcagatgttcattagggcatggcacttcataccctcggccggaagataaagcgtcaaggcccagctcggcttcgcagaaatgagctatatctgcgttaagcccgtgctcatcggcggcaagtgtcttagcctcgcgtttacgcagccccatctcttcggctttcttgatgtaccgctccgcacggataacacgcccttctgtaaccgttatcttagactctttatgtggcaggtagatgaggcggttgccgtcttccgtgcagtggtcgcgcagcgattcatctatttctaactcggcacaaatagcacgttgcaccatccacgcgtcgttagagttaaacggagtgcgagccggtacgaggacgcggaaagcgtaatcaccgtttttacacgcgtgctgatgtgacgccgttgtgtgcagaatattgaagaacggtgcgttcttgaatttgcgggtaaggtcgcggtactgagtacggttgagatggtcgaagtcaaacttaaccacactgtcttccagaatcgcgttcttacggcgaccgccaaccggcgcaatagctttctgcttaatcttggccgcgtcgtactcttccttagtccatgacgggtctacggacagacgcttcgatgtatcgcagacatactctacaaactgctccagtggcatttcacgggctaccgggtttttatcgaatgtgttacgcagcgttgcaaaaacaatattcatttctttttctccgcacgttctaaggcttcctgcatacggcgcattgcgcggttcatctttaccggtgcgaagaaatcagcgccatgtttctggcggcgtagctgtggaactattaactttgtcattgtataatccttgtgcttactttgatgatttgtactttagccccgacgttctggcgttggggtttcttttatttatcgcccgcaaaccacgcgtgcgcagaatcatagaaacgacatttacttaacacgtctactggcatcttaataatgcgtgtaggttccgacaaatgattaggcttacatatttctgcatagaatccgctgtcagtaatttctgacgcaaacttaaaccagtatttaactttaccgttttcaaagtaacaacccatacgtccaatcatttcacgttctccttaatccatgcttcaactttattacggtcaaatgtacctggtaaacggcgacccataaccttaatacaacaatcagggaatttaccactgcgcaaccagttattaattgtctgacgtgttaccccaatacgctcggctacttcattctgtgtcatgtaatgttgcatttctatatctcctgtttgtttggtgaagctgagtataggatagcgggaatgtaaaagcaaccaatccctgcaatatttaatctttacaaaaaagttattgaaagttcttgacacatgtttgtataatggttttgggacttgtatatattacggagttgacgaaccctccccgagggattcgtcaacccctcccagacagctgagatgcttgttttagggtttaaggataagtgtatctaaatctcatttaaagaagtaacccactgaaatatctactgtttcttaatgtgccgtagattcgcaaccgtaaaaatgtaacgattattgggcaggcttaaggcctaccctttagttaccaagtaataagaataaaggcacaaccttccctaaagaatcacaacggcaacgtaactaatctcttgcacaccccaacataataggatactattcacttatcgaaacgagacagaggagtgagggttatgtttaaacgtggtcagttggttaaatactccgacgataaacacggcataattgaattaaaatctgctttatttccaggaaagtacgtagttaccgtgcaaaatgtgagaggagtaaattcacaaatatacgtagcggaggagaacttaaaactcatcggcaacaattttaaatttaaagggtgaagtgatggaagaattatttgaagaactgaaacatcatgatttcgaggaaatatatttcgtagctgaacgctacgaggtgcatctggcggacggtataacggttattacatctaccagcgagcgaatgttaaatagcttacgagcaatacgaacggcatcgaatcatgatgcttgtgccgacgacgctgagggaggttgccgttaatgcgaatccgtataactgaccgcaggcttgtccgtataactgaccgcaggcttgtccgtataactgaccgcaggcttatagatttcggtatctcggtaggtgatgtttttccggcgttcagcatcaaccattatggttttatgattgagtacaaagggtcgttattgttcgtgtatcgggatgaatgtgaggttctggtatgagagaagcatttgaacggtgggctgtggtcgagggtctgccggttaacaagggttcaaagaaagagtacctgaacgttaagacgcgtctcgcgtggcgggcgtggaaagctggtgtgcaatccttgattgaaagaggtgtgaggtatgggtgagtggattaagtgtagtgagatgctgccgggtaatgggtatacggataaagagttcctggtgtatgaaacgttaaataacgcagttcagcacgactattacatagttcctgatgacgggagaaagcctttctggaatcactacgataagtacgtgacgcactggatgccgttacccgagccgccagaagtgtgatgttcaatagtttgggattttactgagtgacttacgctgctacacagcagcgtacaactttaacttagtgtcgtcaaaaggcgacactttcatcaaacgcaacaatctaagcggctattgcaggagatgcaacaatgattactaaagaacaggctgaacgactaatcacgttaatcgacacgatggttgatgctaaaaccgatttagcaacggcgacagaggaatccgctacctggtcgcttgaagaaagagaggcagaagcggaaagggagttactggcgttcatcgactctgtaacacaccaataaaatttacttgcacactaagatagaataggctactattcatttacacaaacgagaggggagacagaatatgaaagattatagcgaagtaactttaggtgagttgcaggacgagtacgaagatatgcgctacccgttcatctgcgacggggactacaacggcgtctataacggggtgagcgaagaatatgaacactaaaaacgaaatattcgagtacctgatcgaccagctacggcagcaggtaaataacagccggagcgaagacctggcgcatgaggtgcagtcacttaagaatcagttacgtgatgcgtcagaacatattaaggagttgcataaggcgttggctacagctacaggtgacataggcgcttatatagcagcagagcaatctggttgccgtaaggaagatactcagtacaacgcctggaggccgcattatggtgcacgacaacctgtgccggatgggactatggtatttatccggtatcgcaacggggtggagccgaaacacagtgtagcagcagaaaagcggtcgtggatttgggatggaacatacgcagacatagtggaatacaagattgacacacaggaatgtgaacatgactatcgtttggttctgtggtgtagcgacttacagcagtgctctaaatgcggggtgatcaaatgaccagcatattatttatctgggtactgtccgcgggccagatgcaactcacggcatcagaaacgttttattcgatggaggcgtgccagtctgcggcacgcgccgcagagaacgcacacttcctgtttcagggcgacaagcccaacgattcagaggtacgcgctatctgctcacctaagcgacttggtaaacaggagaaataatgtcgttagcaactgacatcctgaaacgaagcggccttgcgccgctgtcgccgagagctaaaacacagatatacaagcgccgccgtaatgcgctgtacccggagattcagaccagacgcaaagctatccgcgcctgtggattccagaacgggaaggccgtgaatctcggtgagttcaagacaaaggaacgcgccgctatcgctaataggctatttaattactggaaatcgctggggtacgatgatattccaacgaaaccgcagagacgacaatacatatggagacacaaataaaccgttattaggataattcctacccgtggtatcctccagttactgcatacttaatacgcacccggaggattcatcttggataaatttactgaaacagtgacggggtggcttctcgctgccgcactggtcggaggggttataggactacgacaacataagtccgttatctccggccctatcgacggcttctgctttattgcaacgggcttcaccagcgccgtatttggcgcacctcttgcggctcaatggtttggtattaccggtgagcgcgagatagctggcctcggattcatcattgccattctctggatgcctatctattcccgcctttctggcatcgtatcgggcggcgatattgcccgcccaggaggaccgcatgactgagttattctggtttgtcgtaatgctggcaatgggcgcttcgtccctgttcaacgtgtataatgaacgcgtggacgacgggctgttcgggcgtgttctctatatcctgactgctatcgtctgtgccgccggatgtattcacctgttacagggcagcatgtcgcctacgctgcctgagacattaatcacattagtcgcgctgcgccagattcgccaggcgtggctgtcatacggagggcataagcgtgtctcgaaatatttcagataatggattgcatttctgcgccgcgttcgagggattccgcggaactgcgtatcgcgctacgccgaacgagaagtacctgactattggttatggtcactacgggccagacgtaacaccaggtaagaccatcacaccaggacaaggcctcctgttactgaatcgcgatatggctaaggccgtagctgcggtcgatgcagcagcacaccattcgctgacacaggcacagttcgacgctgtgtgtgacctggtgtataacgcaggtgctggcgtgattgcgtctactacgggcacaggcaaggcactgcgttctggtgctattacgacgctgcgggctaagctggcgctgttcatcaaccagaacggcaaaccgttacttggcctgcgtcgccgtaccgcaggacgtctggcattgttcgacggtaaaccgtggcaggaggctgaggcaatcgggcgtgcggtgaaaggttgacacctaagactaatccgacgatacttaaatcacctcctgttccatccctctgctctccagttttatcccggccctgacccagccgggattttttttatctatcttccgcaatgactagttgactattactctcacaccaattatatttactccatcgacaacgagaacggagtagagaagatgaaaatcacagataccgaagcattcaaagatgcgcaactgatggcacgcatcgccgttagtaacctgagcaacagcattcctgcggacgcgttctggttcgccgcgatgcagacactgaaagcagcttatgcaggagagaagaaatgagcgaacaaggtcagataagccaaccgttacgcgtaggtcgtaaagtaagtcacactccgttcccgacacgcgaggaactgatgaaacgtaacagtttccctgggccggacaagaacaagtatctcaatcgcatgtggggagagaagaaatgactgaccgtgaatacgaaaagatgatggtagaggctgttaacggcggcgtagacatcggtcacgtgatgcacgtcctgaatactaaaatcgcagtagctgagcagatggttgagtcgctttacgggacacgccgtgaactgattaaccgcttcaacctgaacaagggtgataccaatgcctaaaatcacaatcgcatcactcgaacgccgtattatggtgctcgagtcagagaaacagacgttaggcgggcaactgtcgattaacggtgagtaccagttagccgcatttaaggttcttctcatgttgttgagaggagaagaggaaaagatgaacgcctgcgagcatgattaccgcctgcatttagttgatggggtgcatcgagccacatgcttaaaatgcggtaaagcgtatggagtcgcctaaaccagtagtaattgatggtgtcctgtggaaaccctactcggttaaccatatcgacgccgacgggaagaagtttagtttctacatttttgcaattagccgtgagcacgccgcctgtgtggtcgacgatatacgagaaacggcggggcttggtgatgagatagtggggtgattatgttcagtgacattaacgcggcaatcgaagaagcaatctggcgtcgttacaacggcgagcaacaacggcacttttgcctggtgcaacgcggtaacatggttgccgtagtgcaggaccgcgataacaaatatccgaatgcgatgtggacaacgaggaatttcttaggatgattaccagcattccaaacctgattaaagaatacggcacgatggctgagacatgccgacaaaccggcatcaacgaaatgacgattgccaagtacagcaaagacgttaactgcgagcgccatgtaatttataacaaccgtctgatgacgcacgttaagacaagcccggtgttattcacgcgcaggggtatcactaaaactgagcaacgtattgctaaagaggagagcggggaatgattagtattctggagttcatcgacaaccaagtttggtacgagccagagttaaataagtattcagttaatgggaaaatatttcggcgcaaaggccaggcggagcgttacgcagctaaactataccgtcagcttgtcaaggatggtttcttcaaatgagactactaatcatccctaacgcccgggccattcccgtagctaacgaccattacggcggcgacggtaaaagagcaccacgccacgacctatacaactgatacaagccctctaccgagggcttttctgtacatcctgcccaatcaccttatataatccctttagacgcgtagggcgcgtctgatgcgctctgatggtcagacgcatatgcaaggggattctatgaagctgaaactcaagcagccatcgccagaggtggtgcaagctgcacatgaagaagctgttagtgcaaaccgccgccgtaaacgaccgcgcggtaaacagagcctttatcaatcatcccgtaattccgccgcgttgtgggacccggactattgtgacgagttaatccggttcttcgaccgcacgtcatgggaggcaatgcctaccggggcacacggagacatgaaagccgttatcgcggataaacccccatcgctggcccgcttcgccttacacatcggcatcactatcccgattattaagctgtggctgcgcgaggttcctgcattcgctgaagcatgggaaacggcgcaggcgctggaagaggcctatttcactgagacaggagccgctggcatctctgctacgtttgctgccgctaagctgggccttagcaaagagaaaccagttgaatcgaccgaagaaacagcacctaccgagattattttcagtgttgcagagcctgtaggtaaaatcgtaacaacgaacatgggcgaggtagagga

SEQ ID NO: 3 - DNA, 150393 bp, synthetic construct
  source 1..150393: mol_type = other DNA
agattttcaaaacccgagcttttcggaacccgcttataagggcgcacactgtttttctatcattctagcacaaacaggaagctagagggcacacaatagccctaggaagccataggaagcccttagagcgattttacatagatttatatataattatccataaataaatagaactatcctagaatgctttaaaatagcttaaaataaattgaaatatttaaaagtttatacttgcatttcatctctttacatggtatactatagatagttaaaagagagcttcattattcggacgggaaacaaaataaaaaagttgagtttaatgcttgacaaggtaaaatatacatggtaatataagagtgtggttagggttaaaccttacaggaaaacgagtacgaccacacaaacaaaaaaatttaaacaaatctattgacattaaacaataaagctgatatacttaacttgtaagataaataagaggagggaaacaaaatgacaattcaagaagttatcatatacggggcgcaatacggtactaccttaacagaggaacaagtaaaagcattctttgcagaacatcaaggaacaccaagcgcaatgcaattggctatttttgtaggggcgatggatgaaaaaggcaactttctaccaaagaaacaagcttaaacgttatttaatctaaaaaccaaggtgcaaggcaaaaaacaggaatgctattgcaccaaggtttgcgggactaggtggttaaaacttccctagggcagaacttcatagttaaaaatttaatcttgttattttaaacttttctattgacattaaacaataaacaagttataataaacatgtaaggtaaagagagggaggaaatgacatggaatacaacacactagacgaattattggacagtaaagaatttaaggacttcatggacgaactagaagacgatggattttttgaccaattcgaggacgaagaagacgggaacacactagcagacacgggacgttatccagaatagagagagaggggcttaacaatgaaagcaattataatcaaacaacttaaggacggttacaaaggcattctagcacgtaaggaaaacggttggacgaaagaggaactaatcaattttacagcgggcgtaagcaatacactatttgaccttatcaacgatttacagggcgggggctttattacagacaaggaagcggaagaaatcgaggaagtattttctaacactatcgacacactagaattttaactataataaaacagcatataaagcccgtagcgaggttttaacgggctttatatataaataccttaaggagggcttacaagtgcttacagtggaaaacaggggcgttaggtggctagtgagtaaagaagcatggcgggcgggctttgctatggaagtgctaggcttgccagattgtaaaattagtacagtattaaaagcgggctataaaattattatttaattatttaatcatatctattgacattaaacaataataatggtattctatatatgtaagataaatgaagggaattgataagaatgaaaaatctaatgaatgaaactatctatagtaatattacattaaacctaactaagaaggcgcaaggcattatatcccaatatgtagaccataacgagggctatccaagacaaaagaacagaggtcactactaccgctatacagttacatttatcaatggtgaaacgtttgaaagtaatagcagggcggacatcgctcactatatttcatctatgacagcggacgaactagaaaccatcatcaaggaagcacaagccgagcagtaagaaataggtatataccagttaaccccaccccgtggttttgtgaccgtatttaggggcggggctatcagggcaccctcgaccctcgggtacctattttttggactggaaattttttctagaaatttggaaagtcaacactaaaagtcaacaccttatctccaaccccaccccgttatttcctctaatctatttatctaataaaagaccccaccccgttgatgatgaggtctttttattgtgacgtactccatagttacattcctttattccaacctcccacatctttatgagtatcgaaaccacaatcggggcagtaacctgcttgttctgcatctgttgggtacatgctatagctataatagaaagcatacatccccatgttttcatgtgtacactctgattcctttttcttatacgggtaagggcacgcaggacaggtaaatgtgtactctcctgttgaaccaattaaacgttccccacattttgggcaaatatctgcaaccatcttagtcttcccccactataaatcttgctttagcctttaatggtgcgtagtccttttctgttagtctcacgtaagcaacacccggcactcccggagagcatacgtaagcaactacaccccagtctttaacttcacttactgtagcaaaacatcccccaaacacggcatcaaaatgcgggactatttgaacaacgtcatatacttctgtataatacttcatttattcttcctccgtatttaatgggtcttgtagatagaagtcggagattccccatttgtttacataagtgatttctccttctttactacctgtcacctgtcttaacttgtatgtgatttcttccccgtcttcacgagagttcccgtctttgtctattacgaacaatggagtcttctctgtgtctaatagttcgtaacgctcacctgttagcttgtgtatataaatcatgttatccctcctttagaacaatgcacatatagatacaatcaccatagttttcactgtcatatgtgatatagtctacttcatagtctagtaattgttctgggaaatcttttgagtgaaactccgtacgccatgactgttctgcgcaatagggttccccgtcaaagtctttaatatagattcggaaagagtcaccaactgataggatgtctctaacttgtctaagtgttaatttcaaatgtcttgcacctccggttctgtgatgtctaagacagctattacttgtacctgtcctactccttctatatataatggtgtaaacaaactagttaactcgactaggttatcatgtctaatcgtgatagcattaaacttataattacacccataaataacttcatagatgcccataaaaaccctcctgtaatttatacttaaagtatatcacttagagggttaattgtcaataccaagcaggcaaagattgttcataatcgaaagaccaaccactagagtttaaaaattctcctatctcgtttacactctttgctttcataatcttctttctagcatcgaggttttctttccttgttatactactatataaggtttctcctaaccttatgagaagttcttctttaaactttttgaaggtttctccttcgtaatagtctgcccattcccatgtaatactttgtgtgcctttaaatactttactgaaccctgatatggttatggtgtatttgattgtcattggtagttccttcatcgtcttatctcctatacccatgaaatcttcctgttttgttgtggacgaaatacctctactttacgtgtatgaatgtccctacctataatagcgtaaggactataatctattacttcatacaaacgtacagtgtaggggtgttcttcccgtataaagctactagcttctgcaatactgaaaaccttgttaacaatgcgtactgccttcattacacaccactgtacctttcttgctcttcatagatagccatgtcttcttgtagttcgacttctctgtctatacatttataacaggtttcaaaggtgtagtcgaagtcacaatctaattcactcactagtcttccacaactagcacaacgtacctcattttccattactttgcactcccaatatattgaacaaaataatttgagccttttttagctaaagtaaacatagctgtaacttctccttgttctattacttcatgagtaattaagtctactaagttaatactactcatatttgcaataaaagcctctccacaaggatgcccctctacaagtatatgtgctcctgatgctgaacgacctctgtaagagtctaggatacgaatgtgtcctttaaaatctaccttttcaattacttggtatttttcggggtagtgttcaatataagcatccccatattcaagtaaccgccaatcagttaaccctcttgctttatctggtacccaaatattgtccaatctttctaaataataggttactgccattgtttctcctccttgttaggtattactcccataggaatatatcgtttcttataacaaaaatgtcttctagcggagtattataatgcaactctacattatgattctctttcatgtaggtttttgcataatcaaataaatgctctggacacttaaaactaaatgaaccaccatctgcatctttgcaagctatatgctcttccatagtactattgacaaaccagtttacacactttggtggataacctagcataattcctagtgcataatcttttccgtgttttcctgataatttagaaaactcagctagttgttccaatttagaaacaacaagtatgccatttttgcctacagaagttgcaaaatgctcccgtacaacacgtttaagttctggtgtcccaataaagatggtatctcttagtcccaaattaaatgccacagtttcttctgctaaaataaccatgataatctctcctcttatacctaattactcttttgatagtttgcttcttctaattgtcctccactatttcgctttaaaattatatacaggtttgacaatcttttgaatatctactgtatctttgatgatttctttgatttcgtcagcattcttgtatgcttttggtgcttcgtctagtgtactttgaacaacagatgttgtatagataccagacattgtttgtttaaactcatctaagtcaagcagttcttttgctttagaacgagacaatacacgccctgctccatgaggtgcagaattattccaatcagtgtttccttttcctacaccaatgatagagccttctttcatgtttaaaggaataacaagtctaacaccctcctgtgcatctgtggcacctttacgaatagtgttggaggctacatcaatataattatgaatagagtcaaatgagtcaactacagtccaacccatattagaaacaatcttatcaatgatagttttacgattcatgtaagcataacgttgtgctagttgcatatcatttaaatagtcatccactgcggaaccttctaagtatggcaattgtggtttaacattgacagctttaaaattcttaatagcctcttgaatttctgactgtctgccttcttgcttaagtgtctcaatcatagttgctaaacctttgtcatcacgttcatggtataaatccgctttcttctggtgatattgggctactttaagtcctaaagaacgggaacctgtatgaactaataagtagtaattgttttcgtcatctttacttaattcgataaaatggtttccaccacctaaagtacctaaagacaaggtaacacgttcaataaatggttcttctgttgcacctttaaacgtcatagattctaacatgtgcttaatcgtattcggtacagtaggatgaagttcgtccaaattttctctaatgttaaacccagaaggaaccactctgttaatcactgcatccaatttagcccattcggtatctgtcgtgtcttctggcttctcaatttgagctaccataataccacaacctacatctacaccaacaatagagggtacaactcgtttaataccgtctggataatgaatcgttgtaccaactgtagagcctttaccataatgtgcatctggcataattctaacaatgccaccgtctgttaccggttcattaatcattgttgtaacctgaccgatagtgccttcatcgactgtattaataaacattttcgcatcggtatacttaccgttaagttcaattaagttattcatcagttttctcccccactaatactttcttcatcttttcatctagtctctgtataatctcttgttgttcctgagctagctttgcatggtgttcacgctgttttttatacttagcataagcaaatagttcttctgtagttagttcttctaatttacgtgtaaatggtgtagcttcaaattccattacaagtacctccttgttttttatacttaaagtatatcatgtaagataaaaagaagcaagcagtttttacactacttgctatatttttttaaacaaattcttctcttacttctccccaactttggtctgggtctggtaagctaaaaggtagcttatcctgttcttccttagataagctctgataacacttctcatgtactgcaatggttccagaactcccctgagcaacaggtaacacactaatcaattcccgcatagcttccctaaactttttatagtcttcatcttcatcgttatcgactaggacatacacgtcacattctgctttacgtgcatttgcaatgttttcctcactaggagcatcgtagaaattttttctttgcagttcaagatacttgactgctttaattagtcttttagcatagtttttagctatcgggtcaacatcaataccattttgtaaatattctactaattgatacttcgcatcccctgatgagataccgaatagagataagtaacttgtagataaaatatctccacttggaagtatcttgttagaaccaaaatggtgagaatctgccctaccaaactctgaatcacatatctcagagtggctattagggtttggagcaccgtctactgtatggtcttcacctctatagtccttatcttccatgacaccaccatactcattgtagtgccctaccgtttctccaattaactttccctgtctgacatgctttaaccgacaaagttccccaccattaaagcagtcacccacaatctgtgtattacatactggacaaatataaccaaaacaccccattagttctctcctcctttttcacttgggtctacaaacggaatatctattgcaccaaccgcttcataataaggcacaacccgatatagcgttcccggacgatgcttactagaatttttcatagcaccttctgctctaccttttgttgtatgaaccccttttacagtaatttcaccagtaactctgtgtttcatttctaatacatataatggcatcttacattccccctacaagtttgagaccttcgtttttaaaggatacttctctagctttttctatttgttctagtatacgcacagcttgtgaagcaccaccaaagccattgttaatattcacaacagaaataccagaagtgcaactagttagtgcagtatttaacgctgtgtaaccatctgctgaaataccgtaacctgttgaagttggtacagcaataataggtaaatcaattaaacctgcaagtactacaggtagtgctccctcaaagccttgtacagatactaccgcattactctttgtaatagcatctgtagaagccattagttttttcaagtcatttacaccaatatcatgaaacgacacagggacatatccatttaaaagtacggttaaataagcttcgtctacggtgtctctatcagctacacccgcagatgtaattgccacagataggtcactctctgtagggtttgcacgataaaacgctgtctgactagacttgcaatacacaaaagggcttccttctccccaattatctatccaatctggttcctctagttcctctgctttttctataatttccccccaagagagaacctgtgatgtttcaaaaggtagtgcatagaacacgtctaaaggtaattttgttaccatgatatttgtatctgcgggtacctctgcaatctgactggctagttcctgtgcagttttatttccaccaaatagtgtacgtaatttcattagttaatctcctctaaaaatttagttttgtctactggttctatcgttccatcttcctcgattccttgaactttgaatagtaagaactctggcatcgcacagacaacagcagggtcatatgctgtttccgggtcacatgccatctcaaacatgttagtgtctttgttatagaaaaaacataagtccccgattctttcatctgggtataaaaagtcagcaatgtaaaacgccatgtatttcatactagtttcctcctgttattttattgtatagtttagtaagaaatccaatctttttattgctaggttcagttaccaaccatgttattgttagtgatttaattcgtggactcaaagcattttgcagataagttacatagtcattctcttggacagatactgaataaccctttcctattaaaaatcggttaactgcctctacctcctgcttgttaatattaacgtcagagataacacaccagtattgccctagctccactgcttccttaatactaggtagtaccttatttttaataaaatctacggaattttggactaactcttcttcgatttcctgttctttttcaacagtcttattataagcctcctctgctgacatcattatgcaccaactccaatttcttcatctagctttaaggatttaatcttattactaaacatgttagcttgctcattataatgtaaagctaacaacatcttaatgttattttcaaactcagatgcttttgaatctacatatgcttcccgcactagtgaatacattgtgatgttatctttacagaatgcccaaagaggtgtatccaactcactttttagcacacgagttttaaacagatagtctggctctttactacggttctcaatctgcttttctgtaattttcaagtcttcttctcggattttcattacacgagtggtacatgtaaagtctccttcgattacttccgatggtctaacatctactcgtacaccaactaaatataaagaatcctctcttgaaatatatacaggttctatgtccacaatcttagtgaatgggcactcgtaaccattcttagcaaaccaatctgtaattaaggcttgtaactcatcttgcttatcttctggaatttcatctgttaggtagtagtcctctgcaacttctccaacttcttcatagaccatctcttgtgtacgttccaagaatgaatcaacatctacagggagataaaccggagccactcttccaactacaaaactattgattggttcttctggtagaaatcctagaatatcctctacgtgttcccagatttcttctacaaaagttttcccatttctaatggcatctacggctagtttacctgcatgaatagcctcttccttggtatcgaaataagcacaagctctccaaacttccacatctgtatcacttgcacacatccattttcctactaaagattcattactcattttttctttcctcccactttatccttatctagaccccatatatgtgcccatttacgacaaaagtgtttatcataatctaagtccataccggtagcaccttcgaagtctttaaactcttcataaaattccgattctttaaactcatcccactttttcaattcaaccatcctatacataagttggtcaaattgatagtctggtattttaattgcatctaattcataatacagataactgtgtagtagtaaagcacgctctgtcatatttataaaggacaggttatctagtatagtattatttacaacggtcacttgttactcccccggaattgaaattattacttctatatctaacacagccataatcttaaacaaggacggtaagctaattacagttaacccgttttcatatgtagaaatggctttttgtgtaatgcctgcctttgtagctaatgcacgttgagatagaccttgttcttctcgtgcactatgaatatatcctcgtaatgtatcagataaggcacgtgtatattcttctgtgtcatctttattaacacccagttcagcaactgtttcggttaagttgatttccatgttttctcccccttgcctttctatactcatagtatatcagatacctttcagtacgtcaacaactttaaataaaaaaatcctagtatttactaggattttttctcttttattgcatctgcgagcatctcactaaaacaggttcccccattatagaaggtaaacaaaaaattatacaggtctgattcaccctccacaggagtaagtaaagacacttcatcattatctaagatagtttgttcgaccgcatgataaaggtcatcccctactttaacgtagctatcataattctcttctaaaaaccactccatgtcactatcataataactaggtcgttctcccctactttgtgtaaacaagctaactgcttgatactgttctgcttctgtaagcttacgtaccttacctacacgtgtttccatttctgacattataatcgctcctgcattaattttattttgctttcaatgattcccttaacacactcccagtaccacattaggtgctgatattcattctcagagacttgtgttgttagaaatctacattgagcgggtattatttcatgctcatcgaaatacaataatatttggtttctatcgaatataactgttgttaattcccgttttgggcggtcactaatgtgcatctctaaaatggtatacaacctttgtatattatactcctcgtctaggtttatacttatcacaaataaacctcgctctttataacgattttcgcactccacaatcattgtatttactaactggttatgcttgatgtagtccttactttttacatgcacgaatactcactccttaaatatggtcttcatctttaaatgtttcataggaatagtgaacctgtgttctaacataaaagaccttattacagcttggacaagttgtttcccaaattgccccctcctccacattttctgaactatagattccagagtgatacaggtcttcctcgtctttcatagtttccttacaaaatggacaagtgggatacatttccttctcttctataatgtatcctttatacataataactccccctacttaaatgcttcgtctaaatcaagttcacgttttgcgatttcagtgatttcttcaatggcttcttggtattctcggatagttgtaatctctttaccatttcctcctaagacccaatgacgttgaatcatgtgtaaagcttttgtaaggttcgtttggtaaccgacaagcgcaacattctcgtttccttttttgtcgtaagtgatttctcctttgtcgttacgaactacacgttttacagttacgttgtctgcatcgctagtaatgcggtagtctaatactttcatgtttaacattatttgtctcttcctttcattcgttggtttcctgtacgaggtttaaatttacgtggtaaaacacgagtattgcgtttagcttcattgtatttacgtttaagccgaacctttctgtctgactgatgttcaaacatgtctgcaagagcggagcagtaatcaatctctgcacgtactttttctcccacatatctttctaaatagaatacatcaagagctactttactatagtcaatatcatatcgactaatagtaacaatgcgctcaactgtgtatctatcacaaatagagaatcgtaagtaaattattaactggtcaaatcttaagtcataatagagtggtttaagatagtccaacttaatacggttatctatttcgtataggtgttcttttgtatagtctaacagagcaataattcgattgtctgtctcattcatttctaacgtcataccttcgtcctttccggtgtgcattgatagagtctacaggtacatgtcttagctgaaagcttgacgtattagactcggataaaagccccttacctagacctgtccgctaacagcggataatattatctaggtaagggctaaggataaacacaccctatacataccgttaatgtgacacgcccggttcgttactgtcttaaaataaggtctgttggtagtactgagtagcgtttttcatccactgggtttaacccatctttgccgagaactgccactacaagtttgtcttcatcgtagcctgtaactaccaagttagcccccattagttgttcatttcttgcataaagtcctgccggtgaatagagaacccaatccccaatgttaaatacccctttaaggtacttaccacacattggacagtacttaataaatgttctagcctctgcggtcattgtcgtacgaacattcccataactgtgaaaactaaactgtgcacgcaatacattatggtctacacctataccaataccgcctgattcgtcctctaaattataaagtaattctccaccctcacaccaattacacatgttgctcctccttcgctttttggatttcactttgtaaaaaattaatgtaccttggattttctatattaaacatatcctgaacatatacggctcctagttctctacgatacgcatagtccacaccaatacgtctatagaactcatggttaacatgatacataaactgatggaatcttgtatgctgtcctcttaaatcatacagctcctgtaataggtcacagatttgtacaaattcttcctttgttccacttgccatgatttatctcctccttacctgttacctaaagtatatcaaaacccagagcatctgtcaacactctgggtaacttttttattgtacagataataaggaagctacgttaatgtaagtaatcaaacctttttctacgtcctgtacaattgggtactctgctttgtcttcatacatgatgttatctcgtacatatagcatctctgattcaacataacggaatatagcatctgaactacctgttgttgctaatcgtatccgtttcttatccgtagggtttgctatgactgcctgatttttacttagcttacataacaacttaaacattcttgtaatgttttcatcttctaaagccggagaagatgttgttttcttcttcaatcgttgttccatataaattggaattgcttgtgcagataacttcatcgtagtatcactatttaagaagtactctgtagtagttaaaacaacctttgattgttctaaaaacttaagctgtaaatagcatcgcaaatcatcttctgagaatgatttttggtattttgaatggtctgcatttatccattctacgatgctacttaagaaggttacaggtctcttaccagagtaagaaatactgatatagtcagacgtatttactacctcttttgcacaagagatttcatatatggtagccccctctaggtcgctatcttccccgataaaaatagtagttaagaagctacttggaacaaatcctacatggataaattcttgggtttctggtagatgtgactcaataaaactacctaaaagttctttccataagaactgctcgtccttgactaatgcttccttcttttgaagtttgtagaacagaaggtcaaacgcagtataccaatcttcggaaatttttagtttagttaattcttcatctactggaacatcaatagtagcagacgtgtcttcctcaacttccgtgctatctaaatcattgtcccataaatcaaatgttttacggagacaaaactctctccataatgtatcacttgggtcttctccatattgcaatagcatctgctttccaattgaagttagtgtaaccttacctcgactattgataccttcgttataatcttgaatacatcctttataccgcaaagaaagtaacatagtgttagttgctttatcttcgataagttttaatatttgtttatagccatactccatatagaaaacagggaagttcttttgctcaacaaaagcttcgtgctccacctctaacccacgtttttgtcttcctagtttatcaattatacgaagcgcctctaattctcgttcctcaatggttacaacatactggctaattttgttttcgtaagctaaagcggtgttcatctcttgcaaaatctgtttaaataaatcgtttgcatcttttgccttctgagtcttaaatgttctgattgtcgtatcatagaaacgttcgtgactcgaaatagcaaactgcccaatgtatcgcttaccttttaaatttaaacggttttcgttacgatttcctagagtaaacgttacgtagacagactcactagacttagaaaaataaatgtcttgaacaactatgccgatagtttcaagctcgtttatacgtttagtaaaatcactctcatattgtggtctgtttatatttttgcagtgttttctatagtgtactgccacagttttcgattcttttgccacatccaattacctctcttatctttcttcttttgcaacatatgcctctaatacaatggttctaataggttctatttcgtgtacttcatctctgaccttcttgattacaccttctcttagcagtccttctcctaacttatgcgaagcttctagcattcgtaagtttacaagttcatcactgtcaaatacactcacatctaaccttactctgtaaggtaatacttgttggtgtacacgggtgactgttaggggttcccctataagaggactcttcccaactcgagaaaatgcccagttatctagtttttggttaaaccgcttctttaatctgtctaacatgttttcacctccatgtatatagtatacatgttaagccttacaaaagtcaacaataaaataaaaaaacatacaactaagtatgttttttcggtacaaaatatttctcttgaatattaccgtctttatctacaacaacgccatttaactgtcctccataggcacaagcaccatcaataaagactgtacggtctcctaaataaatatcacagttattgcctctatgaaagttaactgtaggtgtatgccctacaataatagttttacttgtttcgttcttttggaatggatttggtctagtccaaagcatttcatgttcctctgctgttttccagtctggctgtctccatcttgggatacctccatgcacaaatagcacgttaccgaactcgtagtaaggttctaggagttccaaggtgtcttttacattagagttattaagaagctctgtacgcaacgctagggcgctaagagaagctgtcttagttcctagaatagaattagcagtctcttgacctccttgataataccacactgagtatatctcttgcaagtcctcataatctggttctaatcttaatgggaaactaaggaaatctaatagcatttggtcatggttccctttaattgctgtgccaccagaagccatatgttcataaacaaaacctagaacttcttttgattggagacctctgtctacataatctcctaaaagaaccaattcctgttcttcacaattccaattttttaataactccataaactcatcgtacataccatgtatatctgatactacgaaagctttctctttgctcattaatcgtcctctactttctcaaaatatcgaaagaacgcataccaatcatatcgttcagtaacctgcttactctcgtgcataaatacaaactcaacgtatttgtgtttaactgcatgagggtctactggttcccaaggaagcctgcgaggataatcataataaacttttgttggaatgacttctcgcattaacaatttagggtaccgctttttaggacggtacctctttcctaaaacatgttcgtatgtcggtctcattctattataccatgtttcgtataagttaagccggactcgttgaaatgcttttccttttcttcaatcaggtcaatacactctttaattgtgtatggtgtcccaaaagggtgtaaagttaattctggtgaatcgacacctacatttaataagttaggttcttgataagctatctcatgaatatgtccatgtaagtttactcggtttcctcggctaccaataatgagcggatagtgtgttaaatggatgatttttctttcctgctttagtattacgccaacatcactccaaaatactcgttcacgtaattcctcatcccgattaattgtttttaaaagcttggtactgtcgtggtttcctttaaccatgataatgataccgtttagcttacgaagaatctctagagtatcctttggtttctggttcatagcaaagtcccctagatggtacacagtgtcttccggacgaactcgtttgttccatgtcttgattaagtaatcgttcatttcgtccacatcagcaaacctacgtcttgtctctacaaagccatcttctccacaaatattgtgatggttgaagtgcatgtctgaaattacatatgttttcattctagcaaccctcccaattcaaagttatcgaaacactctgcattgtatacattttgaatggcattccgatagaactctacagtctctagactaactggggtgaagttgtgtacatctactcctacattaagtccgtcacgtttcaccttttgtttttcatgaatatgcccaaataagccaaaatagccatctttgattttatcttctgaataactcatatgggaaggctcgtggacaagaactagtttttggtctacaagagtgacaacttctccttttcgaacaaattcaaagtacttttcttgttccggagtaatgaatccacctttaccatcacgttcatagttaccaaataataaatgaattttacctttaagctgtttagctacttcgaagttaccgaaatctcctaaatggtaaacagtgtcttcttcatctacaacatcgttccaccgttctatcatagctaaatcagcatgttctacattatcaaaatacatacctcgcatagaatatttgaaagtacgttcttgtccaaagtgtgtgtcggacgtaaaccaaatcttactcatttacatcatctccaaacgttcataacattttttaattaccaaggcatcccacattgcattatgctttacaccctccattgtttcaccattaccaagaaggaacgcaaactcttcacgagaaatatcagggtcaacgcctttaaccttaaataacgtacagatgtcaaagggaatatagtacacgttactgggtatagagagcgcatccccaaatagatggttgaataacacccagtcgtatgaaagacagtctgaccatacttctacagaattaaactgcgatagccattcctgtagtttttgtgcaatatattctgtatccccgtagtactgattttcttcttctcgtaggttttctttccctactaaattatcaagcacatgcgcctgtaaccattcgtctacttgtgtttcatcgtaatcgtttaactctgcataaaatgatacaccattttcagctataattccaatactaattaatgtagtgtctttatgcaatcctgtaaactctgtgtcaaaaaagattttcatgtcttactcctctatgcagtttaattataattatgttgtgactattaatagaactaacaattgaagataatgaactgtttggtcaattgttaattgtgttttggggtctggtattatcgaaggaaaccatgtactttgtgctttgagatagtccattacaaaatgtggtaaccatagaacaagtaaaatgtgtgctaatgtaatagacaaaccaattaggtagcctgtcatagcaattgtaaaagtccaaatagttgcatggataaataacacatacaagtcttttgttttttctcttgcaatatattcactttgtagtgcgtaatctcctacagcatgtgcccctactaacataacaaacatagtaatatatggtgtcattatattctaccaccctcatctaatagtttctctaacggaatgaactctgttgtccgtctaagaacaacatctcctgattcctcaattgtatcaagccaacgtttactaccatcactcatacgaaacagtcttaaagggtatcccatttcatcatattgtatgatatttgttctttcgtatacgtaaggctctggcttgttttttaggaagtcgaaccaacccattcctacccctcctcagttaatttaactattatttttaccgggataatttctaagtccttgtattttctatcgtactcgttacgctcccgtaaaattcgttttaaagtatctcttctacttacagcagaatcatacatggtgtacgcttgcgcatctgagggactagaagaccacgcatataaagtcagccctgctacataatacatatacatgtcccattccatgtcgtatactcttataataaattgattgctcatttaatctacctcataaccattttccaccgcacggtaaaactttaatatattacagtattcaccaaaccagtcttggacgaaggtttcccagtttcctttgtagtaatcatcaatgacagagcggataacatattcctttgctctatcatttctggtacctcctgcattttcaataatctttgctataaagtaaggaactctctcttttttcataattagtcttccacctcttcataagtatctgcaaaaatatcaggtttacatggataaacttcaccttgaatgcctcgaataacatagtctccaacagacacgtgcatccaaccttcaagagtaagaatataaagttctccctctttaaaccggtaatttgcctttaacatccattctggcacatagtagtttccttctgacataaaatctccatcaaatttaaacgcctcaactactactggtttctttcggaactttcttccttcttcttctagttttttaacatcaacctgtactgtttctcctgcaaatctattataaacgtagtctttgcaccaacgtacattctctgcatgacttaaacaacaatcaaaatcaattttaaaatactctccattgtgtgttccctcagtacgatacttcatttcactgtttcccccttttctgcaactacaggtgtgccatctggatgcaatcttacagtcatcccaccagctctatccccatgaaaaactaagtattgcacttttgtttccgggtctgtatacaccgctatatctctagaatctgcattagtacttttaatagtatcttcatttgcaacagaagagacatcacatgcccctaaaaatagtaatggcaataacaacaacaattttttcattttatttcctcccatagttctgtaatgtcttcctagtcttcgtcattaatgacaccttcaatgtgttttaactcacgcatcagtttaagaaaagacttcgtatccagtgtaattgatgagtagttacgttcttcttgtatagtaatctctacaaccttgtcttcttcatcgaaacttcggcggtcttcttcatacgttaccttaacactactgcgagtgtcctcatcactatataatgaatagtatctatcagttcgtatttccattttaattacttccctccttttgttggtcttgttccgtttccttgtacttttgttcccctatacttaatagcacagtcagcgtgctgtagtctccaatagccattctttctttcaaaatgaccttgacctttctctacaaaggtaccgcacctgtaacaataccccggatacttattgcgcatagtagtctcccctttacacaagttctaacgaaatacttagtataccagaatatttatcttttacagcttcctctacttggttaactgcttcttccagtgaaatagttgtatttgtatcctcggaataagtcttagctaaaatccgtattgcatgaacttgggaaacctcttttagttcaacagaggtattgtcttcgtcatccacataagcttgctctttgtatatctctaaagctttgctaggactataggctgatatgagagcaaaataaggactagttacttcatagaacttaattcctgttaagttaaagaaaggtgttacgtagtccattacgcctttttgcatacgtaactcacttgaatgttctaggttgttatagtgctctttttctactacgacaacctcgactactttacctttttctacttcatttggggtacatagtctatctctagctccaagataactacacattagtgcatctttaactatcgttccggaagcagtattataccctgttttataaaacccatcttcccttactgcaacatataattttaacggctcactcatactagttttcctcctctgtaatagtatcatagaaaatcatcccaaccgactcccacgctacgcataaaacaagacttattacatagtaagtatcttttatgatactcatttttaaaactcagagtacttccgcactctgaacaatataacttcacttttttgtctgggtatccatcgttgagtatctcctgcttaaatctcttaattccttgtcgtctattcatctataacctcttttccactggcacagcaaatagccagaatcgctcatctattgctttgatttccgcttctgttagctgataagcagatttttcccaccaacataattcaaatttatcattaaaacagaaatcatttctgtcattaaatttcttgataagatataagtcaccaataataacttcatacaactgctctttcttgacctcgtagccgtttttcatactcaacacaatgttcatgcagtcaggagttgcatttaaccatttttgaaaatctgttttatcttcagggtattctactatttcccacgcttcaccaatttcaccaaataaattattgtgtaaatcatccttattttcctcaaaccactccgccacaaacttcggcacaactggcttctgcggttcgtctaactttttcattaccgcaataccggcatttataccatcgttataacaaaaggctcttatatcggttcctgacatcctatggctttctaattccttaatcgcttcttgtttattcatagctactccttctctaaattctctctcttggctaacaatcggaaattttcataaaaataacctaaagtttcgtcaccgatagccccatcatctgcatcagtgtaaaattcatctttaactccgttaactaaaagtaccccgtcatcatctattccttcaacaaaatatacctttgcttcatgtgtacctttacgaataactaaatccccaacattcacttcccatttaggtattggctctacttcatctggcaatttaattattgtaaagtgcgttttatactctgggaagttatcgtctaatggagtaccagaatatggtgcttcactaataggaaaatcccaccaaagaacatctcccatgtcttcatgccatttatctgctcgatatgctataaccctctgagagttgtcctgataatctttcacaggttcgattgataaccaagctcccataaactcttctgtattattagcaatccactttagtgctactgtttcttgtagacttccggtaaaaggttgggacttagttttataactaactagaatttccattatagtatcaaagtctgtatccgggctttctttccaataagtgagcaaatcttgcacttcttctggcaaggagtaacttattatagcctgctgtttttttaacgaacgaatagcattttgtaagtaagcttcttcgacatcccgacttttattaccatttaaaacccgctcaatctcatcaattgcatgttcaatgtgattcattattattcctcctttaaatccccaaattttctgtctaattcaacaccaaattcaaattcatcagctttcttcgataatttgcacatatcttcataatttttcttgaagttcttatgaataatcggagaacaataacctgtctctatccgtgctaatgaatacttgaccagtctagcaattttatactctaatgtttgataattaacaacaatatttaatttattttttgggttgtaccactcatgtgtatatggaggcattgtaaccctattctcaaaccctaaacctgtcaacagctttttgactgcttctgtattaacttctaatgtgtccatgtctacctccaccagttaggttctttaataacttgccacgctctttttagttgttcttcgttgaaatgtccaaaatgacaatcctctttaggaataccaagcttacgagctaacacactgtacagctctcccctacttatctgtctagacttccatacagggtcaaataaactgtgacatagttttttccatcgtttcataggtggtgtggctaaaatacctagtggttcttttggtctgttcttgtgagtccctacactagcaccacaacctgtacaataataacatttaccattaccgtaaactttcccatataatacttcattacttgtccaaataactttagctccacagtaagggcagttatctggtactaacattttatccatgatttgttcacctctcatgtatacagtatacctctatggtatcagtaagtcaacactttttttacaaaaaaagaacagcatttctgctgtcctaaaaatcacaccaatcatctttatcgtaagaatcatctgtgtagtgttctttacctttaatgttattaacattaacatgctcgtcttcctctggttgctcttctttgtttttcttaacgaagtagtaaccaatagagaaagctatacccccaagcaacagtataataagagcgataaagaatttagcaatgaagaatcccattacttgtcagtgtccacaattgcttgtccgtcaccgattgtagtagtaacccaaccgtgttccttacgagcttgtgcttcttcgtaacgaactaattcatccgtaacagattctgcaattttcttgttagcttctgcttgtgcattagctttgtctctaatagcttgggcttccgcttgggctttcaaagtaacttttgtagcctcagtttctgcttgtgttttttgagttttagcatctaactcagcttttttagcttcttgtcctgaacggataattgcatcaattgatttttgtgtttctgggtcaacgtcaggtacacctaccgttacgttttcaactaagaaacctttaccttcaactgaatcagagaaacgagctaacacttctccctcaacctcagaagacttacctgaaagaacatctaacaaactgtacttagaataaacttcacgagcagtcttttgtagacgagatttcaaccaacctttttcaatgtcctcagatgttacgttaccgaactctttgtacattttagttgcttgtttagggtctactttgtagtcatacttaatgttaactacagttttcttaccgtcagatgtagaaaccgcaacatctttagcttggatagtttgtaaacggattgggtattgtgttactttatcaatacctacccatttaacaccgggctgtaatgcttcggatttaacaccaccgttaggtgaaaaacgtacacctacataaccgttgtcgattcgttcgaagaaacggaaagcaccgattgtacctccaatcaataaaataactgcaaccactccggctacgactaggcgtttaaacgtcttctcggtcataaaaataattcctccaatatttagttttttatgtgtaagttttccccttacaaatagtagtataccttacactgtataacaagtcaacaactttttttattttcttgtggaaaataatttaatgggtgtatggtcttccccttcaagatacttaccatcttcccacaagaccactgagcctttctctaggcttctctgcacatcaatgatacgttgattccatgaaccacggaaaacaaggttagggttgaatttatcctgctcaaaacgaccatctactagtacatctacgtaagataataattcaagcttatcttcccagttttcagcgttagaatccgtaagctcttcaaaggtataacctgaccatgaccagattgttttacctgttagctctgatttaatacgtttagctaaaggcagtagaacttgtgtatttaagaaaggttctccacctaacaaagtaataccatcacaataatcttgtgaaatgtctttaaggatttggtcttctacttcttgggtatagtcttttccccaactaaagttttgtgcctttttattataacaccctaaacaattaaaagggcaaccggagacgtagatacttccacgtaccccgataccgtctaccattacaggaaacttgtaatcagcatatttacccttagacaatctttctgctgtccatgtcattgggtctttactcatctgtatttccttctttcttaacatgtaagccttcgtcataccctgattgggtaaacttagcttggcaaattgcacacttataggctttgtaccctagattattatacggaaccactttgtcttccccatcttcatcttggtgggtacacgctttttgtagcgcatttagtatttcgtttcgttgcttgattaatcgttctttctttgcaaggtgtctacactcttcatgtagaattgcagactctgcaatggctaaaagattttgtaaagaggaagctgtactcattaaattgccacctcgtaattaaatcttccgttatgtttgtagccttcaaccttaagttcagatagtgggcactcaaagaagttagtcatgttagcctcttcccaaggcaatactagcttaggttctgcgtttagaacttcctctgtcataggagcagttacttgttcgacagcttgtaccatatgacggtcgtagatatgtgcattgtcgatattccagaacattgtacccaactctaagccagataccttagacataactacatgtaacgcatgatactgcaatacgttaaatggcagtcctaagcacacatctgcactacgctgtttaacgtgtaagttcaacttaccaccctgtactgtccagtgagtagcccatacacaaggttctaatgccatttcatctaagtcttccacatcccatagagttgtcataattctacgagaacttcgattgtattttagttgatatagaatagtttctacctgattaaacttaacgtagcacttatagtcttttgtttcagggttaacatcaaccataatatcctcttcgggaaaaaagtcttccggagaagctacataaaattcattattcgtgtctagttgcactttacgttttttattgcgtaactgccaaccataagcttttccgattgtaccatcttcttgttcccattcgtcccaaatagttactccacgttcttgtaaccacttgacattgttagacattgcttgccaaatccactctaattctgtaaatgcccacttagagcctacaaacttactcttaagaattggcagtcccatgtctggtgtaatttcaaagcttacaccttcaattgcatatgcaggagcaggttccccatcttcatagtgtgctcgtacttcatcgggattttgcaaaatacccttttctttgatggctaacacaaggtcagcataaattttgtcaaaactcatgtgtgttctccttttctatgttcgtctaactatattgatagagtctgtatacccatttcttcgtacccactctgtataactgttgtgctcttcttgcgcaatcgcttttaaagaaccataccacttcttgacttcttcccgttttttacgtttgaatactaatgatttgtttttatctatgacgttgataatcttacttactccaccagtattatctataagcattaatcgtgaaacggtcggttttgagggaaacatctttttgcattccctacatagttcttctatttgcccacctaatgcacgcaaatcagatactctacgcccgcaacgtatacactcagttccataagcctgctcaaaatattgtgcattaatacgaggaaacttttgcgtaagtcttagattagttgaaggtgttttaactctttttcttagtactgttttgtttttcttaaccttaacactaactgggtcattaccatcaaaatcaaaagaaaagctaattgttccagaagggctaattgttggggtaactacattgcgttccactcggtctgctaatacccgaacatctgttatacgaggacgtgttttctttgtgaataatcgtcctcgtgtgtagtctataccttgcatattacaaacctagccatgaacgtactttgctgaaagggggtttcttttcaggttccttgtactcagagtttgtacgttttaatttatcattgtagttatctgcaagtgttaacaattcatcaggatttactgtttcacaataaaaagcaatctcttccccagttagctctctattttcttcaatcaatttatcaagagtcaaatcgcaatactcatcttcccagtcagctaagaagtacatacgttccatgacataatctgatgtttcatctaagaatataccgaatagaattgggtctttatctcgattatcttttgctacttgttgacctacttcatctgtatagtctgtaaacatgataactaagcggtcaaatttatcttgtacacgttcgattacaggaacaacttcatccggaatttcacgggggaaatctttgaggtcagctagtttaactgaacgattttccacattttcaataaagttttcaatatcttctgaatacacaaaagttgtaatgcccatatctctaatttctttttctaattggattgttctaatatgatggcgtaacaaagaaatctgtctatcttgctttgttttaattgccttttctagcatacgtaatgcgtttgcgtaataacggtctaggtcggcatcttgattttcctttttattttgttttactcgttcgaagaactctgtaggtgatagttcttctaatggtttcgttgttaagttttcagtcatgatacatcctcctaaaaaaatattccttacaggaaataatatatcacctgtaaggaataaagtcaacactatattaaaaaattgttgtaagcatttgactgtggtctaacgctaagacagcatccccagtaacacgcccatcacggtatagaatgattgtagtatcatcagttgagatgtctactttagcctcatgagaggtgatggtaaaccatacgtaatcactgtcagattcgtcttctttacgttcagcatctgaccgcatttgagctatatacatttgtgcaagattatgcccagaagggtctctattagggtctccaaacactgtagatggactaataccttcttcttgtccgtctaatgaaactgtttctaaaatactctcagcaagcatattaggggtatctgtggctcctaaaaaagcgttaggtaattcgtacacaccttcttgaactcggtgtagtaaaatagtagcacctacttctaattggttccttaatacaactaaagaaacgttaaatcctactttttcaatcatgttctttcctccatttttccatttcatttattttatcaggcaatgttcttcttgttaaacagcctgtagtacttacatgaagcctttgaactccattatttttgcctagaacttcgtctgctttcttatagagcatgtctgtatgttttggacaagctatctcattaaaagatgctccgttatctgctacacttacaatcccgtttgcacagaatcgactacgacaacctatacattcattcgctagcttcttcatgagcaacctcccactctgtggcttcccttaactgtagctgtctagcttcttctaaaggactgatataatcaggtagctcatctaccggtgtaaaacgttttgtcccgtcttcaagtataccataaaaatggtctgccggacgtgcaaaaactgtgttagcatttggtgaataagggttaggatacattcttcgatacaatactaactgctccccagtctctgtatgaagtacatcatcatattctagtgtagcataataagcacccttataatgacgaaaccacgttccggctctatgcttatattccattcctcttcccccctaaagaaaagctagcactaggctagctctttatttttacctttgattaatttaccactttcatcataccacgcatagatggcagttacaacatttgtttgatataaaacatctctaattgcaaaccagtagttaccagaaccgaaatctagtaagaaccaaaagaagttacttgcaaaccatccccaccatgaaaagtcaattcgcataatcattaagaattgagatacgattcctagcaagtaagcaataatgttaccccaatacatgatgttacccattagggaaccatctgtagtaaagccgattttatctccgtacataattaagacaattaaacctacaattgtgaatgctaaagtaaatactacccaaaaagcgttcatcttacctactttaatacgcccatcttcatcttgattggattcttttgtccactcttttaacccaataatgtgtgtaataccgtagtaaatacctgcaaaagccaaaccgaaattcccaaacatagtattaataatgatttcaccaacgttagagctaatacctaagatatttcccattttaggatagcggtctgctaaagataccacacaaggtacacctaagcagtacgctgtgatataaaataaccagttagttttatctgaccagtcggtgacaaacacccctacaaccagtcccagtactaccaaagtgattgcgtactgtttgcgccatttcccattagctagtgaaatattgtccataaatgttttcatattatttctcctccttgttagtccaaatttcgtcaacgtataattgcaacgtgtcaactgtagttccttctaggtacttttcgataattttcttgcaaagttcataacgagtttcataatcactcgcagttacttccacatatgggatatgattctccgcatataatttcttcaacaggttttggaagtcttgtctacgtttttcatcaccgattaaacgcataccatcgtctacccatttagtcgaattatctaacaaaataaccaaatcaaagcggtcattatcaatcttatcttgtacagatggatgaggttttccttcgtacgtaatacagaaggcttgtgtggctacgtagtctgtatccgaaatagtaaatctattagcattacgtcttgcaaatcgaacgtcttgatagtgaccgttagcaattgcttggtagtcactgtactgtaatgcactctcatctccacctaattcaagttcacagtagttgcgaccgtattcccaaacagtcgtagtagcaaagtagttacctagcttatctaccatcaaagttttaccactagactctcctcctgcaattacaattgtaggagccaatgcttcccggctagcacgaggtagatagtcccagtacttaatagggttgttacgtacttttgttgcactaatattaacattagaacgctcggggtctactaacgtagtaggacagccaaagtatttttggtacccttccgcatcctgtggttcacttgaaaagaatgttgcttcttcccaatcaaaacctctttcagccaacacacgattacctgttacagtctctttcacaaggtttgcccatgcttcccatccgttagggtactctggaatgtttgattcatctacgagtacaggaatgataacatctcgttgaacttgaaaagtcttttgaacaattcgtagtttgtctcgtgctgttagtggacgtttcatgttagaatccatgtataaacggtcgtctcgactatctgagtggcttaccactacaacaagagtctctacttgtgtgcttgctttttgaatcatatctacatgtcctttgtgtaagggataaaatttcccaactactactccgaactttttcataccttattcctccttttaggtattttttactataattaattataccacactttactagttattttcaatataaaaatagccataaattaaaccaattgttagtgcaatccacccgataacaattaataccgtagaaaggattcctttagacaatttggactcaacaaatttatcatatgcagtataagaaacgttaatagcactgtctttacctctgactgactgtaacccattttcactagcatccgcaagaaaagttaaatgtaacttcttaggtacgccataataggtaatacgtacatctgatgataagtacttagtagttatatacttgccatcgaacccagtaaacttgttaaagtcatatatatggtcgtgtactttaactttatcaacctgtttagtcttagagccatagtatacccattcccagtaagtttctgttttagtttgtgtattacctttctcgtctacataactaactgttctagtccgcatctcatagtgttcctcttccgcaacaactttcatatattccccaccaatacgaggaaacgttactggttttattgctatgaaatcactatgcgtataaaagataccttgttgtgtatctaacacgtaatcatacgtttctttatcatctgccggaatagcagtttcgtacatttgattagattttatccggttctcttctacttttccatgtacccatattcctagtaaactagttaaggtaacaattagcatagggataatgatgaaccggattctactatccacccgcatcatttgctaaacaggtctgtatgacctttaggctccacagggattgttaacaattcataatcttgtacttcatacccttgcagtgcaagtaacttacgatttaagaaagttctagtgaatcgtttataatctgaaatttgtcggttataagctttacgatgactagcaactcgattctctgtaatactgaactctttcattgcttgtttgtaattatcctgtgatttaagttctggatacttttcgactactgcatttaaagtcgttttagctgagtctactttaccagtttctgcttgctgtcttgctttaacaataagttctaacgtactcttttcatagttattatagctctcaatagcatctactaagttttggaacaggtctactcgtctgttttcctcagtatttaaatccccataagcttgctcaatagatacttcgtaactgatagctctattttctacatgttttactccaaaaaatgcaacaatacctaataataaaacccctactagtgaaacaataattgtattcgctttattcatgcgcttttcctcctaagaactgtttaagaatttctctccaattgacatattctgttgtatgccctttgtcatcaatgtaaacatctgcaccaagcttacggctgttatttccatatgctttcatcaaatctggatgattctcattgatgtagtgatagttaataccacattctgccaaaaaactttttgcttgttctaactcttcgccttcacgacatgtccatataagaatttgttttcctgacttgtataggcggttaattacttcttttgcatgtggttgtagccctacaatatttggaaattcacttcttacaatagtgtcatcaaagtcgatagctatgtatttgcactttgataaatctttcatttgcttctcctttcaaataaaaaaggtatacccttctttgctacaagaagaagtataccttatgagtatcaccaagtcaacactatcttacaaattatttgtaagaattttttatttctttaatttttcccatttgtacacccgtaaaactaatacctgtagacgtttctacgtaaggtaatgaggttacggacttactaactaaataatctctagcggatggttcattatcaatattatgctctgtaaactcgattccttcacctttaagcatattttttacaaatgagcaaccaccgcacccattcttagaataaactgttactttaaccatgtgttatttcctcctgtttaaaccattttgaacctgtaaatgctacaacatcgttagctaaataaagcatgtaagttaacattaatacatacacagcgtgaccatgaagagctgtttgaatccatagtgctactgacattaaaccttggaatgtccagaagtaatactgtgcacggaaccctttaacacacaatactgctccaactaaaccaatcattgcacttgtagcatctaagaatgcttgtggagaatgcaaaataactgtatccaacagatacaatgcaacccaaaatacaacaacaagtaccaatgttttaagcatatgtgctcgattcatcttacgaggtttcaaaccttcattccaacgtttagagaagatgattggaatatccaataaaataatatatgctgattgcatgatgatgtcactgtagttccctgttacacttgctactccaataagtagaattgcggaaataaacccaagtaaaccattaattgatttacccattgtaattgttacggtacaagtaaaaccaattattcctgcaatagtggcagttaaacctgttacagtaataccttgtccttgtaataagggtagaataagtcccgtaaacacttgaataaccattcccacaatccataaaattcttgcaggtttagaccatccagttagtccgtctctataatattcatatgtgaataattttttaatatgttccatcttgctgttctttttagcttccattaatttgttactcctccaatgtgtattaaatatctttacgctctatatcccagaaatgtgctacaacatgataaggtacatcaattccagatgactttgcatgattatagaacttcataactgcttgttgattgctttcttcttggtataattctttgtatgcgttaacggcttgtccctcagatatacagcctaattcaaataatttatctataatttgacttacgatttgctgtctatgttctgggttgttaacaaaatcaatctctgtaacatcgagaataatttttgggaaacctaagtctctttccatccaattttgatagttctcatgatgacgtttgaagtactcgtataattcggtaccttcttctactttttcaaattcacgagcacgagcattgattcgtctgatttcttcttcaaaagaacagtttaaaacaaccattaaatctggtgttttcttaggaagtggttctaactccttaagcattctctctagtaaacgatggtagacaccttgttccatttcgttcacatgtccttcttgtactaattggtctaagaagatactatcttcaaatatagaccggtctaaaataccgttatccacactcattgcttcttgaatcatttcaaagcgtttggataacatatctatttgaaaaagtagtccgtattttgatttgtcttggtaaaacaattcaagcattggattctcttctacaggttcataaactgcttttgtatctaataggtttgctaatatttctgtcattgatgatttacctacaccaataactccggctaacgtaattatcataaccaactcctcgggatatttattttttgacaatattaagagcctgactagcaggctctaataaaccttacatatgttttacacgtgcatctatttctttcttacgtccatgtgcattaggacgagcttgtggttgacctaaataaccacattgtcttttaacaacatcacatgttgcagggtcattattaccacattgcgggcattcataaccatctgatgtagggttaaactctccatcaaaaccgcattcatgacatttatcaattggggtgtttgttccaagataaccaactttatcgtagctgtagtcccaaacagcttctaacgccttaaggttgtgaactagtttagggtattctacataatggataaaaccaccggaagcatattttggaaactctttttcaaaatcaatcttttcaaaaggtgttggagctttgcgaacatcatagtggaagctatttgtatagtattctttatctgtgatattctcaataactccgtatttttctgtatccatgcgacagaatctatcagttaaactttcacttggtgttgagtagatagagaaccagattcccgtctcttttgtccattcatcctttttatcataaagcttacgtagaacatctaaagcaaactcttttgcctcttcatgatgtgggtctgttttatcttgccaatcaccaccatagaacatgctagcaacctcgtacagcccaatatagcccatagaaaccgttgcacggttatttatgaacaattgttttacatcgtcatcatcggttaaattagccccaaaagcaccatgtttgtacaagataggagcattctttggttgagcttcgtaagtacgttcgattcgataaaccaaagcatcatgtaataccttagctcgttcttcaaaaatttcccagaagacttctttatccccttctgattcaatagcaatacgtggtaagttaagagttactactcctaaattcatacgaccagagtttacttcgtttccatgttcatctttccatccttgtaagaatgaacgacaacccataggacatttaaatgaacctgttagctcaacaattttgtcataattcaaaatatcagggtacatacgtttagctgaacattctaatgctaactgttttacttcatagttagggtcttctggtttacggttaactccgtctttaatagtgaacaataatttagggaagattgctgtacgtccttctgtacctagaccttggatacgtactttaaaaatagctttttgaatttctctttcccaacgtccagtacctaaaccaaaaccaatagacgtgaaaggagtctgaccattcgatgtaaataacgtattaatttcatactctaggctttgcattgcatcgtaaatatctttgtttgttttctcgattgcatatgtttctggctcaggaatacgataacgtttagcatctgtcatatgtttttgataattcatttcagcataaggtgctaatacttcatcaatgcggtcaaacgaacaaccaccatattgactggaagccacattcgcaataatttgtgctgtttgtgctgtagctgtttgaatggaatgaggtgaaccgatttctgcattacccattttaaacccgttcttcaacatatattcaaagtcaatcaaacaacaattagtcattggacggtaaggttggtagtctaaatcgtgataatgaatatctccacgtaaatgtgcgttagctacatgaggagggagcattttaagaccctcaactttattaactgtacctgctgtaaggtctcgttctgttgcaaaggtatttgagtccttatttgcattctcattgacaatagttttgtccttttcttgtagcttacgtaatcttacattaatgtctgtatcacctgcacgttcagcatcacgtaaagaacgaaactcaatatagtttctagctacgtttttagcaaaagatttcattaattcctgctctacaatactttggagttttgcaatatcgacacgtcctgtatcgctgtaatgcttcactacaaagcgtttaacacgttcagctataatctcccctaaatctgttttagcgcccgtagcatccttctcagctcgtcctacggcacgtacaatccttccttcattaaacttgacagttcttccgtctcgtttaactacaaaaatctgctttgtcttaacatctacatcttgtgttgcttgcactcaaaattccgcctttcttacaatatctagtatacttagtatagcataacaatacttacagtacaagatgtaattgttaacaaaaaataaaagactacaaactaagttgtagcctttttcaacaaatattacaaattgattaattttttctcagattagctcacctaagaaatcttcaccatcatctggtttcttgtgcttatactcatccgttttgagcattaggtacttgttacctgtttctacttgtaacctctcaaaagctctacggtactcctcagcactagatgtagcatctagtaggaacttagcattaaggatggctaaaacagctagtagctcttctcgactaccggacatctgtaccttaactttaccatcctcagtcgtataagctccgattttattcttgattgccacagttacacctcttaatcttttaatttaattttaggcatagcttcaagaagtttattattgaactttccagaaataacagcttccccaagttcatttgttaccacggaaatccagtaaggagacttcggtttcaaacgattgttattaacatctaggaatgctctaaacaatcgagggaaagaggttactcctactaatttactagcaaggtcatgcgcaataactttcttagtgaaacgctctgcattgaatgagtctagcgtatacaacaagaaataaactccctgcaactgtgtgtttgacctaaaatctgttgaatcaataaacttttgatacgactgagcaaacttgacatattctttatagttacggaaacggaacgcaccatcacgtacaacatctgtttttcttcctgctgtactactataacctaacgcagtagaaatagtagaggacacccgtaatgccggatacgtagacatcaagttcaacagttgtttataactttggtatcctgattcggcatacttatggatgtagtcttcgaccttccatgatttacttgtactattcaattctgcaacatcaatgtcactgtcatcgaacgtataagtaatgggtaacccaagttcacgagctacagctaaacggtgttgtccgtcaataacttccatctttcgatttactttaatttcagtaagtactccacgtttcgcaattgagtcccgtaaagctttagaaattttaactggtctgtttccttttagttgtttgaatttagacaggtctgctgtttcatagacctgttttactgctttatcttgcttcttttctttagacacctgtcatctctcccttaattattttttgtattgaatgctttgacttacctcagtgattttcttaacctttttaaatacattaggataacatttttccaaggtatttcggtctacaccaatgcgttcataggcgctaataagtttgaatgttccgtattgagattcaacttttgttttcttaagttgaatcatttgttcaagaatttcttttctaagttcgtctctttgctcgtttaaagaatcaagcaactcctgaacacgtttgtattccttaaagttgcgctctaattctttttcttttacttctgtagttgttagtctcatgaccatctctccctttctttactatactcaaagtatatcattacatattataaaagtcaacacctatcttacaaaaaattgccaaaaaatatttggcaatcagtttttgtcatcaggttctaatagcttgtccgcaggcatatcaaaaatccgagctaatttagcttgattatttgctctgggttttttgattccatgctcccaataggatacggttgaccaatgtacacctagttttttagctacagaacgcaaggattcatgcttttcttcacgaacacgtttcagcaccaagggttttggcttgctttccacgattctcccctccattctatatataactacagccctaggaaaacctagggcaagtagattatttaagtgcttcttttacaaagtcgtattctggtttatttaacacagacaacatcatttcttctggggaagtaatttctccacctaacacttgtgttaagatgtttgtggagaacccagatactaaagctgttcctttttcgtcaaaacgtacaggtgtattatcatgacgagagtttacattccagaatactacagatggtagctcgtaacctgcctgttcgaacttaagttttgcttgttcatagttagtgtaacctgccacaccttggtcaaattccatatcggaaataataacgatttttgaaggtaactcattttgtggtgtgtggtttttcaccgcagtagataaaatcaagtcgaatactttttgtaaatttgtatttctagcattgtatgaacatttatcgtaagctttcatcttatccataagtgtacctgacaatggtaagtttactaaacgaggttgttcagaaaatacgatgaaatgacctttgaatgcaccacttaagcgttcagcagtgtagatagctaaaccttctgcaacttcccaaggggtaacattttctgtaccaccccatgtcatagaaccagaagtatccgcaactacaattgcattatcttcaatatctttcaacacatcgtccatagatttccatgttgcttctagtgaacggtctaatgttctgtagtaacttctgctaccataagcccgaattacttcatgaggtaacatgttctttgcgttcattgttacttccccagattctactttagaaagtaaatcttcatattcgtctggcatgtgtaattgcaaagctttacggtatttgaacaatgctttagaggatacttggttcaaatcaatcttatggtattccttgcttgctaaccgaacttcaattacatttaaataatcacgtaatttagcaatcattttacgataacgagttagacctgctttaccttcaaaacctaaatagttagcaatacgagcaccttgattacgtttcttgctatttggagaacttacattagctaaccatttacctagtaatgatacaggcttaccttctgacatgtttttaatatcagatgttagttggttcccgatgatacgtgcaccttctgtatccacaaagtgaatactacgcttgtgtgcgtactccatagtttcaaataagtctgtccaacgaccaacatatgccatgtactccattaaagtaacgattacttgcttgttttggttgcgaccatccactaagtacttgattgcttctaggtaagcggaacgttcacccaatccacctaaacggatattacgtaagtgtaccaaattgcgtaatgctaactctgggttttcatcgtaagctttagcaaacatgtttcgtacatctcctaaacgaccacgcatagcccctgcttgtgcaaagaagtctaagttagcgtttaaagttgatgtataagttttagctccattttctgtagagccaacagttgtttcttcttttaggttgtctaaaaatgacatctgacatctctcctttgtatggtaatgttttatctaacaccactataacatgtaatattatgtaagtcaacactttttgtaaataaaaaactcatccgattaagaatgagtttgtatgtaatatcaagaaccacaggcttaattaaattcaatagttttaatttgttagttgattgctgtagggttctttatgctctggcaacctaagaggttagagctatggcaaaataccaaaacctttttaatatgtaacaagaatctattttatacgttgctctaccaactgagctacaggaggaatcatcctcccggcaggactcgaacctgcgacccacggctccataggcaataaaaattgctgttagattctttatgttccggcacccattaaggatggaactatagctatgctaaaaccgttttatttatgtaacaagaacgcattaactttaagctttaccaattaagctataccaccaatggtggcagttggattcgaaccaacaactcacatttttcagatgtattagttttaaaagtttgctgtggcgttctttatgttccggctacctgttaggttggaactatgacatatgtcaaaacctttttatcttgtctttataatagcataaactattcaaactgtcaactattaatttaaatatattgaaacttatttaaaagctccaatatatttaacagtacccttgcatttacgtgcaaaagcttctagctctttacgagcacctaaacggtctggttgagaagactgtactgtaacttcttttggtacagtaatttcacgagttttcttaactgtctttccgttttttaacttttgttcgtactcttctgtacgagtagaagttgttgaaataattccgtaaaatttagacatgttatgtgacctccggtcattttattttaatggggagtgatggagttgcaccacccgagctttcgcaactgatttacagtcagccccgctactacttacggtataactccccgcataagtatgtatatatcaatacaatgtacaagaacttttagtgaggtagctctcatagtgtattaatggggtacattgtgtaacttcaactagtattgcctcacacgtgactagtcttatatacacaatgcctacatacaacccgatagaccacccttggtacgcatattaagaggcgcagggtgatacgaatatatggattgcaggattcgaacccgcaccctttggttggaagccgaagatactacccttatactaaatccacataatgttaataggcgggtacccgacagcgaagtatcattcctgtcttgtcattctcctattaactccataataccttgcctagagttgagctaggactcacaattaccgaaggtactaatcgggaaagcaggactcgaacctacgaccccacgctcccaaaacgtgtgcgctaccaactgcgctatttcccgttaacttatacatatattataacacaaacttacatgatgtcaacaactatttgtaagtttttttaatttatccattcgggacagtgtgctttaaccattcagccacccgcaggggtaacccgcaggacgggattcgaacccgtataccactgtcctattggataggcttgtgtacctgtcatcttccgattacacacacctagtctagttaccgtaccaatagatttgacaggaatctagggtaacgcccaatatggtgttaattcacctcgtattctgttacaggtttgcaaccctgaacaaggatgaccaatcctaatggagcatagcggactcgaaccgctgaccccctgcgtgcaaagcaggtgctctcccaactgagctaatgccccgtataaaacatctccgctgagattcgaactcagaatgcgggattagaaatcctgtggtttatccaattagcctacggagatatgattgtttacagataaggtactcctgtaaacaattcaattgcttcaatttcagtatgaaagttttcccattctaaacattcatagaaatcttttaagatatgcttgtctttcctgtaaacagtctcacctttatgggctttctcacagatttctctaacagcatccacattatacttaccaccagttttatactgctctaaaccagaatctaataaaactcgttgtacttcttcacttttatctcctgctttccaagaatcaaaagctttttcaaacagtgtgtcctccatgttttcaccttctacttccatgattgattgaataaatcttttccacttagaaggctccttgtgtttacctttacgaaaactcatgattagcctccattatctttaatgaaccgaggaggagggactcgaacccccaaacgcttttacacgtctatgacttttcaagagtcaattttttccagttatgatactccccgaaaaagaaattgattgactagtactgttagttgactagccaaccggaactacttaaaccgaactctttaaacagctttagtagtttatatttcaaatggaaggcatgggattcgaacccacacatgctgttatacatctacttggtttccaaccaagcctctttaccgtttgagtaaccttccgtcttgggagcaggcgggtttgtgtcaagtacacaatacctaatcttttgtgcatgttgttccctaggcttcatgcacaccctactatctgcatactaacagacctgccaattttctaacactttttctaatgcttcgtatggacacattactgtcttaccgtgaacatcatgtattctcaaaataatataatgctcatttatctcggaggtaacaaagtatatcttgtccttcactaaacctaaacttccgtttaaaccaatgaattttaaatacatcatgttacctcctaactatgtataacccatgaagcatcatggggggactgtagtatgcccaacctgcggggatgctccgctctgaatccgtagaaatcagccacaattatgtcactggtaaggatttgcaccttacatgcacgcttccattagttagtcggcaccttcgagatagggacatacagcttcaattttctaatggatttataggaatctagccttacagttgtttacccgacttgttctagactagcctgaatcttcccctgtgctatactgtgttaattagcgtttacctattccgccacagtgactatggagctgacgggactcgaacccgtgtcctaacgtagaaccatacaaaattctacgggcgtagttactagttttaatctacgttaaggttacaactaataactgaaattaccttaactgagtggtaaagcctctcctgagttatccacttttacctcagcgttgtcggttgatgagtcctctaggtagaaccgaccctagtctagaggggtaagtgtgtagctagtctaaaactaggctacagctaataattcttcgtttttagcagttatatttactgcgatgattaagtcatcactctgcccgctattcatatactccttacgccagtcgaaaccaaaacagccccaacataagaatttcttttgactaaccctacccttccggcagggtctaatcaaaagtatacaattaaaaaaatgaaaatgagttacggaaaatgtaacgtctccaccaccggactataagggtaagttgttccggtctttaacctaagtactttacttaaatctaacaggacagtcttcattacgtaaactacttaaccatgtaaaacgtaaaggtcaatttccgttgacctaatacaagaggagggattcgaaccctcacgcccatcacaggcatggcattctaagtgccacatgtctaccaattccaacactctcgcataataacagtcctacccacctactgttctgctagcatatagcttgcaggctttttatctgtgttataaaaaccagaaaggttatacaggtaacaggagtcgaacctgcatgtcacaagggacaatggattttaagtccacagcgtataccaattccgccatacccgcataatcactttttatgaaacaaggagaagtgtaaccttgggttattccgacatttgcagaactcgtaaccaacgagcgcatctaccctcagaaaggattttgtccctgccgacttcactgctttgtcaatgttagcctgcttgctaagatagatgtcttccttacaagaattactatacagcatcttgtaaggaaagtcaacacttacatataaatttatttaaaaaagttttgatgaatctaattgagagaaactttcgggtagagaacctagttcttccatgtactcttggtcaatctcgtaaacagttaactccgttacttcattttcaatagtaagtttcattgcttctgctgtttgtatactgtgtccttctacttgaagcttatcatcaagataaatgccttcccagtctcctgcaactacataatctgctttcaagatattacctactttcttctcaatttctgataaaaattattatccttgtaatcatcctcgtgggcatagaattttttcatgtcatatgtccaacaagtttcttctactcgtttatgatgtgtcaatgttacttcatcatcaaaacgaccttgatttaatttatgcctgtaatttctgttaaccattctttttatatctcgaacagttgaatctttcatacaaacatatcggtaatagggttttctgtaacttctactcattgtaagtcctccttaatagatacttacaatttagacaatactttcttcacaggaaccactccttattaataaaagctacctcccgaaaaacgtttcttcaccaaagtgtaagacgtaaactaacgacaggtcatagttttccaattaaggcaaataccagtgagaggatttgaacctctgacacccgccttatcaagacgatgctctaaccaactgagctacactggtgtgacccatgtgtcaggactttcacctgttctcggggtgccccgcctctctactaatctccccattcggtgcccctactagagtgactagagatagttagcaataaaaattatatatcatgaatcaaatttttactgcatcctatatacacgataccgtctacaggatttgaacctgtgacatccaccttgtaagggtggcgttctcccactgaactaagacggtgaaatatggaaccctaccagaggatttctttcggtattacaatcacctcggcatgaacaaagccagatattgaggtctggacttctcacgccccgggagtcgaacccagtatagacaaaccatattttatacggaagacaggattcgaacctgcgatataggagttttagtgcactcattatctcccacggtatccgctacgtattgccatcacgtcacttccgtatgttaaccgacagtaaaggaatcgaacctctatcactagattcgtagtctagcatcctatccaattgaacgaactgtcgctctaagctagcaattacgcagactgactatgggcaccttcgtcccgtcccctgtaagtgccctcctacaggttgtccgtggcaccgcaatgtactaaccgatgtccccacagggatttgaaccccgaaccccccgattaaaagtcgggtgctctagccgattgagctatgaagacagttgtgtttttcaagataaccctctcgaaaaaccgttactaatagaaaaactaagggtctcgactgacagatttgaactgcctgctcctcctaagaggcgtgttaccaaagccatacaccaactcttcgagaatatcccctacaggattcgaacctgtgaccccctgattaagagtcaggtgctaccaccaactgagctaaggagataagattaccaatagctagttaagccttacggaatcgaaccgccatgaggttatgaagctcacatagaccactagacacaaaactagcttattgataaaattctatatagataattgtatgcaatgttcgcactaactaaccagataaccagtcaatcattcaaaacattaatttgtgagtttccgctcacaatgctgattgagagaatcgaactcccattcccgggttacaaagccggagtaatagccgttatactaaatcagcgtaacccctcaatagaggggaattattatactaagttaccatacccgtaggtatttgtttgagcttgtttaaacataatgctcttgatagttaagtcgttgtacttttcatcgtcttcatcatcaaggtacacatcaacgttaacgttcttaccggaaataccgattgtttcgtctttaccaactgttaagtctttactgttgaaggatacatcaaagtagatgctatcttcttttgtacgactaccgaacgaaactctgtcaccaaataaatccaagcttcgagagttgattacaacaggttgtaacccaccttcaaattgaatagttactgtataatattgattttcaatattaaggatatttaaatcagcaatagcttcaccaaatgggataccaaagcttaattccaatgcaattgctcgtaagcagtcatagtttaacttaattctacggctaaacttaacaacactgtcaatttcaccatagtaagcttcgtctaacttatcttgcaagtaagtacgaatttcatctgcatcaggatattcgaaacgtaaatggtaatggaaacgtcccggacggttaagcataaagtcatttacacgacttaagctattaacagtaagagcgtagatacgtttacgttgtgataaaccatcgaataagctcaatagtttttcttgtggttcacgaccgtcacggtcattgaatactttttcaaattcatcgaacaggataagagactcttggtcaatactgtcaataaattctgcaatccccggataagcttctgtaattaagataacaggcatatcctcttcaatagctcgttgagataagatttgagtaaatagtgatttaccaatccctttgtctccacttaaaatgattcctaagctacgattaattgttttaaatgtgtgtagcactttttcaattttagctaaacggtcaccgtaaactttaggttctttcaattcaaaatcgtctgttactactagtgagaacccagacattggattgaatcgaactttataagtttgcgcaggcaacttatcataagttttaaggtcgtttgcataaatttcatagttactaccatagttgattactttcataaatattccccttattcgtgttttattagcatttgctaatggagaggggtggaattgaaccaccgacccctagggtttcaatctagtgctctaacctactgagctacctctccgtgtcaatttggacttatcccccacgtggttactaagataagtcctatgcctttgaagtgtggatactcaaaaatgagtacaggtactaaaaatctgatgacaagtcagatttatgtcataagcagaaggtgagattcgaactcacgttcaggggtttgcaatccctagccttaacccacttggctactcccgcattggcatccctctaggtttttatctgcatcgggactcacataaactgataagtgaaaacagggcactagtctgttttacacctgcgctatcagaacctagactcggcaacactgccttagatgactttactcttgtaaacacgtcacattcttcaacaattaccagtagagtgctacataccagtaattcgttcctgtgaaggatagtacactataactatcaccgctgtccaagaatacacgccgtgaaggattcgaacccccgtcttccgggttggagccggaaatgatagccactacaccaacagcgcaagattcggaggggagggactagcaaccctccgaaaaatgtaagataatgagagattaaaacatgccactattaaaagtggaataggtaattaaggattcgaaccttacaagcccttactgcttaccttgtaaacttatagtatcatgcgttgtaccgaaagtcaacactttttataaaaataatagggagaaatatttctccctaaaaatggactataccggaattgaaccgatgacctgtcagttatgagctgacggctctgacctactgagctaatagtccgtgtaataataccacgaaataaaccttagtaagtcatatagtcccagaaagggagacatatgaaactagtgttgaatgccataatcgtttaataaatgtgactgagagagtaataaatttcttaggcatgtccatatgcctcctttccaataatgatagttttaagatataaacagaataaataaaagagaaaataataatgaataatagcgcatgagagagtcgaactctcgattccggttcgaaagaccggtgtcttgaccgcttgaccaatgcgccataaacgagctatatgggacttgaacccatgaccttctccgtgacagggagacgagcactcctgactgctccaatagcccaatgtttccccaaccaccgccacctaagggattcgtacgtctacgtgagttttttggttatacattattgttcaagacaataaattgtacgagtggaataccaatttaccactctgcggttcctattgcggtaggtgggagtcgaacccactaaagcttggttatgagccaagtgcctaaaccgttcggcatctccgcagtaatacaagtctggttaaaaactcaaaacttaatagattaagggcttttcttcctgcttcatatacactcactgcattcggtcacatactcagagaggctgaaccatcgggagctacccaatagcttctctctgcctttaatgtatggtctagcacggtggctaacaacgttcacctaaacattcagcattaaaagtattattttacatataacccatatgtcttctgtaatattttcatccaacgctgacttaagctacttgtaccaaggtctcttgttaaacctgtatttctacagttctcgtcaaagggagtcttttgagttttccaaggtctgccaagcttctcacacttccacctaacttggattcttttccacaggaacgtctattgtatcccccaagagtcttgtaccttacaatccatgtatactccacataacgcttaactgatattagcttttactaatagttactcctatgttaccataagacctacctgcaacccaaagcactatcgcaccttcggttacatccagactcacgccacgttatcctagcaagctgttcaaactttctgcactaggttcaaaatctattaagttttcaatttttaaccactaacttgtggtgtaatactaatatagcataacattacaaagttgtaaacacctttttgtaagtttttttgatttttttgatggaaggtaagggggtcgaacccttacaccggatttctccgacctaactgattagcaatcagccctcttaaccatttgagtaaccttccaaaagcaaaaagggaacccctgtaattaaacaggggtaagagagatgtctctaaaagcctacaaccattataacatagaaacatagtttgtacagccgtaactgtacaactgtcaggacagggttcgaacctgtatcgcaaccttcaaagggtcgtgtcctacctgttagacgacctgacaaaaaggtggaacctccctaaatttggggaagagggaggttctcatgctattaacaaacacgaatttgctaaccaagtaatcttgactagcaactcacctagcaggacttgaacctacaagaactggttaacagccagtcatgataccgtttcatcataggtgaattttagttctatcaacattataacacaaaagctgatagaactagcaactttttttacaaacttaacaacttttttcttaactactgattcagcaacttactcaatagttaaagacttaaagaaagaggaagtaattgaggtatgtcaatcactaactaaagtatacaacatttttatcatcctgacaacaactaaatgcaaaaaagttcaaaaaagattataaatagttaaattatcagaatattcaaattaatgtcctattttaaatttttgacctccttatatacttaatactatatattaaatctatatatctaaattatataattattagactatatattattaatatatataagacttgcaaaaaattaaaataggacatttttctgacaattcacttttagataaaaagaaagagagcaaaatgccctcttaccgtgtttcaaagtattccttgattgtatactctctagcttctttagcttcctcagtttcatctttaggagctaaatacaatttagtaattgtagcgggtacctctaccatcttatagtcaataaaagtagcttgacgtagatttaagtatcggatacctgttgttctatcagtacctgtatgaacaggcaagaaagttaattctttacctctgacagaaccattagcttgtgttagtgcatcaactacagttccgcccatatagcgtggaaataggtaaaccttgtcagtacctactgtaatttctgcgaccttttcgtgtgttggatagttcacttataatttctcctttcagaatatgctataattacagtataagtataacacattctatggtttaaaaatgctgaacacgtaagtcacaaccgcaccgagaacaatcatgaagatgttttccacgatgtctcttttatggtcaaactctttgtcgtttacaccttcgagagcatcaatggtttcttccagttttgtaatctggtacgtaagatgtgaatatttctcttcatgaacagctaaccttttatcaagactgttaacgatgtccttcaattcactaactgcattattcagttctgtgttgtcctgtttaatgcccttctcagttagttctccatgttggagcttgtcttccaatcgttgcagtcttaatactaggtcacctacttggtaatcgttcatttgtgctccccctctcggttgtatagctcaatctcccggtcagttagaaaaccacatgtaaccgcctatgcccagaatacatccgacaaggtaaataattggagtatacagcccaatgaagagcataaccacgctaccaacactaagtccgtataatatcaaaagatacttatacgatgccaaaggacttaaatctgcttgcagttttttgtactgtatagctcgggtgacatagtaggatgctgagtaaacgaacaactgtagcaataacatagcaataaatgctagtcggtacattctatcgcctctcttctttcctagagctatctttaatatagtacaccaaagcctttataatcaggtgtgctagattaaatatgtaggctaaaaaatataaacggaagagtgagaaaaagtgaaggtacggaaaaaattattatacaaatcaatttttatcaccatctctgttatcatcatgatttgtgcaagcaagctgattgcagatatgctaggcttagaacaacactttacaacaacaatgcttgtaggaggttctttgtgggcttggatagctagtattgtctttgattcttatgagaagaggaaaaagaaagataatctacagcaacagcttcatgaagcactgcgtgatttaaaagagataaaagcgttaatcaaaaaataattaataaggggtggaggatatgtcccttacaagagaagaaataaagcaaaaaaggcagtatatttttagcaaagctcaaaagacgacaaatatacgaaaaggggataaacgcatagcaagtgctacacggatgtgtgcagtatgtggaagaccgttgtctagacttgttcttactaatggttctgcaatagttactacagcacatgtaagctgtaagatgtcagatttagtacgattgaacatgtgtgaagacatacggtcttgctatgcgtatacaagtaaaaagggggaggaatagccacatgagtatggcagaccgtattaaagaaaatgctgaacaaaagaaaatggaacgtacatccgaacaacgattacgtgacacatttaataatgcttctctcacgttaattaaccagttcatggctaaagttatggcaggttcaatagatatagatgacgttggggatttaacccgtctattccaaatctacatgcaaattaataatatcaatgcaggaatgcaagagggaactggtcaattacctgctcttagtgctacgcaaaaagatattattgcagataaggtaagcactgaaaaggctaccatagacggagaggaggaggaagttgtttcgttggaagagttagctaaattatcagacgaagaaattgataagatgctattggataaggaaatccaaatgaacaaagaaaacgaagcaacgttttaatgacaaataaagcacaacatattgctaaaatggcaaaagaaatgtatgggacggacaaaataacaactgcacagcttgcctacatcacagacatgttaactccgtccacatatttactaagaaaccactccgttcgtaatcatccgattacatttatgatttccggacgtgaccaacaaaaagcccaagcacatagaccttggcaagtaaaaattattaatgaccaacatcgaacaaaggcagttattaaatcacggcaattagggctttcagaaatgggtgtaggaaccatgctacactttgcagatacacatagttacgatgcagttaagtgtttgtataccttcccaacaaacgaacaaatgactaaattcgtacaaacacgtcttgaccccgtattgcaacgtggttattacagtacgattattgacccagaagtagactcattaaaggctaagaagattcgtaatagctttttatacttccgttcaagctctaaaccgggagctgtagagggggtcgatattgattacctatctatggatgagtacgaccgtgttcctgcattagccgaagcttctgcattggaatctatgtcatcttctccatataagattgttactcgttggtctaccccatcagctcctgatgtaggtatccatgctttgtttgaacagtctgaccaatactggtacctacacaaatgtgataagtgtaatcattataaccaaatgaactatgaagactatgtaccagaggcaccagtggaacgtagagggaacatcctttgtgtaaatcctaaaggggtagacccaattgctaaaacagttgtggatggctccttccaattcgtttgtcaaaaatgtggagagccattagaccgttggtacaatggtatatgggttcctaaatatccagaccgtactaaaaatggtctaggtattcgaggatacatgatttctcaaatgaatgctgtttgggtatctgctgaccaattaaaaacaaaagagctaacatcactatcgaaacaagcgttctataactatacgttgggttacccttatgctgaccaaaaacttactgttaatgccggtgacgtagaacgtaacagacgtggagacctcccagaatctcctagagaccgtggagattacaagtttatctctgtaggtattgactggggaaacagacactgggtgtccattcatggcgttagaacgaatggtcaagtagatttaattaaattgttctctgtaggtaaagctaacccgttaaaccctgatgcaattgatacagatattcagtcaattcgattacaattagcaccatatgaacctgatattatcgttgctgatgttggtgactctggtgataaagttgctaaactgattcagatttatggtaaagaccgtgtatttggttgtgtatacccatctacacctaaatctacaggtaacttagtgcctagttggaatgttcaaggtaacaaggtatctgctgataagctaatgcagaataaacgatacatctcaaacatgaaagatggagttattggtttctaccacaaaatggatagtgaactaatgctttacattgaacactggggaaatgtagtaattcgtgatgaagaggatgaaaaatctcctacaggattccgacaaaccatcggacgtaaaggtgatgaccactattcacaagctagtgtttattccatgttaggttatgaacatttgatgaacgtatttacaggggcagatgactacgggtttaactctgattggatttctactcaattgaaccctacacctcctgatatttttactcagtttacttaaaaaagcaaaatgtcctattttaatttttctacgtccttatatattaatactatatatctatatacctatatctagttagtaagtatatatagtataatatattatataagggagacaaaaatttaaaataggacatttttattaaattagctattgattgacaaaaaataatatgctattatactacttgtcaataatagcactagttattttttcttgtcataacaataaaggagacgtttacatgaatgacaatcaagaataccaagctcttgttgataatcttcttagctctgttccagaatttaaacctgtagaagctacagtcagtaaatcctttttagaaggtatgctaggcaagaagttagactacgggtacgttatatcagaaaatgaaaaattatcaaaagactattcacatattgtgaaggcttatggttttaactccttttatgacctatactgctatgctgatagttgtgattcactaaatgactatttaattaaaggtggtcaaaaagatttatcaaagttgaagccagttaaaagacgagtaatgagaaatggtaaaatgatgacgactactatctacgaagacagttccggagaagatgatgataaaaacccattagataaggacactcaaacagaggaaaatgttgagccaagaaatgctagagatttaagcaaaacaattattggagatgaccataatggtatagacccaaaacaaattgctaaacttaaaactgaggcaggtaatctaaatgggacattttcaactgattgttcttcatacttagttcttcaaggagaaaccggagaaattggtggtgtggcaggttatcgtaaagagggtagctatttatatttagctttctaccaatcagacgaccttacaagtggagtggcttatgtagcatttacacaactattgttacgtgctcgtaaacttggcttgggcgctaagattgatgctactgatgacccgttagcactagaattatttaaagaatacggacttaaaaaaagtggtagttgttatataatttccaagagttccctactggaagcgcttggggagccatgatttcaacttttgagttatttttaattttagccttctcaacaaccgtgtttatatgctataatctttttgtagctcaaacagtcaagacaatttttgatttgagaaaaaaggcacaagttgtgctaactgaaagagcaactgagctaacgaagaagttaacaaacatactgaaaggggatgtacaggagttgccagagaaagaaaacgtaattattaacgaacaaacactctctgacttgttagtcgaaaaagcaagcgatgccgactacaaattgttcattgagaaactgacagagattgtaaaggatttatattcaaattatcaatttcttcgtcaagacccacaacccgatgatttcatgtcaggttattttttagggttccaagtttttagagaggaataccctgtcgaatatgagtatttattccgattagctattgaccgtgggttagacgatattaaaatcaataaactctttgtcgaagctttacaaaacggagaggtattaccattaggagatgccattgtagaccctaacttgtccggatgcagttctatccttcaagcacaagaagtacgtgtaaacattgtattcgcacctaaagcatacatggagcgtaaagaagagctgattgaagaaaaaactgctgaaatggaaaagcagaagaaagagcaacaagaactagcaatccaaaaagacaacgtggttaaatctgcacgtcttgctgaggctgtcattaacgaattagtggatgaagtcgcagaaaaacacgaactacaagaactcgttaaacaaattaaagaaagcatgaggtatttctaaatggcaaaccctacaaccaaagtaacattaaaccaagcattaatcaaagaattgcgtgcacttcaaggaaaaagagagtccttgattgcaagcaatctacatgtaccagaacctcagtcagttatgattccaattcctaatgttttagtaacagatggtgacaaagaggtactaaaatttattaaaaatatcggtttaattagagctgataaatcttttgggttagatgtggcaattgaagcaggagaaaaagtaacccttacagatggacgttcttccactatcttggaatgtattttctattacacaggagatacaaaaattgatgaaattgagcaattcttagaacaaaactaatatttcctgattaaaaagaagctttttttacttgtgctatattaacactgcacaggaaaagagagcttctttttttgtgacttttttacaggaggttgcaagatggcaggagaagtatttagtagtttgattacaagtgttaaccctaatttgatgaacgcaggtagtcgtaacggtattgctattgaccgaattattctacatcacaacgcaacaacaaataaagatgttgctatgaacacatggttattaggtggtagcgcaggtacatctgctcactatgaatgtacaccaacagagattattggatgtgtcggtgaacagtactcagcattccatgccggaggaactggtggcgcagatattcctaagatttctaaccctaaccaacgttcaatcggtattgaaaatgtaaattcaagcggtgctcctaactggtcaatagaccctcgtacagttacaaattgtgctagattagtggcagacatttgtaaacgttatgggattccatgtgaccgacaacatgtcttaggacataacgaagtgactgcaacagcatgtcccggaggaatgaacgtagacgaagtagtacgtcaagcaaaacagtttatggcaggtggaaacagcagtacagctacagccactcgtcaagcattcttcgatgttgtgaacgtaaactctggtgcatttaatgtgcaaggatggttcatccctagcaagtctacaaaaggacaatctatttggttgtactttatggacaagaaaacgaataaagaaattgctcgtttccaaggtaaacgtgtagttcgtgaagacgttaagaaagtatatccatctaaccctaacggagcagatgttggttttaacgttgatggtgcaactccacaaagtcttatgggcaaagactattacttcttgttacgttacaacaacgataacaaagaagaacttttcgtaacagataaagtctttaaagcacctgcactagttaaccgtggttgcctagacgtaattagaggtgacaaaggtcaggttactttacatggatggcatttatcttccaaacgtagaaactctgacaaacacttcttgttcatcatggataagaaaacgaataaagaaattgtgcgttttgacgttacaaaatcttcattcaaagcttccccagatattcaaaaattgtatgacggtacaattgcacaacgaactaattgtagatttgcttttgctcatgcactggatgctaaatcccctgcacgtggtaaagacatctatattttaagtcgttactgctctgaccctgcgggtaacaacgggatttccgaccagttacaacttggtggaactcacaaattgtaacattacattgacctaccttctggtgggtcttttttattactgtaatataatgtaaaggaactgtaatactataggactaactttgtaacactaatttgctatattagttcctgtaagcaacacataaaactaaaacaacccaaaggagaacgacaacttgaagaaaacgacaattgcaacattaggacttttaggactaggactatcattaggattgggagctaaagctcacgcagacgaaatccaagaaaatggacaaacttactggcaagtagaatccggagacacattatcagctattggtaatcgttacggaattgattttaacttaattcaccaagcaaactcagacaaagtttcagatgctaacttgatttatgttggggacaaactattattaccattaaacggtgaagttcaagctcctgtagctcaaccagtgcaagaatcaccagttgtagaacaagcgcctgtagtagaagaaacacctgtagttgaacaggcaccagttgttcaagaaccagtagaacaagctcctgccgttacatctaactcagcaaaagaatggattgcacaaaaagaatctagcggttcttactcagcaactaacggacgttacattggacgttaccaattagatgcttcatacttaaacggtgactattcaccagaaaaccaagaacgtgtagcagatgcttatgttgcaggacgttatggttcatgggaaaatgcacaagctttctggttagctaacggttggtactaaaataataaatactaacagattaaaaaaagactctctttttagggggtctttttcttatgctatattataactgtaacttaaaaacaaacaggaagtgatagctatgagtaacattaacatggaaaccgcaattgcgaacatgtacgctctaaaagcacgaggtattacttactcaatgaactactcccgaacaggtgcagatggcacaggggattgctctggtactgtctatgattctttacgtaaggcaggggctagtgatgcaggttgggtacttaacacagatagtatgcacagttggctagaaaaaaatggttttaaactgattgcacaaaatcaggaatggtcagctaaacgtggagacgttgttatctttggtaaaaaaggtgcaagtggtggttccgcaggtcacgtggttatcttcattagtagtacacagattattcactgtacatggaaatccgcaacggctaacggtgtttacgtagataacgaagcaactacttgtccatatagcatgggttggtatgtgtatcgtttaaatggtggaagtactcctccaaaaccaaacactaagaaagtaaaagtacttaaacacgctaccaactggtctccatcaagtaaaggtgcaaaaatggcaagttttgtcaaaggtggtacatttgaagttaaacaacaacgaccaatttcttattcttactccaatcaagaatacttgattgtaaataaaggaacagtacttggatgggttctttcccaagacattgaaggtggatatggttcagatagagttgggggaagcaaacctaaactacctgccggatttacgaaggaagaagctacgtttattaatggtaatgctcctattactactcgtaagaataaaccaagcttatcttccccaacagctacaccattgtatccgggacaatctgtaagataccttggttggaaatctgctgagggatacatctggatttatgcaacagatggacgttacatccctgtacgacctgtaggtaaggaagcatggggtacatttaagtaacatgacttaagagggctaaatagccctcttttttgtgctatattaaattagtagacagtgatgaaaaattgttacagggctacctgtggtatacttaaactagtacaaatgcttgggaggtaagaatacgtggcatacttacaggacgatacatggcaagcagtaaaacagttagctaaacaaaacggttttgtaggagactggattctaattattcacctctactatgaaaacggtggaaacaatgtacaagttcatactgctatagataataaaaattaccgcatactacgaatcttagataacaaacaggttttattagttgatagagaaggaaacgttgctgtagaggactatgaagtagtcaatgatagtcagaaaggtttcttttatagtgatatgcacaaagtcgaactaacacttccggaaggttgtagcttcaacggtaaacaaagaataaaaatttatatatgaggtaggtgtaatcaagttgccaaaatggttagataaagtgttgggtgtagaagaagatactgacatcgttaaaagcgaagaagtctaccaaaccttgcttaaagaaattcaagcacagccgttaacagaaacggtagagaaaggtatgaatggtaaaccagtagcatacatgcaacctataattggtgacatgtcagtaaaccccggatttaagacaaaaccttctattagaaattctcaggatttacacaaaatgttgaagaagtttggtaataatatcattcttaattcaattattaatacacggtcaaatcaggtatctatgtattgtaaacctgcaagaaactctgagacaggtgtaggttacgaggttcggctgaaagatattgaacaagagccatccacacatgacattgcaaatattaaaagaattgaaagctttttagaaaataccgcagtattcaaagaccaaaatagggataattttactgctttttgtaagaagatggtacgtgcaacttatatgtatgaccaagttaactttgagaaggtattcgataaagatggtaattttatcaaatttgataccgtagaccccacaacaatcttcttagctactaacggtaaaggaaagattattgaaaagggagaacgatttgtacaagtactagacaatcgaatcgtagctaagtttaacgaacgtgaaatggcttttgctgttcgtaacccacgtgctgatattgaagtaggtcagtacggttatccagaactagaaattgccttgaagcagtttattgcacatgaaaacaccgagacgtttaatgaccgattcttctctcacggaggaacaacacgtggtatcttacatgttaaagcaggacaacaacaaagtcagcaagcattagatattttccgtagagaatggagaagttccttatcaggtattaatggttcatggcaaattccagtagtatccgcagaagacgttaagttcgttaacatgacaccatctgctaatgatatgcagtttgaaaaatggttgaactatttaattaacgtaatttctgcgttgtatgggattgaccctgctgaaattaacttcccgaataatgggggagcaactggttctaaaggtggttctttaaacgagggtaactcaaaagagaaaatgcaagcttcccaaaataaagggttacaaccattattacgctttattgaagatactgtaaatactttcattattgctgagtttggagacaagtaccaattccaatttagaggtggagacctaagtgctcaattagacaagattaagattcttgaagcagaagttaaagtgtttaaaacagttaatgaagcacgtgctgaaaaagggttggaaccaattaaaggtggagacgtaatcttagacggtgttctaattcaatccattggtcagttaatgcaacaagaacaatttaactatcaaaaacaacaggataagcttaacaggctcttagagctttctggtggcgaagcagatgattctaatggaattagcttccaagacaaacaacagggcttagatggaacctcagctagcgtaaatggcaaaggagagtcatctgttggtaaagatggacaaattaaaggtaagggcataactaacaccaattctgctaaacaaggtatgaaaggtgacaaacctaacgactggcaaaaataaatagaggggtaacaccctctatttacaattgtccaactgtttagtggtagttctgctatattaaaaacagatgtaagtttaggtggtgaatgaacaaagatgcaagagaagtataatattttcgttcccattgacgtagcaggttccgtagagaaatctgaacaggcaaacgatggtgaatggtacgtacagggttatgctacaacgcctgaccttgacttgcaaggagacattattttaccacagggaattgacatttcttactttgttactaaagggtgggtaaactacgaacataaacaagatgcagaatacattattggtgtaccaactgacaactgttatgtagaccttaataaaggtttgttcgtggaagctaaacttatgaaagaaagcaagtatgctcaatcaatgtggcagttagctaataccattcaaaaatcaggaatctcacgtcagttaggtttctcaattgaaggggcagttacaagtcgaaatgcaagagacaatcgtattattgagggtgtggctatcagaaacgtagcattaactacacatcctgctaacccacaagctacgtgggaaacacttgttaagtcttggacaacagggtatggaattactcctgagacacagacagatgcaggagcattacgtagagagatgtttaaagaagacatcacaaatctaacatatgcagtgaagacagtagctaagttgtatggtaaaaaacccgaagataaagagtttatattacgtgaagttgctaagagtttcgaccaagaaacctctgaaccagagttaagtgcatttatgttacaattaactagaggggtttccttacaggaagctaacaacttcattgaaagtagaaaggagctaaaatagtgtctaaaacaattaatgacattatcgaagatttcgattcaaaagtgaatgtacaggaagtatctaaatctattgaagatgaaaatgtagagcctgtacaggaagaacaaattgaaacaccagaagctgttgaagaaggtgtagaaaatgacaagccggaagaacagcctgttgaagctgaggaagttaaagaggatgttgaatcagaatccgaacctactgaatcagatgaaaaaccagaaacagaatccgaagtcgcagaagaagctactgaaccagaagtggaaaaagtagaaaaatctgataaagaatccgataaagaagatgaggaaaaaaaatcttctgatgacgaggacgacaaagaggataaaaaggataagaaagataaaaaagctgacaaagaagataaagatgaaaaagatgaagacaaagaagatgttaaaaaatctgatgagtccgaagacgtagaaaacgttgaaaaatctgttatttcttcccaagatattgtcggtggattcgaagctgtattcaaaaatatggcaaacctttttgaaactcaaaaatctttaactgatactattacagaattaaaatctgaaatcgtaagcttacgtgaatctcacacacaagctatcacaatgaatacagaagatgttaacaaatctattcttgtagataaagttgatggagtatcagtagaaggtaaagcagtaggatttgtttctaaatctgtagatgtagaagcagatgtgacttctgaacaagaagatgttgttgaagtagtagtagaaggtgccgaacaagaagaagctccggctaaatctgatgaagaacaattgtttgacagtgttcgtggaatccgtgatgacttaatgagcacatatactcgtgttgcaagtaacggacaagcccctcgtggtgagttagaagaaattcgtcaattatggggacgtattaaatcccaagacgaactagctcgtgcacaagcattcattgataaatacaaataaatttactaaaaggtaaatttttttaaggtgtactgctatattatagtcagaaccaatgagagacctgacatttcccccctgaacctccacagggtcaggtctcatctttgagaggaataaaaatgaaaggtgatttatatataatgccagaagacaaaaaacaagaagctaaattaaatcccgttcaggaacaagtaatcaaaggatttacaactggttatggtattactcctgacacgcaaactgatgcggcggctttaagacgagaatttctagatgaccaaattactatgcttacatgggcagaaggagatttgtcattctatcgtgacatcacaaaacgccctgctacatctacagtagctaaatatgacgtatacctagcacacggtaaagtaggacatacacgtttcgttcgtgaaatcggtgtagctccaatttctgacccaagcttacgtcaaaaaactgttaacatgaaatacgtttctgatactaagaacatgagtatcgcaactggtttagttaacaacattgaagacccaatgcaaatcttaacagacgatgctatctctgttgttgctaaaacaatcgaatgggcttctttctacggagatgctgacttatctgaaaacccagaacgtgactccggtctagaatttgacggtttagttaaattaattgacaaacataacgttattgatgctaaaggtgaaagcttaacagaagcattacttaaccaagcttccgtattaatcggtaaaggttatggtactccaactgatgcttacatgccaatcggtgtacaagctgacttcgtgaaccaacaacttgacaaacaagttcaagttatccgtgacaacggtcaaaatgtaacaatgggattcaacgttcaagggtttaactctgcacgtggtttcattaaattacatggttcaacagtaatggaattagaacaaatcttggatgaataccaaatggttagtcctaatgctccacaaaaagctactgttcaagcaactgtagaaactgacaagaaaggtacattccgtccagaagacattgctactcctgctgagtacaaagtagttgtagtatctgacgatgcagaatctgctccatctgacgtggctactgctacaattgctaacgctactgacggtgttaaattagcaatcactatcaacagcatgtatcaagctcgtcctcaatacgtagctatctaccgtaaaggacatcaaacaggattgttctaccaaatcgcacgtgtacctgcaagtaaagcagaaaacaacgtaatcactttctacgatttgaaccaacaaattcctgaaactgctgacgtattcgtaggtgaattgactccatctgtagttcacttgttcgaattactaccaatgatgcgtttaccattagctcaaatgaacgcttctgtaacattcgcagttctatggtatggtgctttagctcttcgtgcacctaagaaatgggcacgaatcaagaacgttaaatacattccatctggaaacgtaattaacgaacgctaatcttagttcaactaagaaaaattgaatagaaaacggaatagggaacggtctaactgttccctatttttattataacgaattaaatggaggaatacaaatgttaaaatctacagtattacaaaataaaaaagttgcaacatcttttggagaagctgaatttaaccatttaggagaaagtcataacttgccagaggaacatcaaaaagctttagctgaaaaggtgccttacttgacacacattcctgataagaaagaaaaacctaaagaggaaaaagaagtaaaagaagaaaaaccaaaagctaaaaaagcacctgctaaagctaaaacagccaaaaaagataaagagtaggagggcatcatatgtacccagattacggttatgatgatggtggaaaccaagatgtataccaaccatatgcacatggtaacccaaaacatattgacattgcagacctagataagattactcctgctgattacggttggactcccgacacgttaaaggcttacatgtttggggtagctgtagttaaccctgaaacaggtgaaccattaggagatacattttatgaacatgtaattgatacagcaattgctaaagctgaaaagaaactggatattgcgattttacctcgtttaattcaaggggaacatcacgatttccaccaatctgactttaactcttacttatacacgcatgtatttaaacgaccactaattcaagctgaaaagctacaattagaaattaacggacgaggaatctaccgttaccctgcaaactggtggaaagtatataccctagcggggcatatccaaatgtacccaacagcaatgatgcaaacaggtacacaatttgcctatgattttgcattctctggctacccacaattagcaggtatgccaccttcatctggtcaagtagatgctccacaaatgattcatattgactacgtagcgggtatgttacctcgtaagaatcgtggatacaacgctgagtgggagtgccctgctgatttagagcaattagtaatcaaatatgctattaaggaaatcttccaacaatggggacgtttgattattggtgccggtattgcaggaaaatccttgtcaattgacggtgtaactgaaagtatacaaacaacacaatctgctatgtatggtggtgcatctgccgacattaaacagattgacgaagatattgacagactagaacgtgacttagcttcctacttcggaatgaacctaggaattatttaaggagggatgactcatggctaatgaaccaacacgtttcagcagttcaggttctacaggtaaccctaagcaatacatgaatgtaagtagactagagtttgaaacaaaaggtatggatacctttgtaatgaaccgtggtataaacattctgtgggaacgagcttggctttgtacatgccgaaatccgatgactcttgctcctgactctaattgccctatttgtaggggtagaggtattgcatatcaacctgctgttaaggatataatgattatccaaagtcaagaaaaaggtgtatcaaatcaagatttagggttgttcgattctggtacagctattggtacaactccaattgactctaaaattactttccgagacagaattactgtcccagatgtggaaatataccaaagtttcatttttaatgtaaatagtcgtagattagagacaggtatgtttttaagctatgatgttaaacggctagaggatgtgtatggtgacaaagggcaagtccttgtggagggtaaagactttacgatggactatagcacgaatactttttatcctaaacaacatttgttaaacacgaacatctctatcaacatggcagtaacattacgttatctggttattgatttactcaaagaaagtcgttaccagtacacgaaatttggtgtaaaagaaccgctgtttgagaaccttcctagaaagcttctattgaagcgtgaggacatctttgttgatagtgaaccctttgtattagaagtagatacgaagtctcgtctagaggcactagagaaggaaaaagaagtaacagaatctaagatggtagaccctaaacgtacaggttcgagtgcgggagggttctttggaggtaaactaaatggctaagaaaggacaacgacctgcactgttcaccagtcctaaagaaatgttaggtaatctgacacgagcaatggtagatgagattctatctgatgcacaagaccaagcgttacgtgcaggtgccgatgtccaaagaatgcctaattatttacaggtaacagaatcaagaatggctaagagcggtgtaattgatttaaaaccgttcttcgctcgttctagtaagaagaagtacaacaaaaaaggtgaatggtacttatatattcctattcaaattaagacaagaaagatgtctagaagattgtatgacgatttaaggtcttttcctacaaatggtcgtcctgtaacagttaagatggactatctttatgatagaagaaaacaaagtcccgctgtacaaagtatcaactatagccctaagtccaaaaatgttacaattataccaagagagtggggagaaggtacacggaatacatatgtgacattccgtacagtaaatgccaattctccggctaacagttggataatcaaccgtagtaaagtgaactcggacgatatgagtaaaacaatgttagctaatatcgacaggttaatgaagtggaaattgaagaatttaggagggtaaaagatgataccaagtttagacacttacttgtataaagaatttgaagaaagactgagaattatcttagaagagtgctatattatagacgaagctttgaaggagatagattcccaagctttagagacatttaaaaatacttattgttcaattgacggtaaggctccaaagaaagaaatcgaaatgtcgtattctttcccacaggagaagcagaactttaatgctcgttatgtgattacactaggtgggagtgatgaggagaataagtcaatgggtggtgtacagggaggctatacttaccgagaaggtgatatagttaatgaagctgttcaacttgtccgtaatggaaaagatttaattctgaacacaacaaagcctgtagctgattttttgaatagcccagatattagtttttcagaaagcgaccatttcagaatcgaaaacaacaagcctgtatttgattattccggtaatgaacacttagaaggtaaatcttttaatattgtttatactgtgaaagagtctgatgaggatgtagcaggtgtttacaaagggtaccaatcctccgataccgtaaacattgtcggaattagtacaaatatggacactgcccgctgtctagatgccatcgcaagattaattcttattacgatgcgtgacagcttagatgagaaaacaggatacatgctacagacgttacactttggagacatgcaacctgtaattgaatcaggtgagacagtagtatttggtagaccttgtacaatcgggtataaagtaactaattctattagttttgatttaaaccgacaaatacgagaaattattaccaaaaggaggatgaaagcctaatggcaaaagaaacaacaaagactaaacaagagagtccaaaggaacaacctaaaaaggttccaaagcctaaagggtacgttcatgtagatacatttttgggctatgcacaagtactttacggattaagtaagtatcaagtagcaggcttcaaagcattcatggcagggagagagtatcagcacgatgatgccgactttgttccgtttttggaaaagtatataggaaaggaagttaaataataaatggctgtagaacaattcccaagaaaaaaagtgtcccgtccacatactgaaattactgtagatacttctggtatcggtggtgcatctaacagttctgaaaaaacattaatgttagtaggttctgctaaaggtggtaaaccaaatacagtttatcgtttccgtaactaccaacaagctaaagctacattacgtagtggtgaactattggatgctattgaattagcatggaacgcttctgatgtgaacactgcatccgcaggtgacattttagcattgcgtgtagaaaatgctactaacgcaacaatcaaaaaaggtggtttaaccatcgcatctactatttatggtttagatgcaaacgaaatgcaagttgctttggaagacaatagtttaacaaatactaaacgtctgacaattgcatttgcaaaagacggatacaacaaagtattcgataacttaggtaaaatcttctctatcaagtataaaggagaacaagcacaagcttccttcactattacagaagatagcattactaagaaggcaaataaacttattctaagcgcaggtgctgaggttgaagaccaaactcctgtaatggaatatagcttaggacaaggtgtttactctgatacaaacgtattagtaagtgcaatcaacagtttacctgactgggaagctaaactattccctatcggagacaaaaacgtccctactgaaacatttgataaagtagaaaaagctgatgttaaaacaggtgagaaatatgttgaagctctaggcggagacattgctaaacaattggaatacaatgactatgtaacagtagaaattgaccgtgcaactccaattcaagactttgcgttaactaacctttctggtggtacagatggaacaatcccagaatcttgggctgacaaattccctctactagctaatgaaggtggttactacttagtaccattgacagacaagcaagctgtccattcagaagctttagcattcgttaaagaccgtacagacaatggagaccctatgcgtatcgttgttggtggtggaacgaatgaaacagttgaagaaagcatcgcacgtgctacaaacttacgtgacccaagagcttctgtagtaggattctctggtactcgtaaaatggatgacggacgtttgcttaaattaccgggctacatgatggcttcacaaattgcaggtattgcaagtgggcttgaaatcggtgaagcaattacgtttaaacacttcacagtaacaagtgtagaccgtatctacgaaagtggtcagttagacatgcttaacgaaagtggtgttatcgctgttgagtatgtacgtaaccgtaccttaactgcattccgtatcgtgcaagacgttacaacttacaacgataaaacagacccagttaagaacgaaatgtctgtaggtgaagcaaacgacttcttagtatccgaattgaagattgaattagataacaacttcattggaactaaagttgtagatacaagcgcaagcttgattaaaaacttcatccaatcattcctagataagaaaaaacgtgctcgtgaaatccaagattacacaccagaagaagtacaagttgttcttgaaggggatgtagcatctatcagcttgactgtaatgccaatccgtagcttgaacaagattactgtacaactagtgtacaaacaacaaatcttgacagcataacaggtcgggggcttttagccccctataccttactaaaaataatctaaaataggagtgaaacatagatggctagcgttggaaatcaaacagtccacacaggtaacacagtttacttgatgattggtaacaaaattatcggacgtgcacaatctgcatctggtgaacgtcaatatggtacacaaggtgtatacgaaattggtagtatcatgccacaagaacacgtatacttgaaatatgaaggtacaatcaaccttgaacgtatgcgtatgaagaaagaagacttagcaagcttaggtattactgctctaggtgaagatattcttcaacgtgacattatcgacatcgtaatgatggataacttgactaaagaaatcgttgttgcttaccgtggatgctctgctgtatcttacagtgaatcattcacagctaacgaaatcactagtgagtccactcagttcacgtacctaacatcagctaaagttaagtaagtagtgtaaaatagaccctaaaaaatggggtctattttttttagttttggtattgacaaattatacatgtatctatataataggtattgtagttggtatacattttcgaacttaatctttcttatctttatcttacacatgacctagcaggagtgctaggtctattttttttgctctcatagaggcaactaactagtgtgctataataagtatagaatgctatattaacttatgaaagacataggaggaataagtaatgactgaaaaagaaaacaaggttgatttccctcagcttaacatgactcgtgaacagcttatcgaaaagattaaccgtggggaaaatctaacagacgaagaaattaatttgttaaaatatcataatgcagaagcagagcataaagaacttaaccgaattattccgggagttaacaatgtattctcaaaacattatgatttaaaagagtttggtatggaatttgatattaaaattaaagcaccaaacgtggtacaacaaggtaaaattcaagcaatgcgtgaggcttacttagaaggtatgggtatggcagtaagtaactttattttccaatgctaccatacactagctactatccgtgtttgtggtgtagaagtacctaaagagctagaaaaagatgaagacatctataacatctacgtcttaaacattatcgggaaggattttgcggagtggttaaactcctttcgctactaatctcgaaagtttagggggtataaaaaccctcgtcagaaatacatatagccgaaacatgtgggctattatgaaaaaatttaatgtattacctagtgaccctgcatggcaaaatctaactcatgagcaagtagaatggattttgtataacatggaaagagatgttgaagaagaacaacgcagagctaaaggtcttgctctcgaaggtgaatacgaggacttggatgcttcttggtatgatgtacctcatgaagagtttaaccctgtacgtgaaggtcatgatgaagctgagattgctcgtaagcttaatgaaatcactacagaagaggacatggctaaacttaaagctcgttgggaagctagtcaggaagtcgatgcaatccgtgccgaaggtggtacaacgattgaggaagacacaatcaatgaacttattgctaacaatgtacagaaagctattgaagaagctaaacgtattgagaaacatggtggtaataagtggggagacaaaaccccgattgaattagaggaagagcgtaagaatctagaatttaaatctcagcttaagcaagatgatattcaagatgcaattgctctgttcaatggagaaaaagatattgaaccaacatcagtagacgatgattttgtaatataggagggtagggttttaccctaccttttctttgtaaaggaagtgtggaaatggctaacaactatcggttttacgttgatgcaatgactggggatgccattgcaaaattagaagaagttaataagttgatggataaaattgactctaagagtgcaaaaggtacccagaagtttttccatacaactcaaagagaaatagacgaagcagtagccgatatgcaacgtttaattcgaatgaaaaaggaactagataagaacttcgaaaaacaaagttctatggcagaagctacaggtagcatgacagattttaaacgtgcacgtgcaaacctagaacagttacaaagtgagttccaaaaaacacaaaacgagttccaaaagttagcaagcatgaaagctaacccgaactttacgaataaaacagctttgaaagaacaaagagcttacagagaagaattgaccgagcaggaaaaagctttacaagcaatcaagaaagctcaacaagaattaaatcgagtaaactctcgtgtaaatcatagagcacaccaagctacctctacaggtagaatgacctacaatcaatctgaaagcatgaagaaggatttaggtggtgttgggctatactcagatactcaacgagaaaataaagaacgacaagctcaactaagagaccaataccgtagaagacaagaggagctatcacaagtacgttctgatacaaacttagatagacaggttcgtaagaatagagaaacatctatcttagaagaaatcaaaggtatcgaacaagagattgaagctcgtaagaaatttaatcagaccttgaatgatactattgagaacttaaagtcaaaaacggaacagttaaacaatagtaacgttaaagtagaggcggataggaactccactgcgggcgttatagcttctcgtgccccatctatagccatcgcaggtttaggctctgctgtggcggcaatagggggcttatacgctaagggagctactgcgaatgcaggtatgcgtgattcaaccatctctttaggacaacgtacaggtaacggagacttccgtgctattcgtaaagaagcccaaatgatgggtattgaaaagcaacttgggtataaaggagctgatatgcttcaattccaagaagatgcgttaagtaatatcgggtttaccaataaagaagacctaacagctaatactagagctttagcggaaggttcacgtgcagttcctgttgattctgaaaccttaagcgggtttatgaacgaccaaatgcgtagaggcgctgtgagcggtaaagaccaaattaaagcgattcaggaaggtttcttaggagctatccaaaaatctggtatggtaggtcgtgaaaaagagcagttaaatgctttgaaaacattaagtgaccaatcatttagtggacgtaacggtagtaatgaggaacttaaacaacaaatggctatgcttacactgttgaacaaaactggttctcgtgccgtccaaggtgaacagggtgccgagttaatgactagtttatcagcgggtattcaaggtagtgtttggaacaacaaggcttctttactactaggtaagggtagtcaataccaaggtttaagtggtatgtatgacttagcaggtaaacaagaagagggagctacccctgaaaatctgcaaaagattattggtagtgtacaaaaagctgttcctaatgatgaaaaaggtcagaaatatgtccttaaaagtgctatgcacgaactatttggtacaaatgcaactaatgaccaagtagatggtatcatgaaggcttacggtaatggtaatctaaatgaagaaaatatcaataagattatgaatgaaagcgaatctactggtaaagataaatacaagaagaatgcagaagattatactaactcgaaagagggtatggctaatcgttccgaagcagtaactgagaaacaagcttccggtatcaacgactatggtgatgctctacgaggaattaattctaaattaggaggaatccctccggctatgtatgctttaggtgcaggtatgggtgccctagcaactgccttgattacttcgggaactatgggtggtctctctagctttgttaagaacttgacgagagggacattctctgccggagctacaactgctacaacagccggagcaactagtgcaggtggttcattctttaaaggtgtaggacaagcctttaaatcaggtaaggctactggtggatggtcagcaggtcttaagagtgcaggtactacagctaaagacttagcaggtgctaatattgccggagctgaaactattgcaggagctacgaaagcaggttctgtagcaagtaaatttggtaaagtagcaggtaaagtagcgttacctattgccttagtcggttcagcaattgatattgcaagctccgatgacaaggtaaaatctgttggtgagaatgccggaggactagcaggtggatttgccggagctaaattaggtgctttagcaggtacagctattttaccgggtgttggtactgttatcgggggtgcattaggtgctcttggaggtagcttaatcggtaataaagccggtggtggtttagtagacggtgttcgtaagttctttggtggagaggaagcctatgcagacgaagtagatacaggtacttccgcaggtgggcaagaaacgcttaaaggacaagagaacaagtctggtaaacaagaagaacgagacatgacgaataaacgtgtcctttctgaaaaaacacgtgctgagaataacgctgaggaagcaactaatttatctatctactcaaaattacttgatagagcacaacgaatcctaaatcaagctagaaatcaaaatggtatctttggtaactccaagggtgctaacagttctagtgatagtggcggtatcggtgacgaccctgcaagtaaggattttggcggagactgggaaaaagccattcgtcaagcttctaaacaacttggggtagacgttacagaccaagatgtagacacattgcttaaattaattcaagcagagtctagtggagatgaaaaagctgtccaacaaatcattgatgagaacaactttaacggttctggtggtgccaaagggcttctacaatacatccaatctacgttcgatgcttataaagtaaatggacacgatgacatcatgagtggttatgaccaattactagcgttctttaacaatagcaactggcaaaaagacttaaatgcttggaataaccgttaccaaaatggtagtacgggttggggtccaacgggtagtaagacccatgcgatgggtggacatatcacttctccggaacatgctttgcttggtgaggtgccgggacaagatgaatatgttattaacccacatcaacctacagctcctagattactggcagaagcttctcgtaaaactgcacagaaattccgtttgtttggtaatggttctggggacgaatggtcttcccgtataggtggaattaacttatccggtggaggtagttcagcacaagcaccaacattaaacaatacaaatgacgttaaagttagcgtaaccgtacaaggtggcggaacttctgaaagtattgctaatgaaattggtaataaaacagcaagtaagattcttcaatcagccgatgatgcaatgagtttctttacaaaagaaatgaaacgagtttaagaaaactagggggactcgttccccctttatttattgaaggaggtaaactatggcggtagaattacgttatcctagatttaacctagcgttttatacagaaaaagacgaatatcatattacgtatgatgcacagacaggtgaatctaatacttctgtagtaaacaaagataatgattcggaagtttctaataactttatgatagaatccgttatcagtttaacaacaaaaaattcaatggaagatgacagtgctgtcttttcttttgttctagccggagatgtatactgggatagaattttaaaagccaatgatgcagttgtattacggctttaccctgatataaccagtgacctacctgttaacccagttttattagttgggttaatctcagaagtacgacttgaaggagactatggggagaactctaagatgtatcgtattacaggtcaatcatttgctaaggctttaatgcaatttgacctaggtgttattcaagaagttagtgttgtattaactgatattggttggttacctgatgatgcccaagagggggttaagatgacaggtagaagtgccagtcagctagcagaaggtatgatgaaccgtttcttacaatatatgaaatttgactttaacggagaaggcttagagcgctttttagaatgggaattagacagttggacagaagcagagcgtttgatagataataccccgtatattaactatgagggttccctaaaacaattgttagacgacatcacagctaaaccatttaatgaactgttctttgatgctacaccgggaaacaaatgtcgaatgattatgcgtagaaccccgtttgataaagcagactgggagaatttaactacgtatactgtaacatctaaagaagttatttctgagtcagtagcaacaaatgatacagaagcctactctatctttaatatttctataaataacctttatggtacagactctatgatgctcggttctaaaccacaggtattccctgctttagttaataagtacggatacaaaaaactagaggttgataacaaatacttgcagggtgcaattgtagataacagtgataatgcagatagtgcggatacaaatactgacggtgatacagaaacgaacgaagacaccactacagaaagacgtacaactagaaaaaaagatacgaatgaatctagtgcattcgacacgacttacggtacagtaatgaactatctacgtggttacccattagacatcttaagagtgaaacgtggtaatgttcgagctaaaatacttcaagtagacagacgtattacaggaacaatggcagataaaatcattgaccagtatattacaacacagagcttgacaaaagaacagttcacagatataactggtattaatgaaaagaatgctagcaagggaaatggtaaggaaaaacctacgtataaaaaacttgtgaagttcttggaagattacaaggatgaagcagagaacaatgagactaccacaatcaagaatgaacttatgaatgagttcaaattaacagataaccaagcaacatctattgctagtgagtttgtggctaataaaagcttgcgtaaaactcaatatgacgaaatcatgaaaaacaatcctagtgatagtacaacggtatctggttctgatacaaaatacgtaaaagaatttacgaaacgtttagctaactggtactgcgaaaatcctaacttctatagtggagatattgtagttaagggtagtccagaatatcgtttaggcggacgactattcgttatagacgaacagaacaacgaattgtgggaatactatattgaatctgtagagcatactttttcttacacgcaaggatatacgacaaccctaggggtaactcgtggtcttaaaaacggaggtaaagaccgattcacacacctttgggacaagtcagaagacttctcaggaggtatgttgggtgaaaagaccttagaagctttactagaagagcaagaaaagaaaaacaatgagaacaatagtagttctggttctagtggtggttcaagcggagttaacccatctaatattccgggtggtacagtagcaatgaaagctgtaaactggggacgttctcactccaaaacagaatcttcctttaggtctgcgtatgactggggaggtgggcgtacaggtagagacccatttgaaagctcacctattgctacagactgttcgtcatttgtatggtggtgtttcaaacatgcaggtgtagaattgaatggtggagcaactgggatgactacatggagtatcattgcggatacgaaacttgaaacaatagctacccgtggtcaaaagaactctgctatctttgataagatgaaagcaggagatattatctggttccgtaactgtgaacatattggaatttactgtggtgaaggaaaaatggttgcatgtaatggttcaggtaacatgaatgaaagtcctacagcaggtattattgtgtcagatatgacaagtggatactggtgggatacattcgatggagatgtaaaaagatacaattaacctcgttaatagcgaggttttttgttgtaaaaaaacaaaactagtatgtgtgctataatattaagtagagacacatacaagagaaaggatggtatcaacttggcaggaggacgtagatttcaggcagggttaggttccgaacataaaagattatacaaagaaggacaacaaattaatactttgttactagcccaagttatccaagttaattataaatacaatacagttgatttactagcattacagcataaagaagttttccaaaactcctatgccaatgaaggtagattttctgctcgtttaccaatggaatttggtggacgaaaccttgcaggacaaccatatggtcaagtaaaccctattgccgttggtactgttgtcctagtaggttttattaactctgataaagacatgccgattgttattagtgtatacaataacaacgatgtaaataaacaattatcccgtacacgttttgctaatgcagaccctacagatatggctttagcgggacaaatgtatcaaaaatttagtttgtacccatctttaacttacgatagtattgatggggatggtaaccgagtagttacattctctggtaaatcatttattgcattcgatacaaaagacatgcaaaactctccaatgacagatgctagttacggttctcgttatgaagacttaggaacatcttactataacgatggagaactaattgaaccgatgaaaggtcgagcacctaatgtgttgttcaagcaccaaggtattcttgacgatgataataaacccgatacacataatttcatgattcacattaacccagatggaacataccgtacatctatgatggatacggaacaagactggcggacaatgtttgagatgacaccggagggtaaaatccgtttacgtagacaaggggatactgtacgtctaaacgatggttttgaaattggtgaactaggtattaatgaagaaggtatcgtttacttacgtaatggggacatggacttagaagttcgtgaagatggtatctactcccaaggtaaactaatcacagaaaatatcaatcttgatgatatttatgaaaaattagctaatgttacttttgaaattaataagacaaatgagtccttacaaattttaactgagaaatcagagctacaagatggtaagattgtaaatctagaaacagagattacaattgtagccggaaaagtagaatctaaagtaagtgcaacagaagtacaagacatgattgatagctctattgtagacatgacggatgctattaaaaaagcccaagaagatgcagatagagcaaatcaagttatttctgatatggctagtgataatcgcttggctcctagtgagaagctagatttactaaaagagtgggacatcatcaagaatgagtacccaacttatttagcacaagctgaactatacgaagtagatagtacaacttatactgctaagtataaagctttagaaacatttgttactcctttattggaagacatggaagctactagtgtagtagatggttctattatgcgtaaaacatttagtgcatattacacagaacgaatcaatttactaaatgcaatcactaaagggttaaaagatggtttagaagaggcaatgaagaaagcttctcaggcttctgtagatgctacacaagctttagctgattctgcacaggcacaaattgatgcaaacaatgcaaaacaattgattgcagatattgctagtgacggtaagctgactgcttctgaaaagtaccaattgaaaaaagaatgggatgttattgttaaggagtatcctacaacaattgcccaagcaacaaagtacaaagtaaatacagataactatactgctaagtataaagctttagaaacatttgtcactcctttgtttgcgaatatggatgaaacaagcgtagttaacggggaacaactacgtgcagtattttctgattactatgctgtaaagattactttattaaaagaaatcacagatattgctcgtgatgaattgactgattatggtaaccgtattactgtagcagaaacaaaaatcacacaaacatccgaagctattacgttaatggcttccagagtggaaactgttgaaaatgatgttaaaacaaacacagcgcaattgaaagtgcaagcagacttaattagtcagaaagtaactgctagtgaagtaaaagatgctattgataatgcaattgataacatgtctattggtggttctaacttgtttgtaatcaaaacgcaaacagcaggactattgaatgaaaataatggtactgtaggaacagccgtagataaatctgtagtatctaactatatcaaggtaacagctaaaatgccttatgtagcttctttatatggaaacacagggacaaacagtattatcattgcatggtatgacacaagcaaaacgtttatctctggtcaagctgtagctgattctggtgatttccataaaacttatgttgcaccagaaaacgcagtatatgctcgtttaagctataaaaaagctgacactgttaaaatgaaatttgaagtaggtacgaagccaactgattacagcccgtcatgggatgatattaaaggtgaccagactgctttagaggaatacattaaacaggtagaggaacaagctaaacaagcacaacaagaagcagaaaacgctaagaatgaagcagaaaacgcaaatagtgctattgctgatatgtctaatgacaatatgttaacagcaaatgagaaacaacaaattttactacaatgggaagaaattaaaacggaatatccaattaatttagaccaagcaactaaatttggtgtttctgctacgcagtatacaacagcgtacaatgctctaaaaacatatttagacccattattagcagatatgacaacaacttctgtaattgttggttctactatgcgcagtacatttaatacttactacgaccgtagaacaacattgcttaatcgtgtagctgaactagctaaacaagtagctgaccaagctaaggatacagcagacaaagtagacgatgacttaaacaacattggtgggtacaactacatcggattctcttccggagaccatatgtatcctcgcttgatgattaagaatgttggttattactatgttccttctacaacaagtgcagaatttgtagatgatatggtttgtttaaaacctaaaacagctacagctacaagtgttcaatatgacatcggtaactctaatgttagtgtggctaacgttggacttgctaactatcgaatgaaagaagttaaaacaggtcaatggctgactgcttctgcaaatttaaaagttgtgggaacaggtactgcttatctaactatttttacactggaaaatggttcatggaaagcttcatacagcgatagaattagtgcaagtcaaggcgtaacccgtgtagttgctcaaagacaagttacagatgcaactacaggtattttagttcgagttgatggaagtaacataaccgaagttcatttcggaaatacgcagttagaagttggtatccgacctactccttggaagaaatcagatattgacattcaagaagacatcaacaatgttgcagatgacattaaagattacatcggtgctcgttcagataacctaattacaaacggttttggtgagttagggaacaatacgaatattggtggtatctttgatggtgctgataggattgtaggtaaaggttccttccgtcaagaagaaggaaacaaatcactattattcagtgaacacattgttattgacaataagaaagtttataactttgattactacatgcacacattaaaaggtgttggtagaagttacgcaatgattgccccgtatgacgtagacgggaaacgtatcacatttccttctctcgggggacgaaactacaactctattacccctgttaaatttacaaaactagcaaaaccacttaaagtcggagatacagaggtttttgtagaagatgctagtctatggaacggacaggcaccgcaagactaccaacgtagtattatcatgtggggttataaaaactcgttcggctatacttatcccgatggaacgtatagtcagctaatgcagatgaagacatatgatattggtgcagttgacaccacagctaacaagattacgttaaacaagccatgggcagttgcaaacccaaatagttcagatgggattttcccagtagggcatacacttagcccaacttctgacggttccacatatctatatttgaatggtcacgtaaatatacaagtacctactacgtacaccaagtacagccatttgattagtggctcttctgagtttgctaatacaacgcttatcccagtagaaacaggttctatccaacttggattcttgttgaaccgtgatacaacaggtgaaaaatcttggctaaacggtttacgtctacgtgattatacagatacgtataagctaaacgatgacgttagagaaacacaagaaaatgtggataaagcccaagcagatgcagataaagctaaccagtcaattgctgatttatctaatgataatttagttactcctaacgagaaactagatttgaaaaaagagtgggaaattattgttgctgaaaaacctaagaatgatgctcaggcagataaattcggagtaagtaaagtagcttacggtactgcgtatactgctctagatacgtatttaaaacccatcttagcaagcacaacaacgaactctgcgattgttggacaaactatgcgggatacgtttaaggcgtattacacggctcgtacagacctgttaaacgctattgcatctaaagctaaggaattggctgataatgcacaagataccgcagataatatagctgtcggtactcgtaaccttttaatcggaacacaggacttttccaaaggtaaatatccgggtaatgctaacgttaccattacagatgaaaagctgtttggaaatgcagtaatgaagaacgattacactacaggtaccggatattcagatatgtaccaaatgacgacctcaattattccaacaggaactcagtatacactatcgttttatgcaaaggcagacctagaaggaactaaaatgtcttgttacttctacaacccaaatactacgacaagtagtgtaaacagtcaaggtggcaaacttagttctagtgacggtcgtactgtatttgttttaagtgcagaatggactaaatactgggtaacttggacacagacacaggcagacaagcctaagtcagtaattattggtcgtaagactggtggggaggaacctaactctgctttctatatgtcttctcctatgatggtagaggggaacaaaccacaaacgtggatgaaagccccagaagacattgaaacagctataaacggtaaagaaggtgcttgggtttactccccaacagcaccaacaaatccggctgttggtttagtctgggtagactcttctaaaactccgaaccaaccaaaacgttgggttggtggagaaactggatgggttgccttaaccccagaagaagtaaaagatttaccttggggtgaagatggttctagtcttgctgactgggtagcacaagcagagcaaaagatttcttctgatgcaatcattagtactgtactaggttctgaggactttaccggtatttttgactccaaagcaaatacagaagacttaaataaccttgcttcttacgatgacttagatgctatgcaagctgagtatgaacgtctgttaaaagaagggattgcaggaattgacttctcaccatatgtaactaacacagagctagaacaattgaaagatagcttcactttctctgttcaacaagccggtggggttaatatgttgaaaaactctctaggattctctgggacagacttctggcaagcctcttctggtatagatactactcagaatgaacagttgtctaaattaggatttggttccggatttatgataaaccgagttcaaaatgcaacactagctcagacaatcgaattaccagaagcaaaacaaggtttgcagtatgctttatccttctacatgaacgtagctacttttggagatgtcactgatttccaatgtggggcacatatctacgaagaaggtgtgttgaagtatactgttggggtaacagatgctacacaagaaatcccaagtgactatcacttgtataaacttgtatttgaaccagagtctccgaatactgtcattgaattatttgttacaaatggtgcacaggcaactgtaatcatttcaggggttatgtacaatattggtaacattgcgttgaaatggcaaccatacccaagtgaaatctataacacgaacgttaagattgatattaatggtattactgttaaaaacaatcagacagatggttatacaatgattactccgcaagagttttcaggttacgcaagggttaacggggagatggaacgtatctttaccctaaatggtcaggtaacagaggttaagatgttacaagcagagaagcgtattacaatggaacctatttccgtgtttgcgatgaactctaaagaaaccaatacaattggttgggcgtttgttgcttccggagaggttgcacattctgccatagcatctagtacacaatagaaagagggagccttatctgtaaggctctcttttgttgtgttgtgctataattatattatgagaaacaaaacaagaggtgagaaaataaatggctttaagcggtagtacatacacagcttttgcacggcataggcttgtgttagaatggagagcctcccagaatgttgcgggcaactactctgatgtaagtatttggttatacttgcagtctatggattcctatggtgctttatatgctcctgctgttggacaagcacaggtaacagctaatggagttaagcaaaccgaaaatgcaacatcacaattgaatgcttatcagaaaaaactattgctagccaaagtttggcgtgtaaatcataacgcagatggtagcaagtctttttctatatctgctagttactttgtaaacgtaacctattcaggtgtttactacggaacaatctcgataccgtcattctcggtttcattaaataaaattccacgtaaaagttcgttaaaccctgtgccagatttaaatattcctaataaactaggggtaagtattacccgacaaagttctagttttacacataatttaactgtttgggtagccaatagaacaaaccctacattagataatgactcccattgggtgtatttaaacagtattgagaacgtaggtacaagtggtacattcacatttagtgtagcaaacttcacagaaatgttcaagaggatgggtacaagtaccgaatgggtaggcaaggtgaagctctggacgaatggtttaagcgagtcagtgccgagccaacaacgaaccttccgaataaaacctccaatgaacgcacaggcttctgggggtaagttaaaagtaaaagcaggagaaaagattactgttagtctaagtaacttccaatctgacggtaactttaaatatacaggtgtttttgattatcgaggggtatccataccagtagcaacaaatgtacatgcaaactctatgactcttacattaacccaagcaaacgtggattctatcttgaaagaatctccggatgatgcaggaacatgggggcaagtacgagtaacaagttactacaatggtgtacaatatcgaactccttggactggacagcatattgattgtaccattcctaaagaagattacttacctgtaataaacggaacaccgacttatactgacttaagtgccgaagctactaacgttaccggaagtaaccaagtagcattacaaagtaagtctaatatccgtgtgactattccggctaactttgccacaggtcaaggattctcaacaattaaaaccgtgcaagcttcattaggtggggctacaaaaactgctaactataatgcttctggttttaacattgatattggtgctccaaatgaaggtactgcttcttcattagttgttactgttctagacggtcgaggatttagtacatcttggacaaaaacagttcaagtatatccatatagcaatccagatgttaactatacgattgcccgtagaaacaactttgaagtagatacagaattagctgtttcaagtagttgggcgcctgttactatcggtggtgtaaacaaaaatgcaattacgtcagtaacctacgcaactaaacgttcaggtacaagtacatggggagaagaaacaccagtaactttctccacagatggggctaaagttattgtcccaacaaccgttgttcagttacctaatgagtacagttggaatttcagactaactatcaaagataagtttggtagcttctctaaagaagcaaatatttctgccggaaaacctattatgtttattgatgctgttcgtgaatctgtaggttttggtaacctgacaggtacaggagaaaatagaaaccttaatggtgtaattgaaattgaggcggaacgctaccatactacaggtaaaactggtatccaaatgaataacagtgatatttctggtttgaatggaatatatttctcaaatgacgtaatggataacgatggtgaaggattgcattttatcaagtcagggaaagacgttaactcttccaataaaaaagactacgattatatgtatatgagagacggcggattctatgttaaccatgatggtactccaatctttaaagttactgataacggtcgtatgtattatcctgcctctcatttgtggtctggtggttggtatatgtctggtacacaaaatataaccccatcgaaaccaatgtcagagtgtagaaatggatgggtactcatgtgggctaagtatcaaaatagcacacagacatggaatgatgttgtacaggtatatttaggtaaggacttagtaacaacacatagtggactaggtgtaagattactatttggtggttatggtaacgttgttatccataaatatttaacgattactgatacagaggttagaggtaatgcttcaaacaccaatgctagtttaaacgctgacagagctattttagttcgtgttcacgaatggtaaacgaggtggaaacgatgaaaatatacgtagcagttgacgaatataacgtattgactggatggagtagtagttacgaagaaaatctaattgagacagagattgacgaaaatcacccacttattgtctctaatgatttttttggtaattataaactcatagacggtaaattagttaaagatacatctattgaattgttaaatttaaaagacatgttaaaggtagaattagaccaacaatgctcagaagctattattagcggttttagctacccattaacggatacagaaacacttcacgtctcttattcacgaaataaacaacaatactttgaagagattaagtctcttttcgaacgtaaaattgttactcgtattaactgggagtttactactgatgatggagctactattactaaagagctaaatgaaatagaatttttaaccttgtacacttttgctagtttggttaaaacagcaaaaatgactaagcttaaagaaaaactatatccactagttgataaacaaacaaataaagaagacctgttgagtattacatgggattctattcctgatgaaccattaccagaaaaacctgttattgatttaaatggtgatggtgaaataagtcaagaagagttcgatgctttggttaaggaaaacaaagaactaaagcaaaaagtagagtttaacgaattggctttaatggatgcaattaacatgctatcgagcatgagtacaggttaattttaaggaggtgataacatgtatccacacttagcaatgctctatgcaacgtatgtcatgaaagaccctaaaacatggacgatggacaaagttcctgctatgattcgagaagatgtacaaagaattgtagatgaaatgacaaaaaaagaacaagcacccgagtagtctttctaacactaggggtttccattggtttagtcgcaggactagctattgggttcttcctataatgctcggggagaggaagagggtggcttaggctgtcctcttttttcttagttaattgtactatattaatggacgaaaggacgtgataagtgtgggacaatcagatggaatgggtggaacattaaaaagaattgctattcaagttggagacgacccaaacacaggttggtatagatttcaagttaacccaactcaatataaatacagcaaaccacaccgtgtaacaatctttaaaacaaagtctaacattatcactgaggactttggtaaagatattgagaccattcaattctccggtacaactggatttagaaaagactctagaggaatgaacggtgctgatagattaagagaactatctaatttgatagatgattatgcaaatcaaggcggtaatggtaaccgaccgaaagtagaaatgaagttctataattttactgatgaccaatattttgtggttcatttagccccagaaggtctcactatagaacgttctgcggaacagccattactatttacttatacattaagcttagttgtattaagaaaagcgggagagcctgctgaacgtgaccaagtaaacccagaaattgggaacaaaaatccaagtgtaggagacaaggataaagaaacaagaagtggcataattcaaactcctgcacaaatactacatgaacagtataaaaattctgtgttgccaaatatagcagtaaaccctagtggtacatcaggtgcctataactacggtttagttgaactaaaaagattaattggttacggaggtggtcagtaatggcaactgtatatcaatctgcggacttgcttagattctttcgttacttaaatgtaaacgtgcaaggagatgtcgttagtaatgtcatagacgaccaacctaactttatttctagattttacacaccgcacacaagagtgaataaaatatctaataccttattggatattgtgaaagacaataacattagtgaaacaaacaaagagttatccaaggattcactaacctataagttcttgaagagtggactacgattaacagctcctgacatttaccagttagctcaaatcgtagtacttgaatcttttgctttgatttatgcaattgaagaaaaacctgaaatgttcaaaatgattaatgaatcagatgtgaaacaaacacgggagaacgtaaaatatcttgtagactacttaggggagaaaaaagattatactgatattgtaatggatttacattctatggatattgcccttggttacatccaagaacagattccattaattcaaggagggttaccagtaaatggcacgatataaaaaacatacaatcgtttatggagaaaccatgcaatctattgctcaaatggaaacaggttcagtaaacgactggataaaaattgctgagtataactccttggtttatccatacatagtagatactatgcaggagaaaatggctaatattgaacatttagcaacaccgggggatactttggtaattcctgtcgaagctaacctactagacatggacgtaagtaatctaaatcaaagagacatggattttctattaagtttatctctaggtcgtgatttagacatgacaagtgagacagaatactatgaaaatcatggtacaagtgatgaagtgttctcattaacccataacgggcacggagaccttaagacggctaatggagcagataatataaggcaagcaactatctctcgtctaatgaccgctaaggggtctttaatgctacatccagaatatggtagcaacctacacctactttttggtaaaacaactattgaacaaatgaaattgattagcttagaagtatgtgaaactgtattaaaagacactcgggtagctgagtgtgtattggttagtcattatatcgaagaagaccattatgtaggaaactaccgagcaaccatacaatcaacaaaagaccagttcgagtttgtagtacaaaatgatagtgtgggcgcaattgttatagaatagaaaggagtatccctgtgagactaaagaagatttcagaaattttaggtaggctaattgacgtaaccatgattaatactcatgagttaaacgacttctctgtagggtctacaatccgttccatttacgaagctgtatcaatggaacttgaacaatactacatcttaggaagagaaaatattttatggggtatcgaacagggggtactcaatgcttttgattttagaaaacgtgaagctaaacgggcttatggtatggttaccctagaatttcataccgtaacgcaaacccctgtttatgtgccgacaggtacgacctttgactctagcttgtctggtgcacctagtaacttgacatttcaaaccatgcaagactatgtgattcctgccggagttgttactgctaaagtagaggtttactgtacaacagttggttcccaaggtaacattgccaaaggaagaataaatcgggttattaacaacatctctaacctgaaaaaagtgtataatgaatatgacatacttacaggtactgacgaagaaagtatcgaatctgtaaagaaacgtttccatgctttcgtagaatctcgtggtagagctacaatcaaagcattagattatggtacacgacaagtcgaagaagtatctggtgtgtatatcaaagaggaagttggttatgtacgtatttacgctcatgacttaaacggagatttgaaagacgaaacattagctaagattaaaacagctattgaagattatcgtcctgcgggaattaaattagacgtgttccctgtagtcaaattaacagtaccgattgacgtaacaatcacaattagtaataaaaacagaattaacactgcattagaagaacgaatcgaattaactattagaaactacttaaacagtcgtacagtatcagaaacattggtaaaagctgatttacttcaagctatcatgaatattgatgacaacttaatctatgactgtgaaattaataatctgagtggtaacttggatattagagacgaggagattattcgtgcaggagacgtaacgatagaattaatctaggaggtaacattgtgagtaattttttcagaaatatacacccactcttgcgaagaagtaaacgtccggagaagtatgacgatacgaacttcgctgtgttgaatgcgttaaattacgaattaacacaggcagagcaagaaaccattgctagtaaaatacaatcctccttagagtctgctacagatacgtacctagacacttggggagattggttcggggtgtaccgtaaggacggttgggacgatgaatattatcgtgcacgtatcatacgggaactacttcttaagcgtggtacaattcctgctatcattgatgcgttattggatttccttaacgacaatgatgcagtcatccaaatctacgaaccttggagaaacattttctatacaaataaatcaaaattaaacggtgacgaccatttaatgggttactactatcgttttgcaattattgatatttcaattgatagaccgtttcctcctgaaattgtagagattattaaggctttcaaacctgcgggagttttattctatctaagattagacacaagtttaaataagaataaaacaactgtagaaagtccatatgtatatctagacgtgacgaataagacagaattagagttctttaatggtttatattatgacctacgaggtaatattaacctgtctgaccaacgtacacaagttgtagagaacaatatcttccatacgaataactctatgttaaacggggaagatgtacttgcaggagcatttgaccacggaagaggttacattcacttagcaagtacaacattgcttgattacacaccaaaacctactgactctatgagtgacttaaaaacagctctaggagagtcaggtgctgacatgtataatcagacaaaagaaaaggatggaagaacagcttctattcaagtacctgcaacaaggaatgtccatacgttatactcaaatagtatagattttggtgactatgattatagcggaaaccctaatgtagctgtaaccgatgcagatacgttcaaattaggaacaggtggaactcttacctataataacggggagtacactgttttgatggatgggacagctagattaagtaaatataataccgatggtaaaaacagtgtatacttagaagataaggtaacttatacaatttcttgtgaaatgtatgttggttctgattataccggaaatgttgaccagatatttgctaactatgcgtatcttgatggaggctatactgtactgcaaacaacaagactccctgcggatgctcctagagatacttggataacagtaaaaggaacatctactatgaactatcaagggagagtacctaaagtattgtactttagttggcaaacaattgctagtgatgttaaccctactggtacacttaaaatgcgaaatatgaaaattgagcgtggagaaattaatactccttaccaacctaatttattagtagagccattccaattatctaatgttcctttaaatgataatttaggagacccaaacgtatctttcccaattaacacacaaaattcctacttagtgtatgatggcaccataaaagaaaattggcaagctaacacggtgtataccttaacattaaagggtaagaaattaaatacacagagttggaaaccgtatattgatactaaaaatacttccacgcttagtaaacctcttttaactcctgtggaggggttaccgaatgtttggcgcagtacatttatggtctcccaaaatgatatagacaccggacgggttcaaaaacagttaagtatctaccaagcacctagtgcaacaaggggtacagcttcaattgaatgggtgaaacttgaaaaaggtgctattgctacaccacctatcgaacagtatgcctacacaggtactcttgtttcaggtacaccttctaaaaaccctaaagattatacatggggaagtttatctcctgttttaggtaaaaaagcctatatggtgtttgatattaagacatttatcgaagaaaattatgctatagaatttgaaaaacttattactgacctaggagaagaccaagcattaaatactgtgtttgaaaactttaacatctccacagcacttaaggctttagtaagtccaagttcaccaattaatttttcagttgaactatacgatttttctacgagtgcatggcacaaactaaacacggatagcttagacctacgtatgcgtacattcaacttagtagcaaaccgtatcacagactatctaaatgattacaaactattatttgttcgttatgtgtttgataacgaaactgataaagatgtaacagttgaactagacatgttaaatgtattgttcaactatcgtttaggtgacggatatagtttagggctacaaagtactgtagaatgtttaagtgaaattccgttaactggtattaccctttctagtgatagtgttgaagttgctattggtgaaacagcgaaagttactgctactcctgttcctgccaatgcaactaacaaaagtttagaatgggaaatagcagaccctaagattgctactgtagatacttctggtaatattacaggagtagctattggggaaaccacattaaccgtgtatggtgaagacaaaaccattagtgctacttgcagtgtgtctgtaaaagctagacataccctatactcaaacagcaccgacttcggtgattatgattatagtggaaatcctaacttgctaagcaatgtaaccaatgatagttggacggctgagggtgctatgaaggtgaccgcagtagatgattacctagagttagtaaaagatactgctggacgttttggtactgcaaagatttataatataccagcattgcgctcagactcacaatatactacttctttagaattttatcttaagtcaggcacctctgttgaggatttaaaaaaatgtaatattgctatcgaagcaactaatacaagtgggcaagtttattatagtgttatttatatgaataatataccgaagatggatgaatgggttgatttaacaagtacttttactacaaacacctatacagataatcttaccgactggaagtttagggtgtatgtccatccagatgtttccgcttctatgagaattagaaatagcattaagattgaaaaaggttcgacggctacagcatatcaacctaacttacttgatgacccttactggttgggtaaagttcctttgggtgagaatattgctaataaagatattcagttcccaatcaaaaccagtgaatatctcgcatatattgctagaatgatagaaccttttattgtaggagaaacttatacaatcaccataaaagcaacaaaacccgctagtcaaacatttatggtttataacagtggggaaggaactacttactatggaaacctaaaaccagttgagggattgacaaacgtatggtctctaacatttacaccaaataatgtttcgtcaagtaatcctagcgatttacgtatttttcaatatccatcatcaactaaaggcgatgttcaaattgactggttaaaaatcgaaaaaggtgacactagaactcctaacattgattcctatgcttatcgtggtacagttttaactacatccgaagaatcaccaaaagaccctaatgcgtatacatggtctagtatctaaataggaatagcagaataatatgctataatataaatagggcacgatgctgtgccctattttttaattgaatgctatattatctaatgaaaccatagaagaaaagaggttataaagtggctattgcaactaataattcccgagtgtatgcttcattacaacttaaaaataaaaaagatagcatgtacttagttatcggtaaaacctcaccttggacaaatgaagatgccccacctgctacagaccctaatacttcaacattacaagaagttgttggttacaaaaaagtaagtaaagcatctctatgtcgtgaatacgttgcagatgacgagaacaagtacccagtgattagctacggtactcgtaaatttactttaataccagatgaggatgcttataaagaaaaagcatggatggtatatatcgaatctgaaatcgtaggtgacgaattacctttaggtacatttagacaagtaggacttcacactgacctagtaccaaaaacaggtgtagataaagatgcgttactacctacagaagtaacaaatgcaggtattttacaattctttgaaaacagacaacaacaaaacagaactgccgatgtaacaatccgagaaaaatttatcgttacaatggaaaacggcaaaacattaaaagcgtaagagaggatgacaagcattggcaaaagaaattacaaatgatgatttaaagaaagcgccctaccttgaccgctttgaccctaacaagaatagaacacgagtgctattcaaaccggataaacctcttcaacaagcagaacttaatgaactacaagcaatgcaagattatgcgttatccaatgtagcagagtccgtgttcagtgatggggacatccaaacaggtatggagtatattcttcaaggaactacgcttactgttaaaaaaggtaaagtattccttggtggtaaaatgcgtaactttaacgagcaaagtattgagattaccggtacaggtactgagtatattggtgttaaacttgttcaaaaggtaattaccgcagaagatgacccaaccttgttagaccaaacaagtggcgttcctagccatttctcagaaggtgcagaccgtctagaggaaacagttgtactaggagtaaacgatgatgaagcttcaaacatttatcgttttgagaacggtcaattatatattaacccagatacaccagaaatggacaaaatcaataaagtattagcagaacgtacttatgatgaatccggttcttatcgtgtacgtggatttgatatgtatacagaagtacacccaacagaccctaataacaaaatccaattagttattgactctggacgtgcatatgtactaggttttaaagtagacaaacctacaactactcgtattgatattgataaatctcgtgatttagaaacaatcaataacgaaggtttctactacagtaacgaaactcgtttaaacaaactaggtaacgcacctgtatctagcgtagaccgtgtaacagcccaagtggaagttgcaaaagaacaagtgtctcgtggagttgttggtggaggtactgattaccttaaaaatacttcggtaacaaaagttgttcgtgtatggacggaaggttccggagcgcacgaatatagacagggagaagatttccaattagttaatggtcaagctatctcatgggcacctacagggcaagaaccacctgccggaggtacctactttgtacaatacgtttacaacaaaacaatgattgaaaacactgattataaagtaactgttaaaggtgaaggagataaccgtgaatggtatattgactttaacgaaatgacaggttctaaaccagtagacgaatcattagttaacgtagattacaaatacttcttagctcgtaaagacttaattgtgttagaccataacggaaactttactgttcataaaggacagcctaacgcaatgcgtttagtagattctcctaaccatattgacccattgacactgaatattggtacagtgcttgtttacccagattcgagcacggcagaagctaagcaatggacaatcactcggttaacgatggaagagctacaaaaattatctgtacgtgtagacaatatggaatacaaccaagcggtattctatcttgaccaacctgcgatggcaggagaaaacccaatctatttacgtggggtattctcagatgcgtttatctctcttgataaatacgatacaagtcatccagatgctacaattgcctttgactttgatacagcagaaatcacactgccttatgcagagattaataaaactgtaccatccattatcgaaggttctagtgaagcacatgtatggggacggttagtaactgcaccatttaccgaagaagtcggaattagacaaccatttgctacagaagcaatgaatgttaacccatacaatacgttcaataagcaaggtgttctaacactaaatcctagtgcagataactggattgaagaagaacgtatcactatcaccaaagaagaaacatctacaatgactattcgtcaatggtggagacacggtggagcttcttggacaaatgatgaaatgaaccttgtatctaacgtagacctagacaacggtatgaattggagcgacctaaaagacgactaccgtaagtctggattgtctggtactacactgtctagtggtggacaacaaacaaaagagtctatgattgagttcatgagacaaattgacgttgaaatctacgctgagaacttagagccaaatgcaaacaacttagttgtgtcatttgatggactacgtgtccctgtaacaccatcttctggttaccgtaaaggttcacaagagggtactggtatggcaaatgctgatggtacgttcaaaggtgtattcaagattcctgcgggtgtacgctgtggtactcgtgaagtatctattcgaaatgatacgaacttagcaagtacaacgttcactgcacaaggaacaatgaaaactactgaggacatcatcatccgtactcacgtaacaattaacctagttgacccgttggcacaatcattcagcttcaataccaaccgtattgctacaagcttcgatgtgttcttcgcttctaaggatagcagtacaaacattatctgtcaagtacgtggtatctcagaaggtggtcaaccaaacaaaacggtttatgcagaacgtgtattaaaaccttctgaaatcaatgtatctgacgatgctagtgtagcaactaagattacatttgatgacccattgatgtgtaaagcaggtcaagaatactgtttagtgttcattactgactctgataaatacacaatgtggattgctacaatgggacaaaacagaattgatgacccaacgcaaagtgtgaactctaacccttacttagaaggtgtgctttacagttcatctaatgcgagtgcatggtctattcaccaaatgtctgacttgaaatttactgtttacacagctaaatttaacgaagaagctgtcttggagttcgatgtaatgagaaacatcaacgtagaccgtgtggttcttatgtccacatatttaactcctgcgaatacaggatgtaaatgggacatgaagattgttcttaacaatgaaccttccggaacaaccgtcaacgacaaaccttgggttccaattgcgaactatgtagacttagatgttaaccagattgctcgtgaggttaaacttcgtgcaacgtttaaagcaaaccaatatatttctccaatgcttgcattagacgatattatgtttgccggtttcttaactgccttgaagggtagctacgtatctcgtacaattgatttatccgaggctccatacaacactgttaagatgtcttacgaacagtttactcctgccggaaccactgttgttgcaaaatacagtactgacgaaggtaaaacatggaagacattcactactcagcctacaacaacacaacgtacgcaagatttcgttcgtgtagactacgttgagaagattaatacgggtggaacatttaaatccattaagttccgtcttgacatgtcaacccagaactcattcctccgcccgagggtgagacgcttaatgacgaatatgaccgacaaatagaagatgtaactgtaatgtaacatttctatgcctcttactgtggtatacttattgtatacgaaatagtaggaggttttttaatggttaaagcattacaattagcaggtactacatttggtaaatggtacgtaaaagaacgagatacttctaaaaaaggtagagcatactggatttgtgaatgctcttgtggaagaacagttcaatctattccgagcggtactcttactacaggctcatctgtgatgtgtaaacaatgtgcaaatgagaaatctttagtgggtaagacttttggtaggttgaccgtcattaaggattcaggtgaacgagcaactaatggtagtatcctttgggagtgtaaatgttcctgtgggaagacaagccttgtcaggggttcagagttgacagggggtcgcacaaagagttgtggttgttactccacggatgtactcaaaaaagtagccactaagcatggattgtctaaagtgaacggaaaacccacaaaattattccgggcatgggcttcgatgaaacaacggtgttacaacaagaaccatgcgagttataaggattacggtggaagaggtataaccatatgttctgaatggcgtgaagactttgaagcttttcataattgggctatgactaacggattttccgatgacttgtctattgatagaattgacaatgacaaaggctattcaccagataactgtcgatgggtagatgctaaaacccagattcgaaatagacgaaatacagttacttatgagtggcaaggaaaagagtatactcgagctgagttaagtaggttgacaggtataaatgagcaaaccattgcttcaagattgaacaaaggtttttcccttgaagaagccctttcttcaaaaataggcacttctgtattacttatgacctataaaggggagactaaacctgtcaaacaatggtgtaaagaactaggattgaactatgcaactgtacgtaacagacattataagggttggactgatgaagaagctttgactggtatacgtaataaatagtcaaccaagttgaatagcctctatatgctatactaggcatataggggttattttttatgtaaaggagacttattgatatgccagaatcatttagacaaaaatcatcaggagctttaatttttagacctacagtttctgagaaaatccattctaaccagatgaaagctcttgctaaagataaagagaaattgaacagagacatacaagaggttaataatttaaaacaagaattgactaaggaattagaagaaattagagaattaaaaaacaagttaaaaggataaaatgtcctattttaattttttgacctccttatatatttaatattatatatttaactatttatctaagttataagtatttatatattatatatttatatataagggaaccaaaaatggaaaataggacattgacatacacttacagtactggtacaatagtattgtaaggtgtgagacattattaggaggacttatgagactagtaatagatgtaatgcacactcagattagatttgatgaaaacgaaggtagtcttcgtagcactatacatagagtaatgcacgaagaacttggagtaaaagcagatggctatcaatttagtcctgcatataaatcaggttactgggatggtattattgatttttataataaagacaacgatacatttcctacaggtctagtacctaaagtagaggaaatcctaggaagactacaaactgctatgggtagtagaggttacatgtttcaatttgagattattgatgacagacctgacaaattcatggaagttgaagaaatggactcagaaattaaattgaatggtgacaatggagaaataattactctacgtgactatcaatatgattctgtaaaaagtattattgagaagcaaacaggtattatcaatgttgctactaatggtggtaaaacagagattgcttctggtttaatacagcaaatcctacctgctttagaatcgggagaaaggattgcattctttacaaacagctcctctatcttcactcaatctatcgaccgtattgaaaaacgattaggcattaaagtaggtgcctttggagcaggtaaaaaggatattcaacaagttacatttgtgatgattccaacaattacctctgctatttcagcagacccagaagctaaacttaaacttacaccgaaagagcgtatgtacaaaaagttagctaaagagattgctcctaagttccttacaggatttaatcaaaaaggactacttgaaggttacatccgtaacttccaagtgaaaacaaaagctgatttacagttgaaacatgaattggaagaggcttactacagttgtggaaccaacaaacaggtagtgatgaaaatgcgtagttatcaagctgagtatgaaaaggtagtcgagaaaaagaacgggaaggtcttgaagaaatacaacgaagcaaaagagtttttagaatctgttgctgttatgattgtagatgaggcacaccatactagttctgatacttggtaccaagcactaactgcttgttctaatgctcagtatcgtatggctttaacaggttctattgacatgaaaaaccatgtgttatggcaaagaatgcaagccatttttggttccattactaccaaggtatcaaatgacaccttaatcagtttaggtcactctgcaaaacctaaaattaccattttcccaattattgcccctacagacatcgaaaactccaattacatggatgcttacaagatggggatagtggacaatgtatacagaaactctttgattgctaaacttacaaagaaaatgtatgagagtggcagtggtgtactggtaattattaatcgtattgaacacggggaaacgattagtgagttattagatgcagaaggtgtaccacattacttcattcacggggagcttgataatgacttacgtgatgaaaagttacaagaaatgcgtgacggacatttgaaggtgatgatttcctcaacaattattgatgagggggttgacatctccggtattgataccttaatattaggtgcaggtggtaagtccttacgtcaaaccttgcaacgggtaggtcgtggcttacgtaagaaaaagacaggtgaaaacaaggtatctgtttttgatttttacgacttgacaaataaacacttgaagaaacattcggaagagagaagaaaaatctatgagaaagaacaatttgagattgttgacatccctcttccaacgaaataaacgaggaggtacaagatgacaagtcaatgcttaacaaatgaaattcgagcacaatatagtctaggcaacggaattgttgagttcgttgaaagattagctaaaaaagcacagcaatggggagaaacatttgctacccctatacgtaaaacaactgtagctgaggagatgggacgtgacacacgtactgttactcggtatctaggacaacttgaagagttgggtcttgttagtacagaagcaaaacgtggtagaaatggaggaactgttgtcgtgtttaatactgatattttaaattttgaaccaactgataacccgattacttcggagacaaaggaagctaaggagattcgtgaacgtgtcttcccaaaagcaccaactccgaaacctaaaagacggtaccgtacaaaattagagattgcagaagctcgcattttagaacaaaagcaaaaaagctttgaagaacgcttaaacgacttacttgaacgtaccttcttggatagagacttttttgataatttcgaagaacctcgtttgtatttccaagggtatttaattgcacaaatgtacaatgcttatgcagttattttcccaaagaatagacacgagttctttaaagatattgatgtgaaaaaatcagaggaaggtttacgtagtatgaacaaagctaaatcatacaacgtgttacctgctcgttttgtaggaaccccacagtacaacaaatttgttgaagtagctagatactgtaatgagaataatattaacccattatcttatctaactgttcaatttgagcgtgcggagcatttagccgacattggtaaagctcgtgtaggggctattccttatgtaaacactttactgtgtgaagaagctcgtaaagcttattctgacaatgtaatgttttatcgtaaaatgcgtaatagctttaacttattcggtatgagtagtagttctgttccgtataaaggggctaaatatgagattattgtagctctacgtactgcgtacgaactagatagaacaacaagagatacgtttaactacttattagatgaattagttagtggtgcacaacaatcagtgaaacaagcaactttgttaggttattacaatactactttaaatgctttatcagaaagtgagttagtagacgaagaccaacaattaattagagatttcttaaaagagcaagtattgttatattcacgtaagaactcattgagcagtactatctatgctttagctttcccattacaaattaacgctgttaattcagttgcgaccctaaaaggtcttgacaaagagatgtattacacttatattggtaacatgtacaaggttacagatgttaacgatgatgaatacaacagtttcacggaacgtggtcgaacaattgatttctcttacaatgctaatgatactttctttagtacaatgcgattaattgcagattgtaagggtctaggagttccggcaggtaaactaggaagcgccttacaaaaattcggtgaagaaaaagttccgttagatacttttggtatgttagatattgaacgtatctacgataaattgattgattcagatgagttagccaaagaccgatatattcaagacaaagatgcaaccatgatgagtatggttgtaactgacgaggggtagggagaaaagcagaatgagtcaaattcacaaacaaaccatttataaagccattagtgaacctttgttcgcaaaggatgtttttagtcgattaccaattgaagattttaaagaggatggatacgacatgattgtatccaccttaaatctttattatcgtacacatgatgctccactagaggaacaaacgttgttaactcttgtggaagacaaaatgttgaaacaaaataaaagtttagaagcacagcaagttgcttttaacttagtaagtgacctttataaattagaggaagcagaaacagattcagaagcaatcagtgaaagtgttcagaattacgtacgtaagaccttaacacgtgaagctatcatggaagctgtaacgaatgatggagcattaggttctgaccaaaacattcagagccttatggagtctttgcgtggaatcatgacaatcgacacaggcggacatggagcagaacttttagatttctttgctgatattgataagaaaaaagaacatctacgtaatttacaacaaaacaaatatccaacaggttttatggctattgatgctatctctgatggtggtttagcccgtggtgaggttggtatggttattgcacctacaggtggtggtaaaactacttgggcagtaaaccaagctagaaattatgttgtacgaggtttaaacgtattgtacgttcctctggaagaaaaaattgaccgtatgattgttcgttttgagcaacttctatctcaacaaagtaagaacagtatcctagttgatggggagttaaacgaacagttatatgaacaaattcaacaagcctatggtgcatgtaaagaacaattaaactgggggaacttatggattcgtaagtacaaaccacaagaattaactcccagtggtttgtcccaattgatttctgatgtaatgattcgtaaaggacaacaaattgacgtagttatcattgattatcctgatttgatgaagaatccccattcaagtggtggtaacggagagtcggatgcgggcggtaaactatatgaagatattcgttcaattgcccaagaatatgattttgtttgttggactctatctcagttgaaccgtgctagttatggtcaagaagtgaagaatgccggagcaattgagggttcaaaacgtaaaatgaatgcggtagaattaatcttcacacttaaccaaacaccagaagagttccaaagtgggtttattcgtgcttacgtagacaagttacgtaataacagtggtgtagcttatgataaaatgttgtactttaaagttattccggaaacaatgacaattcgtgatgagacccaagaagaacgaatggctcatgcgaacttgttagaacaaacaatggaagtagctagggataactacaagaaggaaaacaattttacaccaaaggatgcccaaagtaaaattaacaatttaaacgcacagctagcgggaggtctaaaataatgaaacacattattaacttttctgattttcatatgcacttttttaaggacttctctaagccagatgctatttatgggactgaccgagcaaaagaacaaataaaggttcttgaagaattaatgaattacgctcgtgaggttaaaggagacgttttatttaatggagacctgtttcataagcgagtttctattgatgtcagaatattcaatatgatgttcgaggtatttagttcatatccagatgtaccaatcattatggttagtggtaaccacgataaggtaacgaatgctctagcctctgacagcgccctagaagcgtttaacgctttacccaatgtaactgtcatctctacaatggaaaagcttgtacgggacgaatacacgctctatggagtaagctacggggaagaagtagatgaaatgaaggaatggattgcagaggaagctaaaaagctagaccctaacacaatcaatattctttgtgctcatatcggtgttgatggttcttctactggacagtattctcatacacttagtggggctttcaaggtagctgacttatatcctgataattttgatattgttacgcttggtcactatcataaacgacaattcttaggtggactatctaatgtattttatgtaggtaacaccttacagacctcttttgctgatgaaggtcaagctaaaggctttatggatattaccttagatggtaaagaatggagtatggaatttgtcaaagcaaactataccccatttatgactgtaacagcagatacagtaccagaagacttaagtggagcatttattcagtttgttggtaacgttactgaaaccgaagctgttaaaaagcttaaagaagacaatgacttgtctaacttacgaattaaagtgcagaaggactattatgtacctccacgtattgagattacagcaggttctaccccagaagaagttgtacgagcattcactgataagaaataccctgacttacaggataaggctttagaatgtttacgtatagctacggaggtgtagaattgaaaacaaccttagaacgtaatagacaagaacatattgattatatactcaatgtaaacaaagaagttggtattatgcaagatgacccattcgttttatcttatttaaactctatttctctagacgaattatacgaattgagtgaacttgctgaacaaatgtataaagaatacaccgaagttaaacttttagataaagcacttaaagagatagaagaaattggtgtaactgcttttaaagaaaaacatggaatttaacaagattttaagcccagaacattctgggcttttttggcatacacccttgacatgtaagtgcttgtaatgtatacttatgttagtaacagacatacacttacaggaggtaaaaatgttaaagtttaaacgtgtaagcgcaaagaactatctctctattggagaagtatctatcgacttagataatcgaggtcttgtcttaatcgagggaattaatgacacgaacgaaacgtttcagagtaacggttcaggtaaaagtacgttgctttcaactgtcacttatgcactatatggcactacacctagtggtttaaaagcggatgctgtaattaacagacaggtaaaaaagaacatgtctgttattttagagtttgaaaaagacggcattccatacagaattgaacgttatcgtaaacatagtaaatttaaaaatacaacgaagttatttcagggagatactgatttaacacaaaaatctgtagctgatacagacaaaaaaatcttagacattttcgggattgactaccttacatatgcaaatagcatcatgtatggacaaggaaacgtagaaatatttgctactgccacagataaaggtaagaagcagatattagaaaatctggctgatattggtgtataccgatatgcacaggatgtagcaaaagaaaaagaaaaagaagctaatgccttagtagaagaacttggtagacaacatatgaccaaggtagctgaaatcgaaacattaaaacaggtttattctagtgcattagagcaatatgctaatacagaaagaatgattgttgctcggaaacaagagtatgaagaagccagagtaaaatacaccgaggcagaagacatgctcactcaaatggaacaagaagtaacaccaaagattgaacaactaactaaagagttggaagcttgtgcagttccagaagatagctttgcaatatcagaggaattgcgagaacagcaggctaacctgtttaagttaaatcaagcaaaaactactacacaacaagctattaataaagcacaagtagatttgagtaacactgagcaagctacaaattgtcagttatgtggtgcacctttagatgcggaacatcggcaaaaagagatgttacgattgcaacaagaaattcaggagaaacaagctttcattacacaattggattcagcaattgttgcttactctgatttggaacagaaagctaaagaaaaacaggcaagggtacagcaagaagttaacgaagttgttacaaaacaacgcaatatacagtcagctattaatgaactaaacaatcgtttacgtacggctgaaaatgctgtagcacttacacggaacaatgtaactaatctatcaggagccttagctcacttagagggcattccgaaaccagaatatgacacggaagcggaagctcgtattaaagcagaaatggaagacattactaaacgaaaagaattagcagaacaagaagcaagacaataccatattttagcactagaagtcttctcaaataaagggattcgttcggaggtattagacctagtaacaccattcttaaatgaacgagctaatcactatttgtctactttatccggttctgatattgaaattagatttagtacacagacagaaaatgcagacggaagtctaaaagataaatttgatttagaggtaattaacggttctggtggagacacctaccaagcaaactctgagggtgagaaaaagagaattgacctagctatttcttttgccatccaagacttggtacaatcaaaagcaaacattgctgtgaacctaggcttatacgatgaatgttttgatggcttagattctatcggttgtgaaaatgtgattaagattttgaaagaaagacagaaaaacattagcagtatctttgttattacacataatgacaatctcaaaccattgttcgaaaatgtagttactatgcaaaaaacagaaggaaactccttcttagttgaaaagaagtaaggatggtaattacatgaaattatattcagtagataaagggcgtaaccttggaacggtactcgtcccaacaaatgtaggatacacacaacgtttagacttcccgcttgacacattgtttgattggtacccatgttgcccaagatatgattacaagtacagtgatacacgagataagatgtacattgtaatgattgaggaaaatgaaaagcttccgttacgttacaatgttccgtctacaaaaaaacgtgttaagtcaaaaacagcttgctttattacagatacttggtataatcaagaagtagctaatgacaacaagaagttatttagctttgctgaaaactatgacattgtaactcctaacaaagagaattatactctggaagacataaacaagagtattgaacgtgtacaggacattttagacatgctgtatacagttcaagaaaaacaagtagaaaaagacttgattgttcgagttggcactttggaaaaagaagctcctgattcagaagaattgaaggcagtgcatcaggaaattaaagaatacatgcagttagaccgagagggaaaagcttcacatgtattaagcttattgccccaacatgccgaagagttatatgcaaactttggagaagtttacacaatgttaaatctaatgaagaaagtagtgtaggaaatgttctcagaccttctaacaaatgaactaggcataccaaaagacattgaacacgaattgcgatataactgtccgttctgtgaaccaaaccatgactataaactatatgtcaaggttagtgatgatagtacgaatggattgtggatttgttttaagtgtggtcgtaaaggtaaccctatatcgtttgtaatggaatactttggtgtctcttttgaagaagcattagagattctagagggttatggttacagattccagaataagaactacattccaaaagatgattcattaacggatgaagagtacttattgttactacttgatactgtagggaaacctaagacggtagaggaggaagaagaagaaaaactcacgccccctcctttaccacaaggattccaactattatctcaaaatctatacaatccggaagcatacccatttttagtttattgtcataaacgaggttttactttaaatgacattatccgacacaatattgggtatgtactagacagcacagtcaatcttccatcaggaagacagattaggttgaagaaccatttagtatttcttacacatggtgacgatggacagtatcagtattggaatacacgtgcgattgctgatagttatataaagtcctttaatgcacctagtaaggacggagagtactccaagaagaatactatattcaatcttaacattgcatgtaaaactccacaagtagtcattactgagggagttcctgatgcactaactttaggagaatctggtgtaggtacatttggtaaacaggttacagatgcgcagattaatttaatacttaagagtgttgctcctgagcaaccaatttatgtgtatctagataaggatgcaaagaatgagataaaaaaacttgcagagcgtttgtatgaacgacataaagaaacttatattgttataagccctacagacaaagacccgaacagtattggtaaagagagtgcttgggaaattattaagaaccattctgtaaaggcagacggtgtaggtataatcaaattgatgttataggaggtacgtatgagtaacattaagtatgaagtacattgggtgcatcaccaattaggggtagataaaacacatggtgtatttggaacactagataaagctattgagtccatctatgattggtggacacagaatgactacaatccaccatatgttcgtatgtggacagtagatggtgtaactacattggactatgggtttcaccacatgttttataaaatcaaagaaataaaggagactaatgaattgaatccagtagttaagtttactaagagtgagggagccattgccccaaaacgaggacgagaagctgatgtagcacacgacttgtttacagacaaggatgctgtaattttaccgggaagactgggagcaacagtagttactacaggaattagaacagcttttgaccctaatttatatggtctgtttatcaacccacgtggtggcatgatgaaatacccattaactctaggtaatacacaaggtgttgttgaaggagaataccgtggggatgttgggcttcctcttaagaatactttctctttacaattcggagaatatactaacgctactcgtgttttagttattaccgaagacggtaagcttgtaggaaaaccagttaaagaagtacgtgaaagctatccagaatttgataagctttatgaagaacagctaactaaactaggtaatgagctagatttaatctatgacaatatatttactggtgtttctgaaacccatgttgttgcaggaactatctttattccaaaaggtactcgtttatgtcaagcattcttgcttccacgttacgctactaattttgttgaagtagacgaattagacgaaacagaacgtggtgaaggtgcatatggttcgtctggtgttaaataatggctagtcgtataccggatttaaagatgccacttctttatcttgtaggaagtgcttctattggtactcgtgagcgtggctgtgatgtaacagttaccttacgagacttttatgtagacacccctgatgacaagttagagcaactaataactttgacgtacaaagaagacaaaattgaaaattttacacgacttagtgcagataaatgttcatttcgtgttatactaggagagtaggcaatgaaagaatcaccaagtgtaaaacttacagaaactcatacagttactcttgtaaacactgacgtacttaaaataggacaggttattggctttagagttaacagtcctaagcaagtaggtgcagaagtagtagatgtttattccgaagctgtcggggttattgaacgtatctggtcagaacgaattgaggtcttaaacctgattacaggtggtcgtacagacctatgggcaaatacgttcgattggagagaaattgaaatactgtcagatgcggaacatctgttggaggcatataagaatggaatttgctgagtatttcaataaaatgcaagagcactatgcaaaaggtgaaactgttgaggtagaaaagcttgttaaaagcgatggttcaaaactagttacctatgctgagtttgaggatgctttagctactgtagcacaggttaccacacttgctattgaagaagcattccaagcacaggaagctaagtttggtcttgtactaaaaacattaagagaacaaaaagttatctcagaagatactgaaaaagctattcttgctgagtttaataatataaatgaacttatggaggacgacattaatgagtaaaaaagcaaaacgtgtaggatttatttctgaggaagatatgagaacatggacagagtatttagctacaggacatgttcatgataaaaaccatgcaaaacagttagaacgtttaagtaaacgtgatattagcttaggggacgtagctactgtcgtagatttcatgtcaagacgtaatgatggttatatcactgctctaatcgaacaaaactctgttaatgaaaaattacttaataaattgggtgtaacagatgaaatgcgtaatgaagcgaaagccgaatacgaagttgaattgaaacaagcacaggaagaaattaaaaagttacaagaagagctagctgaaaaactacaaaagggtgagtaatatgagcacacatgaggaattacgtgaacttggtttagttgacgaacaaggtagcttaaagatagaagctagaaaaacaatggaaattccgttacaagctttagccgatttattaaacgataaggtatccagtgattctggggtatacgtaagcgactgctttcaaagtgttatgattcgagaggaaagaccttatcgagtagttaaggggttgcatgatattcctacgttggtattttcgggaacagtttacccattggatagactaacctgttatccagacattcataatattaattatcaggatgtaagtttatttaaacctgttaaagaggagcatgtagaccaaataattttcatggtacaaaacctttataatttgaacaatagaaacaacaatttgtatatgcagtttaagagataccaatgtggaaaagttacctatgaagaaataatgaacacacttaagtctaatatggagttctggtctgtacctaattatgtagaatcattagttgaagagtattatgtgaacccacatctattcgatgttaaaacacctgtagaacaactaattgaacaagtagaacttattgagtctagacgtaaacgtgttaaagaaagggatgacgagagtacccatgactgattacagtgcagtaggaagaaagtcaaagtctaaaggtgctcggtttgaactagaaacagctaaaaatttatctaagtggtggggacatgactttcaccgtgtccccgcttctggtggcttacattggaaagggagtaacaatgttgttggagatattgtagctcctatagaggcaggatttccttttgttgttgaatgtaaaaaccgtgaagaatggactatagagaacttatttctcaataataaagaaataaaaaattggtgggcacaggttgttggtgatgctaaagaatctggtaagattcctatgcttatctttacccgtaatcgtgctaaaacttttgtgatgatggcttacaacgaagacctcatcaaagaaatcgaagaccgtggttatcctcttatggtctctaatgtagagtatgtagacgggtataaagatacccattgttataagacatttactactgtgttagaagctattacaagctttaaacctcgtaagagccaaggggaagaacatctactccattattttaacccaaaagagtatgattggcaaaaatctggtcttgtccgagaaacaaaaaagatggaagaagcaaaacaacttgatgttgaggagtctttggacttacttgttaattcctatttagaaggagaaaaataatggcagaaagaaactttccagaagctattaaaacttactattcttacttacgtgttcctgatttaaaagaacaagtatccagtatctctattgattttgtagagaactggacaggtcaagaagaacggtatgtacttgatacgctcacttctgaaattaagcctcgtttatacagcttagaaacagcgtatatcattgagggcttttcactaccggaaaaagaagttgacgtaaacgtagatgaattgagtaaagaagtagccgagttctttaaaaaagcatctacagacttgaaagaagcaattgaggcatctaatgacaatcaaccaagtcattcagaagatactgaaccgattaacgattgaccaattagaagtcactcctgcgatggtagacgttgttctcgaatatctacccgcaggattgcttttaacagccaataacgagggttgggatgcggtagagcctgacctgcaagaagtggttatttccaatttggaaaaaatgagaggagcatctaaatgattgaatcaagtaatgtaaatcatccaaaacactatacacagggaggtacagaagtaattgacgttattgaatacctaacttctaagtatcccccatcaatccgttactcattaggtaatgtgattaaatatgtttgtcgtgcaccgtacaaaggaaaagaggaagaagacttaaataagggtcattggtacttgaatcgcagtcaatcagatattactgcaagcgtaagtaaaactacgtgctctattcctacttttgacatggaagctttcatccaagatactgcaaaaggctatcgtgaagaacagcaaccattctttaaatccattatgtacatgttggatgatacagaaggaactcctgtgttccgaatactaaaccttgttgagcgtgaccttaaggctcttaaaattgcatagttactactaggtagtacagagttttactccttttgcttgtaaggcgttcctgtcagttatgttataatagagataggaaaactaaatagcaaaaggagtttaattatgagtagcacacctcgagtaaagcggttaaatatctataataccgaccgacactttaatataaacttaatgaaacgtgaagacattgcgaataaaattaaagtgaatcggttaaacgaaaaagaaattgagaaagagatggatgaactaagcgaagtatcggttgtcacaccagtgtggacaatgaacatgaagaatgaaaagtcctatctattataccaagaaaagtatacaaatgatacattgatacagaaattattcaaacatgcaggttctgtttcttattatacagatacaattgtaccttattatgttattgaacagattgctaaaaatctaacaagtgaagtaatttatccaacaaaacctaaatatgaaaatagagagattgaaaatattcagctagcatttacggcttgtcctgtaaccattgattgtccagtagttattccagatgttagtccttatgacgttttatttgctttacaccccttaaaaacaagtgtagacaaagtacaaatttcatttccgtggctgtcagaatcagaaatatctgatagacatagacgttattatcataaggttggagaccattatgaggttaaagcaaaatataaatatcaattctttaaatatgtccagacctcactatccatctgggctatgaacatttggattgtttgtgatagtgatgaggattttgccaatgtcgattactatgtacaaaaagaaaaaaataaaagaaacgtcaatagagaacgtgctctccaacgaaaggagaagtccgatgagtaaagataaaacaatgaaccggactgatgttgcacgtgccatctctcaatatacaggttatcgtatgaaagacgtgttagctatcttacaaatggaagatgaggttatcacacaagcaatttcacaaggaatatcaattaaaaaccataaattatggaaattgaatattaagaaaaaacctgagaaggtcgcatgggatggcatttctaagaagacgtttattcaaccagaaaaatatgtagttaagtttgtgccactttctaggttgaaagaagctatagatacttacaatgaagagaatgattagtcattctctttttttttgcccttgacataccttacaaaaatgctatactgaaatagtagaattacagaaaggggaagagagcttgaaaatactgttcttacaagattatatcagagagacccatgtacataacagtcagaatggacaatatgtagactataaacgtactgacatgggtaaaaagcttacaagtttacttaacgacataggtttaacaggtcgtgattatataattgactacgattatgacctaattcctgaaccacagaaggtaaataataaaacaggtaaagttattaaatacaaggagcctgtattaaaacttcggaaagaacctgaaaaacgtttattaaaacgattaatgaaaacaaaaccagacatcattattcctatgggaggaatgggatgtaagaacttattgaatagtacttctattacgaaagcacgtggtgttcctgtacaaaaaacaattactgatgaagaaacaggagagttttttgatacatggattttaccaatgtttagtatggaatacttgtcaatgaatcctaatattgagaacttggtaaaagcagacatttctactttatctcgttttattgcagagggtgcacaagcatttgagccaaagaaagttgagtatgagcttgttatgacaattgaacgagtgaaacaaatctttgagttcttgtctcggtttaaacctcttactgcatgggacttggaaacaaatagtctacgtggagatgtattaggtgcgaaaccactagttatgtctcttagttgggaagagggtcagggtgttacgattcccttagaacatcatgaatccccttggaatgaagaagaactagctattgtatacaatcatttacaagcttttgtagctgatgcacagcaaccaaaggtaggacacaatattcagtttgatattcgtttcttaatgaacacaaaagggtttgcttattttgagaataaccgtgatacactgattgggtattacttaatcgtagcacagaaaattgaaagctctaaacgtttgtcagaccttgcttatgaactaactgatatgggcggttatgataacccattagaagattataagaagaaatacaaggaagactacattgctcgtaagaaagctgaaattgatgagttaaaagcttctgagaaagcacgtgtagagaaggagtataaactagcacaggctaaatacaaagaagaagtggcaaaagctaagaaattaggtaagtctaccaaatcaattttgaaacctgtaaaagaaaaagtagttgttccttctaagacagaagttaaaactgtgaatgaaattgatggtggagactttaactatgattggattccattagaaattatgcacccatacgcaagtggagatacagattgttgcttacgtatttataacgtactataccaacgaattgctcctcatgaaaagattctagctctttggacagacttctatcctaaacttacacggacacttgctcatctagaagcagaaggtatcttcgttgataaagaatatgcgaaagttcttgaaaaggtatatgcggaagaggaagaacgtcttatcgaagaattacgtaagttccctgctgttaaagagttagaagcagagcatatggcactttataaagcaggtctagaagaatggaagaaacccaagtcagaacgagacgaagaggttgctaaacttcgtgataaatataagatttctgataaggaaaacaaagttaagttcaatcccggctctgctgtccataaaggaaaagttctttataagattcttggactaacattaccttatgacaaagagtccattaaagaaaaaccttttgataatggtgttcctgaaaacgagctaacttgggaagactataagacagataaacatgctttgggctatatcgcagagcacgatgaagatgcaaaagaattagcagaaatgctactagaatactctaaagtaaacaccttgaagaacaactttgctcagaaacttccgttactagcttcaaacaaagatggaaaagtacatggttcgtttaagattactggtacagaaacaagccgtttatcttctaaagaacctaatatgcaacaagtaccatctaaagttggagaccctaaacgttttgactatacgtacccaattaagcgtatgtttaaaacaagctttgaaaacggagctttattacagctcgactactcagccctagaaatgcgtattctagctttagtagccggagacgaagcgatgacccaagctttcttagatggagaggacttacacaaatcaaccgcttctattgtttggaaagtacctgtatcagaagtatctaaggatatgcgtaagaacgctaagagtgttaactttggtattgcttatggtgaaacacctttctctattgctcctaaattaggtgtaacaccagaagaagccgaacgtatctttgaagactactttgcaaacaaaccacgtattaaatcctttattgatgaaacacatgagtttgttaaagaaaacgggtatgtagataccttacaaggacaccgtagattgattcgtgatgcgttctctaaagaccgtaatacattcaatggtgctttacgtaagtcagtaaatacgattattcaaggaactggtgcatacttaacaaacatgtctctggtgtatattgacgattatctaagaactaaaggtatgaagtctcgtattgctattacagtacatgactccattgtaattgattgtcctcgtgaagaagtagacgaagtagcaaaagtagcttgttttatcatggaaaacctaccaattgatttcttaacaattaattggaaaggagaacaaatgagatttcctattgtagctgatgtagaaatcggagaaaactacaatgacatggttgactatgatgcagaagaagtgaacaaatttgcttcttataaaggatacgttaagtattacaaagaccaagctaaatttgaagactataagaacgcaggtatgattagtgaggaacaaatggaagccggtattaatgctgttaaagcttgcatagaacagtacaaactaattgcgtaagtcttacaaatttatttaaaaaaaattacaaaatgacgttgccctaacatgtaatgtgtgctataataatagagcagacaagttagggaatgtctgtaatattggaaaggagaataagacagtgtgctagacttacgagtgaacgaccttgaatttcgtaagatacgagttaccgatgaaaacggtgaaactattgtgtttgaccttacagaggaactacaggtaaacgagtttagtgttcggcaagcgttcttagaacagcctgcgaaatacacgtattggacttctttacttgaacgcttacgaatgtaccaagaaaactacgagttacaagctgagaagcgtaaagcagaactgtatgaaccttctagaaagtctttgattgagcaaggggtaactaagccaacaaaagaccaaatagaagcacagattatgcttgacgaacagtattatgctctgagacagaacataattagtttaacatttaatgttagacaagtgcaatatgtagtaaaagcctttgaacaaaggaaagacatgttgattcagtatggtgcagacttacggagggatttcgagtatagccagaaagtgtctatgccagacccactaaaaggtcaaaggacaagttataacaatccatataacacataaccttagaacctagttgaacaacacataattcgagaaaccaaaataaaaaaacaaaagaatggagaaattaacgtgaactttcaagaacaattaaaacaacaacttgcccaacaaaaccgaggagaacgtgccgaggtagactatccttccaatcatcttaaacacaaagagctgtttattccaaaagaaactaatcaagtattagttcgtatcttacctcctagtgtttctggtgaaaactataaccaaatggttcgtgaaatcttcttacaagcacataaccgtaacggtaaagaactaaaattaaatgctgtcttatctgcattccctaacgtagaagacccattagaccaagcacttattaactggaatgcacaaaaccgtgttcctaacaaatggaacaaaaatgcaactccaactaagaagtatcttgctaatgttatccaattaattagagacccacaaacaggtcaattccgatatgaaacggatgaacaaggaaacttgatggtacgcctattcaagttatctcattcagcttgccaagctattaatgctaagttaactgatactatgttaacaccaaactttaacccagatgttcctgattctgttaaacaatacagcttcatttcatctgcggaagcattcccagtaatgattagcaaacccgctaaaggttctggtcaaatgtcttacggtgttgatgtttatagcaacatgcctctaggagctttaccacaaggatgggaaactcaactagaagacttagcttatcaagctacaccttcatacagctacaataaagagtacattgattactttattgatgtagtaaacggtgttgaacctgtgagccaagcacaaggtggacaacaagtacaaccacaacaaggttaccaagctcctgcaatgggacaaggctttgcttctgctccacaacaacctgcttacaacatggcacaaccacagcaaccaatgaatactggttttaaccaacaacctgtagctccggttcaatcacaagctacaaacatgggtactccttcatttggtcaaacaaatatgggaacagcccctacaatgaacggtggatttgcgcaagcaccacaacaacctgtacaacctgctccaattgcagaccctatgggttttcaaatgccaatgaatcaagcaccagtaactgacccatctactatttcagatgctgatatgccttttaacatgcaagcaatgccagatgtaacaccgcaagcaacaagtgttcctgagcaaccagtagttgcaactcctgaaccaccacaacaagctcctgtagcacctgtagaaacagctacaaatactactttaccagatgttgatagcttgctacaacaaatgcaaggttagtaatagaggaacagggggctgaaatagccccttcttctatttaaatttgatatgtaattcattactaggaggaacaaatcttggcaagaaaaagacaaagtgaaacagtagaagcaggtacaattgatttaacaaaagaattgggcttaacttcttttagagatacaaaattttctagtgtagctgaccgactacctacaatgattcctcaattagactacatcttaggtggaggacttccatttggacgtatggtagaggttatcggaaagaactctagtggtaaatctacttttgcagtacaccttactaaaattgctcaactattgaaggtgccaacattgtggattgacgtagagggaactgctgaccctgaccgtttagctgaactgggagtaaaccctgatgcaggggatgtattcatggtagagcctgctttgaaaaaagacggtactaaggatacaatgacagtagaacgggtagcagaagaactacaacgtatcttaccagtaattaacaagacaggtaaacctattttaattatctgggattccgtagcacagaccgccgctgaaaaagaaattgaacgtggtgtaggtaatcaacaaccgggtattaaagctaaagcaatggcacaattctcacaaatcattgcacctttaatgactaattcgaaagcattatttgttgcaattaaccaagctcgtgatgagatgggtagtatgttcggaggtattgattctccgggaggacatgcacttcaccactgggctagcttacgactagaagttcaaaaagcaagtaagattgaaaatagtgaagtaaacgcctttggtgtagaagagaagtcctatatcggacatatcatgcgtattaaaacgttaaaatctaaagtatccagaccacagcaaaaagctgaaatgtatctaatggctgattctggtttagaccttgaagaaaacatctaccgtgcatgtttcgcaactaataagcaatatggattcattagcggtggtgcatggaaagcttacacaacagatgcaggtcaagaaatcaagtttaattctgaaaagaattgggtagacttcttgaaatcagaagaagggcaacctgtacgtgatgagctatttgctaaaatgatggctcgtagtttccctaatggatacgcaccttataaaaatgaagagattgatatttgtcaaataccattatataaatacgttaaagattacatggaaactcataaagaagaagcacaacctgtagaagagcaaacagctcctgtatctgcaacagatgtttcagacctattagaccaaattaagtaaggggcgttatgcccctttttataagagatggaggaaacctaattgcgtaaaactacaccagttaacaccgtactagaagccttagaaatgtttcaacaaggaacagcaactacagaggttcgtacgcctatttctttacaatctgtacgtaaacgtttcttagatgctaaagaagcaggaaaacgtgtattgattgaaaactctgatttaagtagtgcaaactctgttgttgttgatattgactatgtaggtagccgttggtgcttaggttatcaaaaagtattgtactttggagaagaggtacgcattcctcatactatccacttttgcgatgtatatggggcttatggcaacgaagcacaaagaagtaaacggcaagtgaaaatcatttttgaaggagagaacccttttgagtagagaccttaacaaagaggaacgtgagattagaaacggaaatcgtttcattactgaggttcacggtaagggggtctttccacgagatgttgatagactgtaccaccgttatgccaacttacgttacaaggtctataacactcataaagactcttttcgaagtgaagcctcacgaaaagaactaagaagttatattgatgaacagtttatcaagttaacgaaagaatatgatattaacggagaggtcgattttccgggatatatcaaaaaggctcttaatttaagagttagacatagctttgtgaaaggacgttttcgtgatagtgctcgtgaacgtctgggagcagaggacaacgagattgaaacattactgggaacagatacctcttctcaggaagcaattgaagatgctgaactaattgatgatttactatctaaagcgaagtttagccctgtagagttagccgtgttcagctatctactacgaggtaaagtaaaagatgctaatatcattaaagaggtgtcagcgaagtataaagtatctcaaaagtctgttagagatgcaatcaaaaacgtgcgggagtacgttgcgttaaatcttaaagaccgatagaattagttaaaatcctccttgtgtgtatgctatattagcagtagaaacacaaaggaggatttttgtaatggaagaacaaaacaacactggcaaatacgctccatttattcgactaattgtaatgggtatctccttcgtggctactggtttaacaactatgtttggttgggaaccactaccttttacagacgaacaaatgaaccaaggtttaatgcttgtactttctgttggacttgctatctataactggtacaagaacaacgctgttactaagtacggtaaagctaaagagcaagcaggtaaagaagtagtcggaactcgacaagacttcaaacaacaaggctaagtttgagggggtaaaacccctccttagttgatattaaaggagtatgacaatggaactaacaaatttaagtgctaaaacactacccgaattaaacgggaagtttcttgttgtagagactctatcagacggatacacaggaaccgtaaacggtcattataactatgaagttgttactaaaggtgaggactatgaaatctatcccacactttggaacaacgaaaaagcgcagtttgtaaaagctgacgaaatggttgtgtatacaaacggagatactgtattctatgtaacaagaacaacaaaagacccttataaccatgctgttatcagtgagttaatcgttgaagaaggaatggacaaggataagcgtacccttcaagctttccggctattcgcagacgatttattctctatcggaaactataacgtgttcttaacacaccaaattgatgtagtggacagcccaaataacgtaaaagttgaatcagtttccttagacaaagaatccggaacattatatgtgggtgacacagtagacttaacagcaactgtactaccagaaaatgctacagtcaaagacgtaacattctctgttgttccagaaggaattgctactgtaactgctactggtgccaaggcaacagttacagctaaagtaaaaggttcagctaatgttatcgtaactacattagatggagacaaaacagctcaatatgctttaacagtgaaagaacacgtttcagtttctggtattactttaaataaagaagctacttcaattgttaaaggtgctacagaaacacttgttgcaacagtaacaccaccagatgcagaaaacaaagctgtaacatgggcatctgataaacctgccgtagctaaagtagaccaaaacgggaaggtcacagcagtagacggtggtacagctaacattactgcaacaacagttgatggtaagaaagtagcaacttgtgttgttacggtaactgtgcctgtaacaggcgttacactagatacgaatgctattactttagaaattgacggtacacaaaaattagtagcaacagttgctcctgctaatgcaacaaacaaaaaagtaacatggaaatccgataaaccggaaattgctactgtagaccaagaaggtacagtgacaggtgttgcagacggtacagctaacgtaacagcagaaacagaagatggtaagaaagtagctacttgtgctgtaacagttaaccctgcgcaagcataatatactaggaaaagaggaatactaaaatggctaaagaaatcgcaaatattgcagacttattaaaaccaagcgtaaaaactgtcgaactagacggtaaatatcttgtagtacctaccctatcagatgggtatacaggtacagtacagggggcttacgcttatgaagtgaagaaatcaggaacagactacaaagtgagtgaacttatctatgataaagacaagaacacgtttactcctgcggatgctccaattatcatgacagatgatgatacaattttcttcgttactcgtacattgattgacccttacaactacccagtaattagtgaggctacagttaaggctcatgaaattaaagaaaaacaagtacttcaagcatttattgcttttgcagaagacagattcaaactaggggtatacaacgtattcttagcagatgacccttatatcttgcaagataaagcagaagactagtttgttctagtacaaaaaaactgtacaaaatttaaataaagtgttgacgacttacacctctcttggtatacttagactatactaaataagagaggtgttttattgtggttaaagctaaaaatcctgtacaaagacgtagaggaacttacaatagttgtgatgtgttagttgaagaagagaacggtttcttttactatagtgtacttaactcagatggtaaagaaatcataggtggctttagggataaaggctcccaagacatatctacattttacaactacttgcttaagttagtagatgactacgttaaatgtccagagggttttgttgaagatgtttaaacgtaagaaatactatgtagtccaactagttgttcaaccagatagtaagccttggtacaggtcaatacttgtccaaagagaagacgggtatctgtttacagaaggttacaacagaaaatgtcgggtagagccaatgtatacacgtcttggtatgaaatataaaaaagtttttactgaaaaagaaatatgtgcaatcaacccagattacatgtattttgcagtggaggtgaccaaggatggcagacctattaatgataactaaaaagaatgttcagggttatgtattaaactacttatttaagcaattagctgtaaaaagtgaacataactacacttgtgagtttttagataagtttaacttacctgatattaaaaattatgcgaataaagcagatgtactaattatttcaggcttccctttttatgagagccaacgtactactgtggatgaagcattacaggtaatgaacaatccgtttagtcaattctttcacttagcaacttttggggatacctatagcaacgagggcagttttcattcatatgtagatgaattagtaagccctgtaggaaacttccctaaaataattaaagaactagagaacttcttgaaatttaatgatgtaattcggcacctgcttctaagtgatatggaaagtatcatcgaagcaaccgatgcgtataatcgttatgaggtaacagatactattctagactgggtttctcttgtagaaacgtacagagagcagttatacgcaagatacggagtaggtacagacctagaggaaatacttgataaggataaaaccttggtcaaatcattgcgggagaaaaaagacgattatatcaaaagaacacttggcagaacatctgcacaggtaatcaatggtacagtcgtatgttttacttacgcagaggaatatgtaaatgaggtagcccataaactgattgagttttatcaatcatacaactatacaaaagtagctgtctttgttggacgacataccaaaggtgatgatatgttcagtattcgaacagcaggtatagatgcgggagaacttgcctataaggtaaacagaggtagaggaaaacctactactgcaactgttttcttaggtaattcaggtcaatccacattcaacgcattacttaacacacttgctcaaattgtataacaagtaagtgtgttataataatgttaggtataaaacaatacacagggagtgtgctacttgaaaaagaataaaatgctagaagacctaatgaaacaattagataacccatacgtaattggggcaattattgcaggaactttgcaacatgactttaaccgtatacacgttagcaaatataataaatatgctcgtgagtttggtttagaccgagagaacaaagaaagcttagaagcactaattgaacatttcgattctgataagttattaaaggaattgtacatgtcaagtattgcaggagaaattaatgtggacatgcttcgttcatttaaagataaaacgaaaaaatccgcattccagactttatctccattcgtggtagacaaccaagctgttttagctcgtaatcgtgagttcaacaagattcaacgtgagggtgcttacttagaccacttaattgaaggcttgaaagagcacttatccgaagaacttgaaaatactaatacgcttaaatatattgaaccagaattacgagtaaaaggcaagccaagtgaccgtgaaatgattctatgcttatctgactggcatattggagcatttgttaacaatattgatacaggcggatataattacgacattttccgtgaacggctaaacagtctattgtcagaagctttccgtattgtgaaagaacaaaacattcgaacagtacatgtttatcatattggagacattattgaacatatcaatatgcgtaatgtaaaccaagcgtttgaagcagagtttccggcaacagaacaaattgctaaagggattcgagtattagttgaaacactaaatgtcctagctaaagcgggtctagatgtaacctttggtatggtaggtggtaaccacgaccgattccaaggaaataaaaatgataaaattcataatgataacgttgcttacttagttgtagaccagttacactttatgcaagacttagggtctctacacaaaaatgtaactttaattgataacagacaagatgtttatagctttaaagacactgtagcgggtaaacgcattaaagttgttcatggagacaatgaaggtaagaaagtagacgttaagattccaaaacatattaaagaagaagttattgagtatttaatcatgggacatatccatacaacacgtattattcaagaagactattcacgattccatgtatacgttgggtctcctatgggtgcaaataactattcagcagaaaacaatctaccaacaacaagtccggcacaattaattatggtcttagaccctaaagtggatagcccacaatttatgccaatctttttgtaggagagtgatagaatgaacccgatttactttttattatctatcatgtatgtattcgagtttggacaagcattcttgaatacgaaacgaaaagaacgatatatgattgaagatggtggagaacctcttcctagaagctcttacgtgttcttattcattcaatatgtattgcgtactcttttcgcaatcttgcttatttttattgtaccagagagcctacagttcaacgtaggaggtattactgcctttatagtagttttgcttattattccatttatctctcggttcattgaagttggtattcgggtattgattattaaatacttgcaagccaagcacataaaacgtattaaggaacaaggggacgaaaaagagactaattagagtctcttttttgttatgttatattaagtattgaggtgaaaagaatgaaatatacagaaatccaagtaggtgacggacaaagcaccttattagatgtaaaaagcaaacctgccttaattcgtagaggcacattaacaatgaaagttaaatcaagagatagtctaatcagtaaggtagaagagaaacctgtatatattgttgagctagcagaagaatcctatggtacaagcgttgtttctgtttttagtgcagtacaggagggaagcggagaccatgtagttgttcagaaggcgtacacagagaatattacgcaaccatcgtttaaaggcaccacatttttaggtaaggttgctcaaaaggttcatgaaaagagcttaaaaccaaaacgggtaatcacaactaaaccccctgtttttttagcgcctgttgtcatgggagtagatacttttacacaggaacatggactaggattttatgaacgggaaccagataaatttgttatgaaagacggtcatcctagcattgagtatggaaagaacacaggagtctttatttgcttaaactctattaagtgggataaagcttatgtcaatgcaggacaattgattcaagactatgtagcagacaaacaactatggtttaatctgggaggaactaaaccacaatttaagagtgaagttaatcaatgaccgataaccgtttctatgaggcagacatacaagagttaatcttgaacaaaaaacgtatttttggagacatcggggaaagtgctattgtatttgagaaagcagttatgagagggaatactatttgtgattgtttaatctttacagaaaaacgaggcgttattggtattgaaatcaagacagaacgtgactcaacaaaacgtttgaataagcaacttaaagactatgaaaaagtctgtgattttgtttatgttctttgtcatgatacacatgtaccaaaagtggaacagattctaaatagatacaatcatagacatgttggtattttagcttatacggagttcatgggtgaagctatgttaggaatatacaaagaagcaaccccttcaccaagtaagagtgcttatcatatgctagacattctttggaaagaagaaattctaaagatgttaggtacgttcagacattacggtattcgagtagagactgctacaggaaccaaatttatgcacacagctaaccgtagcggaggtgtgagtggtctttatacgaagtctgcgaccggtaggacgatgcgaaagccagacttgataagaaaccttataaatcgtgtagggggtgctgaggaggctactagggtcttctgtgacgtgttcattcataatagacagcatccagagaaagctattaagttaagacactttaaacagcaaccaataaggagtgataacaatgagtaaacaaggactgccttttggtacttgggagaactccgcaggaagaaactacacagggctaggtaacacagataacggacataataagaaacgaatgtccacaagaggatattatcacgtagctctgacaaaagagtataggggactaacagagagggactttgaactaaaacttgaatatgggaaagaccttgtttctcaatatacaggtgtaccgattgacatgcttgttcttcgtaaaaaaacagaaaaacaaacactttcgtctatagatagtgtatactatgtttgtcgaggaaaggaacctatcggtaagctgtctgtaagggcacagagacggtttaaagaccttggactcacatttgtatacctagagaagaactacgcccctaaagtggtgagaagggtgtctaagggacagcgtagccttctgggacaaacgaaatcagataaacgtaaagcaaaccgaaaacaaaagaagccaaaaacaacaaattaggaggacaatcatgctaagtaaggggaaacaagttacacttagaaagttaaacaatattattacaaataaggaatacatccttataggtgctcgttacacgaacgattctttagaacgagatattcctattacaactgtaattgacgatatacttatagatttgaagaaagagacaatggcaggttgtgttttctttagaccagtaggagatgcacaaagaaatgccttatctctattaaaagatgcgtgtatgcactttggttacggagaatttttagatgaagctattgaacgtcctgcattgtatgcggggctaaaagcaaacgttatgctacctgatacagccttctcaaatatccaagaaatcccattcaatttttatttcacagaaccagaagtattttgtgaagaagtaactatcaagggaagaaaacatattcagtacactgtcttagacagaatcagtttagatgatgtacaacatgtagaacaatctcttgttgttcttttccgtaaagcagagtatgatggagaaaccctgttaggtgcttacacggatacaaaattaacaaagacagaagcaatcaaaatccttcaatttgttagtaacggttccttacttgaacaggtagttggggcagttactgtattctcagataaagtagtgtctacacttattcctttgtttaatgatgtagatataagctttatgaaatcaggagaaggaaatcctgttgtctctattacagcagatacaggaggcattgcctttgatgaaaaagatttggatggtatgtctattgaatctcctagtttcggagcttaccgtcttgtgttacatgtagggaaagacaccgtaagtattttaattggataaatttttttgtaagggagtcaaattatatattgactctcttatttttgtgtgctaagataaattcagttgttgtacaaggttacaatgacaacatgtacaggagggaaagaaatgagtgtagcatcaagtttagatagagctgatgaatggttgttgtcgcatttgtgtgataagcgtttagagtatttgtctcaaaaagaagagttaactgcaaatgaaaaagcagaaatattactaattcaagagcttaatatgaaactaatatgtaataccttacaaaaagagacacctgctcaaaccgtacagggttctgacgttactagtggcttattaagcaaagcttacacaaactctgttaatattacatcgcaagaagcgtggtatacatctttgttgaaacgtacgcttgatgttgttgatggaataccttgtgtagggaatgtcactgtatttgtggactcagatgagattagtatttcgattatggggcacatacgacacgacaatgatttagcctgcgatgtctacgaaatttcttttgaaaaccttggaggtatcgaagattttctaattcatgttgagggagtagaaatagctttaccggactatttagagtttattaccgaggaactacctgccattttaaaaaaatcattatgaggagagagaataatggatttaaaacaagcttacaactatgcagtagaacatttaaatgaaaatgccaaaacagaaagtgaacgtatctatgtattgggtgtcttccaactaggaagccgatatgccggatacgatattgaatcaagtgattacgattttacagtcgtttacatgccgtctgcttatgatttattaaaccgtgagtatggacgtagcaaaattaagtttgaatacaatgattacgaagtagaaatgtctttcatggatattcgcaaatacctaaatcgtttattatcaagttcactagaaacattacaaatggtgtttgcaccatctagcatgagctactatgctaaatttggagacgataacctatcattgcgagcagaagagcttgtagattttatgttaaaactacgtgataaccgtaaatcctttgtctacttgaacacagataagctatatgattcaatttcaggaagagcaaagtcttctatgggtaatgctagcattagctacaaaaatgatgaatatggtcgaacaatcaagtatgcgattggtgttgaatacatgcaagacttacttcaagcattatactacaatgaagacattcgagaaggtttgactgtttcacctatgcaagcacctgtttataaggaacatcgaaacaatcctagctatgaaattgctcgtttgtaccattctcgtgctgttaaccttatcgagaaaatggtcttaaacaaagaagtggttcgtgaaactttacgaaaactacagccaaccgaagacactattaaagtagttcgagaagtatggacagaagagtttgtaaacattatcttgggaggttatgacgactaatgatgacaacagcagtaaaagaaagaacattagatgaaatcttaaccaatcctaagaaaccgatgacagagaaactggttgaagctgaacaactaatcaagaacagtgagcatgtttatgactttgggttaggtacagttaaagaaactatggtgatgtctggtaaaaattggttagctagtcacttatatatcaaagaagttactacttatggatttatcttgcaagccgttgtatataaacagtctttagttgagcgggctgttactaacgatgagggtgaagaaataaaacctgcttcttatgactatgagctaaaccgtgtttacgaattagagtacagtctacgagataaatatactagactacttaaaaatggtagccctttgaaattctcagagaacaacattaaaaacatgttttctggtcaagaaggtgttattcaaaaactagattcatgctgtaacaccgagatgtactcttctatgtatgacgtgtttagttgtattggaaatgaatcagtaccccaagtagctcgttttcttgttagatttatgcaattgaacgtggttgaactaatctataaaagtggggttcctattccttttgctaaagactttgctagagaccaagctaggaaacttgaaaaaggtaatggttggtatggtagtccagagcctaatgctaactgggtagattgcacagctactgcacctgcaaaggttcttgatattccaaagtctttatttaaaattatttgtcaaggaaatgttagtttcagtagatatgtttcaatgcacagagctatagaaagagctgaaagtgtgggttttgaagaggaacctcgtgaggaatggaacagggaactacggatgtatattaaacccgaagaagacgaagctattgtacaaaaaaggaagaagtacaatgaaaaatgtctaaaacgaaataaacaaggaatcattcgagcttgtggtgcactgtatcatttgttcacctttgctgtggaactagatagtgaatatggaattgagaaagctagtaatttagcttctcatgagttcgaagatatgttatacagggaagtggtacctacccgtgtaaacagcctacagaataactcagcagtttgtattgccttttctttaggattggagttaaatcgtgttgccagatacatgtactatcaattacatgtagaacaaggatttactgatggatattataatgcaacttaccgtgactacctacgtatgatgcgacaactagagattgcggataaaggtaactaccctaaatcattgaaaacagtgcatgatgtagctgaaatgaatactagaatgattaaggataaagaactggcagataactttgcagaacaagtcaaacattaccgagagtgggaagacgttaaagttcgtggtagcaagtatattatgcgtgcacctgaaagtatagacgaccttgccaaagaaggttctagtctaagtcactgtgtattcagttatgctcgttcagtagccctaggagaaactacgattatgttcttacgtactaaagcttgtccagatgatagcttggttacagttgagattaagtacagccctagccgagaatgctatagaattgtacaagctcgtggtcactctaatcgagcattaacggctgcggagaacgagttcttagagaaatggtgtaaaaaatcggaaaatgtggagagaaaataggctattttaaaatgaaaaaatactactagttagttcattttcttaagttagctaaaacgattcatttcaaataacaattttccacctacaaatgtttcatatataattcacagaaaaaacacaaaaaaccctacagttatgtggggttttcttgcgtttcatttatatctgaaatttaacagttatgtgtgctatattaacagtagaacctaagaagggcgggctttatccgtgttcttagaatatagacatgttgaaggagtttgtatttgaaatggctaaaaaagacttaaataacagttcagtattgctgaacctatatcacaataaactattggtatcaaaggttgatgaagccctagacgagggtaaaccttatgattttattattgctttttgtaaagagaaatttgactttgaaatcagtaaacccgcattatctcgttataaagaaaaacgcagagaggcaattgagacaggggtagacctagaaacactacttgacaaaagacgaaaatctggtaaagttatagacctaaaaggaaaagaggttgaaactctaccaaacacgaacacgtcttatgaccaaacatttaacgcagtagagcaaatttataatgacgttgaagtgttagacactatcattcaaaaaggctttgctagcttgaaagaagtcgattatgtagaagcacctcttgccatgaaagctatcgaggttaaagcaaaagttacaggtaatcaactgcaagggttaagtctagtgggattgcgtgaactaagattacgtcagtctgctaaagaacaagcaatgaccgaagttatcttacgtttcatcccagaggaacaacacgaagaagtttaccaagcaattgaagaagcagaagcagagttctatgaaaacttagacctaacagcagaagatgcacgtatcactagcgcactcgaacaagcgggcatgaacattatctaagggggctattcaaatggcagaaaatctagtggaagtagactatagagggctgactttacaagaagcacttcaagcgctactagacaaaaaagtattgctagtcaaaggactagaacaaagtcggaatttagatgtattgatacgtctttacaccgaaggagtcgtacctgttactcaaatcagttatgatgttgttcctgctgatggacattggagagaagaatactggcagatatttgatatatctgttaatgctctaagtacgtatccgtgttacgtgtatgatgctgaaacggctaataaagcacctaagttcctgattggaacaacagtttattacaccagtaagatggatagcactcgagattccgctatcgttattggattgtacaaagacgatgagggcaattggcattacaaattaagtagagaccaagaaatttacgcagagacagagcttacagcagacaggttgtaagcctgtctttttttgtaattaaagtattgacaataaacagtaagcatgatatacttatggtataaattaataaggagagattcatatgaaagaagaaaagacttatactttagaggaaattagagaggaaattagggaaaaagaaagaaaagctaaagaattagaagagttgcttgcaaaactaccagaagatgtcttatgtgaagaatattatgcaatggaaaacgacatgttttatgcttgggaaaacggttcttgtgaacaagtgcagaagttgttgagtaaacataagtataacttagactcaattcaattggttcacgacgtattctatacactgaacaatttggtagaaggggaaatagaatatggaaaataagtagttgacagtactagtacaagatgttaacatgtttatgtacaagaaaacaaatcaaggagagatgtacaaatgaaaccattcgaagacatttttgatgtgttaaataaagcacgtcaagacaaagacaaggtaacacttacttttattgaaggactagacaatattgctagacttcaaattgaggattcttctgctacagcaggaatcactcgttatgtaaagttctacaacaatgacatccgtaagttccggtacgttgaccaagctgactttgaagaaatgtatgcaggcttagaaatgaaaacaggtaaaccaaaagaagaaacaattgagtttccttctgaggaagtaggaattatcagtgctttaaaaatcttgcaacaaagtggtgtctttagtgatgaagacggaatgcgaactttaggaattaacacgtctacattggaagatgctcactatatcttacagtatattgagcctgcaattgaccgttacttcgaatctttgaataaggatattgaagaattagaccgtgtaatgattaaccaatcagatgaacttaaacaaaaaatctgggaaagctttgtatttagcaaagataatctaagcaaaatgctagatgactttgaattggcaactctagacacgttcccaaatgtaccgtctaatttgattgttgagacttgttcagaagtgaagaaaactcttgaagggttattgattgaagatgcggaagaaaatcctattgagtgtcatgattaccttgttcgtggtttcgttggtgctgttatccgtattgaacaatttattatttctgttgcaacattaccttaccgtagaacagaactagaacttagagaatcaagagaagcttatatcaaagagcttgcttcaaatctatttatctttgcagaagctattgctcaggcgtatactagacttgtatgctctatcttaatggaaaattctattgatatgcacaatgctactgagtatatccaagttatggaaacaaaagcggttcactgggtaaaagaagaagcattaggcggaactatgttagctaacaatgaggaagacctcgttgagttatcccaagctttaaactctatgacactagatgacgtacgtgaaacccaagaagaccctgagaaggctgagtttaaagaagctttggaagaactgcttaatgagttgataggtgttttttcagaagacgaggacgaagaagaagttgacgaaacagaagacgaaaatgaggaagaaatgaaacaagccttgttagaatcattagaagcatttgaaaacctgttacgttcaattcaagcccctactatggaagaagaagaggaagaagacaatgaggtgcctttcgaaacacctatggtagacatggatgaccttcttggatacttattatcgggggaacctaaagaaaaagaagaacctgtagaactttcagatgatgcaaaagcagagtttgaggaatactttgcagatgaaatcggtgagttacaagaacttcgtgaaaaagggaaagatgctgtagccttgtataataagattaatggggaactaccattaaccgagataaaatcaatggctatgaaaaatatgggatttgcactgtcaactctgcaaaaaatgttagatggaacagagcttgactacactaagaggggtctacttgattccttagatagattaaaaggaagcaaatacaatttatttgtagaatatattgagtttttgagagaagcatataagttgtataaaacagtaggcatcggtattgttgcttacgcacatgcaattgttgaagatatagaaaatacggttgataacgtgatggacattgactatgaaactgcttaccttgttaagcttgcagttaaacagattaatcaagacattaaagcctttgaagaaaatgatggatactctgatttattagccttctctttagcatttacactcgttgttatcatgagagactatggagaaaccgacttaagtccaattagtgtagaggtagaagactttgtgtctaagaaaaaaccttccgttgttgtcgaggaagatgaagaggaagaaaaagaaggagctattgacttagctaaagagttgaaagacttgattcgtgggactgcattagacaaagacaattctttaaacaatagtgtagacgaagaagccctgattactgattataagaatggtgtctctcaaagagaactcacaaaatgttataatataagtacagggaagttctactcaattctacgtagacatggtatcgcagtagatagctctaaagtagctaaaaaggttgcacatgtagaagaaaacccggaagtacttgaacaggttcttagagattatatcgaaggtaaaacattagcttacatttactcaaactataatctatacaagaacggtttgttctatctactagataagtaccaaattccacgtagaaacaaacgttaacttccaaataactttaggcagtggctactatggtcactgcctttaataaggagaatatttgttggaagagacggtttataattttatacaaggcttaagcgggacacaattaactatattagaagatacatttgctttactaggactaatctttatacttataggaatacattttttagtagcagatacagttgaatgggtgaaacttgttaggaatccaagagtatctacatttgcaacaatacacatgtattttactttttatctaccgatgttcattttctttttggtagatggtagtacggttactacttttgttgtttcattactgctttttgctgttgtgtatacatggattgtctggcttcgagtgggtagatacacagaaaattggtcagtagtacgtccgtttgttacctacattaaagcacaagaccatgtgtgtacgctagttattggttcagtacttttaagaatagtactattttttataaagattaggataggttaagataggataggatggaggataagatacatgaatgaaataatgagttatgtttggttgggtgtgtttattgctatacccgtaattggctttatctatgtatataactacaatagaaaaaacccacgttggtaccttcgcaaaagctactgggcgccactagtgctagacttagttgtttttggtgtttgggcaatggtaggcgtaatcacactagctgttggacatacagaaactactactaaaacatttaatattgaaccacttacggtttatagttcaccagaaaatatttatgcaaagataggtagcacggatgacagctatgttaactttgcaattacaggtaagggaactcactctgcaccacttggtaacactagtatccattacgttgagtccgaaggtagaccgaaagtcacagttacttactacaaattaggttcctctttctcagcctttatgggaatgcagggagaacttgtaactaaaaaaactcgtgtagatattcaagtacctgtaggtggggtggacgtcacaaatacaggcagtacctttgaagagcaatcagtaaatgatttacttagataattccctaagtagcgggctacaaaaatccgctaagtagcaggctagagacatcttttataggtgtctcttttttattgacaaaactgtacagctatgctaccatatacatgtaaataaaacgagctaaaaaatttgagcttacctattgacattaaacaatgtacaggctataataagcttgtaagataaaacgaaggaggaatttacaatggaaaaacaaaaacaagtgattacaagaaaacaatatgaggagcttatggcacgttataacaaaatagactatgctatcatcgcagggttcgttatctttggtacaattatttttggactttggggagctatttttatggctgttgtaggtgcatttacattcccaaacatgcaacgaaaaagtcataatttaatagaacaagactacattgttagagatgacattcaacagtaagcttaattgttgactatggaaattacaggtgttactataatggtacaaggaggacaaagaaatggcagaagcaaaaaagagctattctgacatgacagaggaggaagcacagtatgcaatggtattaggtgctagaatcgctcatgcacgagaagggttaggtattagtcaaggagaactgggtaagttagcaggtttcaatcaaacaactatctctttaattgagacaggtaaacggctacctaacttaaagacccttatcagattgagtaagattcttaaaaaaagtttgaaaattacattggaatgaggtagagaaaataaaacagggggagatttattatgacaacgaaagtaaaagaaacaaaatcaaaagtaaagaatggtgaacgtacaccgaaggaatttgtagcagggatgaaacgtagtaagaaagacttgtcacaaacgcaagtggtaacttctttaatggaaaactatccagaacttacaccaaaagacatccaagaaattacaggtattaaacgtggaactatctatacaatccaaagtcgtctacgtagtgctcatcgtaaggaacatacaaagaccgcagatacgccacatatggataaagtagagtctattagtgaaaccatgagtccggaagctattggtaaacaagacttattcaatcgtttagctgatgtatacttaaagaagattgaagaaaccgaagatattgaagaagctagcaaatataacacgttacttattcaagtgatggaaagcttagataaatgatagcaggattctatttatataatttaagagtcctgattctaccgtatatttaacaggaatgtgcggtagaattttatttacataaacctattgacaataaacaatagataggctattatatacatgtaagataaatacggggagatgtttaaatgcaaacagcaactaaaaattttgaagttatacgtaagacagatgatttaatttattaccactttgcaaaagaaagtagttacgctatcagtaaggcagataaacaagagtgggaagaggcaatgactgaatatgtgaatgattttcttgaacaggcttacggaaacatcccacctatttcagtgtatatcaactctaggctttctagaacattaggttggtttcaatattatttagaagacaatggcaaacctccttatattgaagtaagtagcaggctagtaaaaagtgcgattctgctaacagatactgagcacaaagaacttgcatacacagtaattaacgacctgttaagacatgaagctattcactatgcgttgcacgtactagataaaccttctagtgatggagacgatacttttgagaaagacttgtttgtaacagggacatctcctagtctaagtacaccagagtataaagtatataaaaacgagtttcctagactactatgcaaatactatgcaaagtgccctgtatgcgatactgtgcttgcttatgagaccagaggacgttactattgtattcatagatgtatagaagagggaaaaacacatccagtcatctttagacctaagaacgaattaatcattgggatacaaccccacgtatcttatgggagaaagctactagaaggaaaatacgatggagaagttaagaagtcttacagagaaaaagtaaaaaaagattaaacatatctattgacaataaacaatagaggagttatactatgtatgaagataaggaaagggagagatgaaaatgttaaactttaacaaacatgtaacagcagaagatattatcagagatggagaatacaatgatgcagttgtagaacatattatcggagaacttgaaacaagtgataagaaaaaattagctttattcaaacaatggattgcagacaaaaaagaagatggagacacggaagctgttgaatactttaaaggtatgacagataaagaaattttggtttacatggacttagacgaaattgtagaatattatgaagaaacaggtcttgcagactttgcagatagtttagacattgactggacaggtttactagaaagctttggagtagaatagggggaactaacttgaacacagaaaacagagtaagaagagggagacctcgtaaatatccagagggagctaaacgggtagacaatacaagtttgatagtcacaaagaaacaaaaagaatacattggtaatatcgcaaagttaaacaaggaaacagtaaaagagacaagtaacaggctactaaaagaagttttagacggcaagtttgattacttgttaacacctattgtagaggaagatgtaccatctgtgccagtaacagtagataggaagttgacccatgaggtacagaagtatttagagggttacaacgagaatgcttcggaagtaataaggaaaatagtggaggagtttatgattatgacagacagaacactgaaagtagttgggggttacgaactgggggtaacttccattacaaaagagcttaaacgattttggttgaaacctacagaggaagcagaagaaaatatgttctttatggatgcttccattcaactagatgtagataaccgacatgtagtcattcgtgaaaaatctatgggtgtccgctcaatcagtcaaatggaagagcttaaacgttacaaagaccaactgatagagacagcttcacaattacaggatgcactggatacttacgttgcgaaacatttaggataaacttttaggatataggataggataaacaggataggatgcgtttaggataggataggattcacttaggataggataggataggataggatgaaaggagataggatacaatgttaagtacagcagaatacgattcacttagagagtatttagtagccgtaattcataaccaaattagtgagtatggaggagacacgcaaagcttagacgtatggaaagaagaggttaataggtacgcagataatcgaatgggttggtatctccgttgcatgagtctagcagatttgttatatgtagatactcccgcttcactggtagacatttacaaagactataaagaggagctaaacgaaatacttagagattacacagatgagttgcgtgcaggagctacgttcgataaggaagctgacgagcgcctagggtggatgtgggaagattatgacccattaatactagaagcacataatcaaggtctagtggctcgtctagggcttctaatcgttgctgaacaacttgctactcaattagaacaagggacgtttacaataccatatgataactaagtaacaggctagcctaagtagcaggctagcttttttcttctaagtagcaggttagctaaaatcttctaagtagcgggctacagtaaaaaaactctaagtagcaggctacaaaaaaactctaagtagcgggctacaaacagcttataaaatcccgaggcgtaccatccgacagccagacccgccacctttgcccgttcgatatgccaccactcaaacccgttttttccttatatatagaagaaaaaagtttttcatcttttttagtgttttttattgacattaagaaataggcatgatatagtatagacagttaaagaaaggagaaacaaaaaaaaataaataaaaaaatttaaaaaaagttattgacaaaagacaataaacaagctataataaacatgtaagataaataagacaaaagaaagagggaactaaaaatggaaaaacaaattattgtaaactttttgaaagagattgaaaaaaatattaaaatggtaaacagaggcttaaaatctgaaaacgaaactcacagcgaacttgttggcatgtatgacggcattaagttagcaatgaaaacaatcaatcccgacaccgtaaacattgacttacattatacacgtacaatcatagaaaactattttgtaggtactaatgaacaaaaagaaaatgctctagaagctttacagcttgcgttatcagtcgcaaaagactaacatataaaacggcgggacacgttcccgccttacataaaaaaagttaaaaatttttatgtttatctattgacattaaacaatatagatgataatataaagacatagaaagggaggggaaaacatgaaaagcaaagtaaaagcccaaaagaaagaagtaaaagagattttacagacaagaaacaaggcaataaacgagcttaaaaatttaaataaaaaacttatacaaaactattgacaaaaagaaataaacattatataataaatatgtaaggtaaaacaaggaggaaaaaagaaacatgcaaaagaaattatacaagaaaagagatttttataaaaagttagcttcattcgctgttatgtttttacttggttcggttgttacggcggtattttcattttcagtgtcacttattatcggtttgactttattcgtttttgcttttatgatttttgatgacttagactatacagtaagaaataaataaaattttttaatcaaaactattgacaataaacaataagcatgatattataaacatgtaagataaataagacaaaagaaagagggaactaaaaatggaaaacacaaaaaaatatacattagagggcttgaaacaactagcaaaagaaagcgggtttgaaattgaggaggtaaaaccaaaattacacgatattaatcgttattattggagtggtagcatttacggcggttcagacttcattttcattgaccacgatttaaaaattattgtaacaggtaacacacgagcaacaaaaagcgatatgtatacaagaaacaacacggaatgtaaacgaaaaagagacttaaacgaggaaaaagcttactatgaggggctagggtatcaagtatttaataatggggctttctcttatgaggctttgcgattattacagaatggaagtgttaaccgctcattaaataaagaatacagcttacaagaattgcttgacatgaaagactaacatataaaacggcgggacgtgttcccgccttacataaaaaaattaaaaatttttatgtttatctattgacaaaaagaaataaacattatataataaatatgtaagataaagaaaggaagtaataaaaatgattattgcagaaaacgaaaaatatttattaaaacacccattaaattcttgggacatgaattatcatttaatcgaaaaagaaacaggtaaagacttcttaattgatattgacgacgtagcagacaacgaggaagaaagagaaaaatatgatttagttttattgttttcagacttgcaaaaccttaacactgatttattgattgaaaacagttggaaaacgttagaagatgaataaaaaaatttaaatttttttattgacaaaagacaataaacattatataataaacttgtaagataaataagagaaagagggacttaaaaatgacaaaatacggaaaatttaaagcatacttttataatggatttgacaaaccaaaattggtggcaacaagcgttacagggcttttaagagatgttacagtatccgacacgtaccaaggagatgtaaccaaagaaatgcgattagaagtaaaagcgtataaagaaggacaaaactcttttcaagaatttaaagagtatttacaagactttaatatctttatagacccaacttattcggaattaaaagaagcttcacggcaatggttcggaaacgataccccagaacaccatttcacggaatttagacaagcagaagcacaagcaaacaaagaagaaaacaaggcgctagcattggcaaatgtgacagaatacaaagacatgaacgactataaacaagactatgaaacactagaagaagcgcaagccgattttaacgaaaaactagaaaatggctatattcaaaatatcacattagcaacgtataacggcgctacacaagaaagcacattttacgagctaacagacgaaaatattctagaagctatttatacagacttgcacgaaactgattcttatgatatgttacaagaaatagaagaaagcaccgatttaacaaaatgggactatatacgagcttatacagaagtttataacgtgtttacacttaacgggcttgtatacattgaaagagactaaaggggggacggtgtgacgatatgaaactaaacaagaaactagaagcattaaaacgggctagaatggaaaaattagcccgtgagacaatcgagaagcctatagaatttatttacaacggtaactatacacaagaagaaatgtattatttcatggaagaacgaaaacgattgaaaagaattaaaaaacgagaataaaatagttgacaaagaaaaatatacatggtatattatacatgtaaacaagggaaacacctattcggacgaactcaaaaaaagagtataaaaattttagtcaaaactattgacaaaagacaataaacattatataataaacttgtaagataaataagagaaagagggacttaaaaatgacaactttaaaagaagcatacaacgaaattattgaaagcaacgtaaacgaaccagaagaacgcaaaacatacttacaagacttaacacaacacggggcaattagcggaatggttagcggtttgatttactacaatgaaacaactcaattctttaatgaacaccgtgacgaaattcttgcaatgttacacgaactaaaagaagaaacggggctagacgaaaaagggctattcggtgataagtggacggattgggaagacttactagaagaagaggcggacgacttagacccgttagcagacacaaacaatcaaaatttactagcatggtttgcggtggaagaactagcaaagaaagaacttgacgaactagaagaagcctagcaaacacggcgggacgtgttcccgccttacataaaaaaaattaaaaatttttatgtttatctattgacattaaacaatatagatgataatataagagtatagaaaggaagcataagaatgttagataaagaatatttacatcagcaactagaaagaagtttctaccctataaacgatattaaacgtttatcagtgctacacaagcaagagcttaacaacttgaagaaccatgtaagaaagggggctacaccggaacacgtagccaaacagttggaagaactaacaaaagaaatgaacgagctttctaaccttgcgtgttcattagagttatatgttagaagtgtaaagaaccaactaggcaacgaactaggcaagaacgtaaacaaacacgaataaaaaaatttaaaaaaagttattgacaaaagacaataactattgtatacttaacttgtaagataaataagagaaagagggaactaaaaatgagtaaaacagttgaaacagttattacattgatgaaaagagcagaaaagaagggcgtagcaatcaaacgagcaagacaacgggacatgtggggcgtgggagacttacaagaagtgtatcgagtagaaaacaacggtaaaacagtaagcttataccactatgaaacactaaccgcaaaagttgaccttgaaaacatgcaactaatagaggtatacggggaaagccgttctgatagtgatagcgtggcaactttcttatctgaattaggtttcaaaaattttgactttggttttaaaccagtaaacgggggcttttggttattcactaacaaagacggggaaagacaagaaacctatctagacgaacaaggagaaaccgccgttataaatgaatttaatcgggtacaggcataacaaaagaaagagggggaaacctctctttctaaaataaaaattttaaacttttctattgacaataaacaataaggataatataatactagtgaggaatgataaaaatgcaaatcgaaattatcgaacctaaaaaagaatttaaatttttaactagggaggaacttaacacctatcaattagaagcgggggaacttgtggaactaacttatatagtaaactacacaaaagaaacgcctaaagaattgacaagtgttttcatgtttgcggataccatcggggcaagctcgtatcttgtagacgtagaaacgggcataatgacaaagacacaaacaaaaaacccgctttctaactgtaatctagctataacaaaagtagactttttcaaaacaagcaaacttatactagaaaggaaagaaaactaatgaatttaaaagagtggggctatacatgggacggcatgaaagaaattacacgggaacaagcaaagaaacaatacaaggaaaaagaaacatttattctatatagtgatgacacagaaagccttatcgagtcagaggaacaatttaatataaagggcgttcgttacggtgtggaaaaggagggggaacaatgaacaaatttctagaagaaagaaaatcagacttgcttattcaacaaaaagaacaagctcaaaccttattacactatatagaggaaaacaaagaaccagaccaaaccatcatacaaagacaaacaaacaggcttaacaggttaagcgctcaaatatacgaaattaaaatgatacaaagaaaactaaaaagaatataaggagaaaacagacatggaaacagtaaaagacattaaaagaatgataggaacactaaaagaggatataaagcataaagaaagctatataaaggaattagacgaacaaggaagaatgatagagtcagaactattgaaagcagaagtaaaaggaatgagggacgttatacgggacatagaacaagctatatactagaaggaggggaaaacatgaaagaagttaagcttattcaattagacaagaaagaaatagatagttatcacacatggggcatatttgacacaacggaaccaatagaagacggggacagaatttctatatatgaccataaaacggggggcgttttacttatagacgttataacagtaatcaaggaaacagaaggctacttctttcttattatagaggaatagagagagaggaaaagaagaaaaagagcaaagaacccaaaaaccaaaaaaaagaccttagagcctg

SEQ ID NO: 4 - DNA, 56144 bp, synthetic construct
  source 1..56144: mol_type = other DNA
ctaaagaccacactcacaggcacacgacaggcattatagaggtgtgcgaatggtgtccgaaagctatccgaacagccctaacatggcgctagtttacataatacacattattcaaagtagaaagaccctgactcaatgcaatgttaacagcaaagagacagagtcgaagtgaagtcgcttgtgtgagcgtgtcggacggcgtgacgtgagagcgtcgtgaagcactcgcaacgcctctcgaagcgtgagggaaggcgcaggggcgcaggcgtggccacggctggcgggggtctttaggaagggcagggggtagcttttccgagggcgggcggggcgcgcgactgtccatctcacacagtttttgggaaaagcgacattataggccttccgatttattttttgctaaaaatcctctataaggcgtcccgacacacttcccgacaagctttccgaggccattccgacaatctatccgataagcattccatcaatagacgtccgaaagctttaaagctacctttcctgatacctcttccttagtatcctttaagaatagattccacaaatagagagggcgccgcttgtcggcagccctagaggcttcgcctctttctagtggagtattcacacaagcgtttattaagttgtaggaagcttattcaagccgttgcaaggccgttggaagaggcaatcttccgaagcatttccttaatgcgttctaacatactgttcaacacccctttcttatcgtttcttatagtataccataaaaaagaggccgtgtcaaggcctcctgaaggtttattttagccatagatggattctctaaccatctcgaaaaggtaaattaggacagtcactgccacagacactgctgcaacacctttccaaaagtttagggcagcatatgttggagccttcttatggactatcttaagtcttgttaccctgtgttgctcaaagcccctatagtatcttaggttaagctcctcagaaactatttccttagcttggtcaaaggcatcctcttcgtcttctgcaatgccttcccactcataaggcactccacaatacttcatcttaacaacgtaataaccatcttctaaaaatccattcatatcctttacctccgcttttaatataccttattatagcataaaaaagacgccttgtcaaggcgcctctaacattatttctctaagtcttgcttagctttattgtactcttaatgaagcatatcccagattagtttaaggagaattaagtttgttaaaatccgtccaatagcaattgtaacttctcctccaaatactgctgtaatggctacaataagcccaaatgcaatcaccaatgctaataaataagagaatgatactagtctaaaagctttccaattcatattaaagttcctccaatgtcttatgtttatccttgttatagcgactataggcgtacttagtagtttcccaaagtaggtctatcacgaatagaatcccaagatagaagaaaagctgttcccaaccagttattaatgatactagccaaagtataccgaagattattccaatagttatcagataagctatgataacggctgccaatataacgcgtttagtaagtttatcagacaatataatttccaactcctttaacaagctttctgcaaagcttaactttgactaatttactatagcgtgttgaatatatctccacaggtgtctctgaataagtttcaataatcacgtctttaggctttttacgtgtaaccatttcaataagaccttctgaaagtgttaaaatacctccataattaggtataaagtaggcgtagactctatttaatagttgttgaggtgactcgcatacttggcatctagtggaagaccatttttcttcaaaccaatactcatactcaggctcttctttaatgcgtggggaatactcttccttaatctcttgcaagtaattctcaagcatttcctgaatctctttagtatcaactttaatagtagctgttggttgaggctttctaggaattgcttcttgaagctttctatactctcttttaaggctgttgtaatcctcttgaaggcgtcccatttcctgttcccaacgcttgttttgctcctcttctactgaaagcttttgacaaacctcttcaaatttcttaccaagtctatcataagcctcttgtctaagcaatctctcttcagcggactcgttagccatttcaatagcctctacttccttatcagaagcatatttaagacgctctttgtagccagcttctttaagctttaaggcgtctacctctctttgaagctcttcgttagccatctctaacctatctaaggccagttggtagacagcttttctgccagtcaataattcaatctcttgtttaagctctttaataagcttgttttcgtccttcttaaataacatcttatcaatcctttcctaatactccactagtatagcataaaagaggcctgttgtcaagcctctcctaacactttttaaccatctaaccaaaaatcttccatacggcagaatccataaccgttctcatgagcgtaaatgccctcatgatagaggtcacaaagctcttggataacccctttaggtaccccatacttagtggaagctttctccattcgtgtaacctcttctaaaacctctccagtagcatcgtcaaagactaggatgcgcttattgttgtcgtagtagtgtttaaggttatcctcatgtgttaaccattccaagttatctaggttgttattaagcttattgccatccatatggtttacagtaagctcttcccaaccttctattggattgtaagtggaaagcaatacccgatggagtcttttcttattcccatcgcctagtccaatttccgcatatcccttatcatttataaaaggctttagaatcttaccagttaggttattaacgaccttaccagtctttgttatggagtagttaggaaacccattaacaaccttccactcaccctccaaatactttttgatgggctttttagaagctagtggagaacctttctcaaactctcttccagtataactccacacatgccctgcatacaccttatttttagcacaggcgttgcggacacttgttgaatccttccctaaatccttagcagctgcatgagcgcttctgtaaactgtctctaaacctgtctcaacgtctactgatttaacctcttttataagcttcactaaaaaccctcctaagtcctcttctataggcatattgtagcacctttcaggtgccttgtcaatatcctttatgttacatttgtgttacaaacattaaatttactttacagttataaaatattccatcaaatagtgagactaatttaaagcatgtgggaaatactgtcgtattagttaagagttagttagcgaagctactaacgagcggtctccagcgagttagtaattacttgacctttcctaaaagcttcctgaaacgttctcctaagccttcctaaagctttgagacgtctaggttacaggtcggggatggagtcagttgttaattactttaaggacgagtttgtagaaagcttattaaatcgtatggcctcacctaatgcaaagtgccagcagcgacctttagtaagcttcctagagactcgttttaatgtgtaataagaaaagccttcaggatagcttcccgaaggccttatttatgctttatttataggcttccataattccagcaacgaagtgccattcgtcccagccttcagtacgcttttgaatagcttctaaaaggcggaagaactcactttttggaatcatgtctgaaggattagccaaaggaatttcatcttctatgataatgtcttccacaaagtctctgatagaggagattccgtcaaggaaaccttcatcccaaccttttccgaatgctgaattatcagcgttatcggttgtatttaattcctcttcggtcttttcaatgtgatttaacactacttctgcatcgataagcttcataaaatcactccattaccttttggaatagcttggatagcgcctttcaacaaggcttgaatcgaagaggtatcaaagaagtcctcagaagcctctaggagagcttctaaaacgtctttggtataattgtgaggcaaggtgttaataggcgttacagagcttcctgtaaaggattctgctacaatgtttccatcaatagctaatttaataggctctggtgcagcctcttccttagctaccgataaagctgctttaatttcgtccatacaagtttctacagcgtcctgataaccctcatcgtaatcatcttctgggtattccaatttgtttttcatagtggttaataaagcttctccatcgattagtttcattaagcttcctccttaacagtttcaataaaggccttcaaacgaggtgggtggaatccactaatagctgtgtcgaagtcttcgtccaacatcaccactggaaagcttcggaaacccgctaatctaagcatctccacagtctctgtatcattgcggacgtccacaaacacttcatcaaagcttactccgccttctgtaagcactcgtttagccatcttgcaggcttggcacatgtctttagtatatactttaatacggttcattcccattcctccatgctttcaataatctcttcaagctcttctacacgttctgaaagcgtgtcaacttcttctgtaagctctgccacagtttcttcaaggctatatacttcgtcttgcaagtcagagttctccgattcaaggtcttctacgtcttgttcaaggctataaatctcctcgttcaagtcttcgttttcccatacaacactagtaaggcgctcttctgcatactctaattcctgttcagcaatcagcttatcccaattggaatccaccaaggcattttgaagctttcctacaagctcaattaaagctgtttcatgttgcgttaatgtaggctttgcacaagcctcttttaattctttctcaaaaggtaggttactcatactaaaactatccaatctcgttttgtttaaactcttcaacaggaattgctaatggtgcatagtgaggtgaagtcttcttaatttcatctagcgtcattgaacctttttcaattacttcatatggcgattgagtaactgctatactagctgtaagagtagtcaagtaagtatatccacaaggcgtaccacttccacgcccactaggaaggactagtacatactttttctctgcttcgttagccatgatttgtaaagagtccgcaaggtctcgtgccgctctaggggtaagggtcattgaagcacatatagtagaaagatatatctcaccatgctccttactgacaattaattcaatatctggttgaaaggctcgtttgactgtaagtgactgcattatactttctcctcccacttcttatcttccttagccaagtatcgcttagcatcggtaaacagttctgaaagtacatctaaagaattagtaaggttatcgatggcttcagtaacttcatctacagcagcctcgaactcagattcggtgacgtcagaaacctttgcaccaagcattcctgtcaggttgtagacagtcgtttcgacatttgcttggtctccttctaaatacccattctctaaaaagttatagtaataatctaattcaatgccttccactattccttacctccagactccaactcttcagtaatcttctgctgctttctaatggttcctaagtattccgtaagctgcttttcgtcttcctctgcttcgtcagaaacgatattctcaataagctcatggtactcttgaaccttttgggaaagcttttcaatatcttctgcatactggttagcgattaattcatgagccttctttgaaaagctattattaagctcgaagtctgcggccgcttttcgtactgtaccaagcttctctaaatactgctgataactcttgatggagtacatcttaattgccctcatctgtattcctccttaaatgcctgtgtaaggcgttctaatgtgttcagggataattaccctagaagctactcaaaagctctcagagagcttcctgtggcttttaaggtatgctttagcgcctgtttgtcttttacataaataactataacacggttgcattaaaatgtcaagcactttttcataataaattaaaaatgtgacaaaaagagctagataaggtctaatctaagaggctcttaaatgagcttgaataaatactccagaaaggaggaagcacttatggtaagaattggaaacagagagttggaagaacgtcaacgcaagtatttaactacttctaaggagccagacgaatacgagggagttgacttaactacattaaaacctaaaatgaaacgctttgcgagacattatatgcaaactatgaatatcgctgaaagctgccgttccgtaggctataatgaaagctcaggttatcgtgtgttaaaacgtgaggatgtgaaagcttatttacaatggcttgtttcagagaatgctgacgcagctattatgagtccaacacaggtattagaagagctaactaatatcgctttacgaaacagctctgattacacggttactgtaaaaggagatgtcgtagagaaacctattgatacaagcgttcaattaagcgcactaaatagcttggctaaattccatgacttattagcccctgatgtcaaggtagaacagtctcttaatatcgtggtagacattgctgacgacgttccaaatgaagctgaagaggttgaggaagaagagtttgtagaaggagactttaccgaagttgaagaagaggatagtgacgtaagttatgacttcctttctggattttaaggaaggagataccaatgccatttgaagagggtaacttagaggttatcgtcaacgaccttattaaagacgttaacactcatgccaaccagattgcttctattcagtcagacttaaacagaatgacaacagacatttcaagcgttcgtgacttgcttatcaaaaacactgagcgttcggacgttctaatcggccacatcaaaggccagtctgacgaaatgcttaaactacttactgaggagcgccgtagacaaacggaaagctacctagctgacgaagcttcagaccgcaagaataaagagtttagtcaaaagcagatgtgggctgtggccactgctcttgtcacaggagtagggtcagctttagtgaccattgttaagctaatcatgagctaattgaaaggaggtgcattaatggacgtagtaatttctatcgcagttgttttaggtggcgttaccacaggcttagttaacttagttaagtctatggatgtagtctctcctaaatacttaccactagtttctctagctatcggaatggtgtttgggttagctatgtcaccacttcttggaatcacattatacgtaggtgctattagcggacttgtagcagggctttccgcaatgggattctacgagttgacaaagactccagcagaataaccttcacatggccttgagggagtttccttgaggcctttacataattttaaggaggacacacaatggctgaaccaataaaattaaccataaccaaaagaacatttaacgaagcctatttaccttacatgtacgaccagcctgaaggacagcatcggacaatggtattctatggaggcgctgggtcaggtaagtctaagttcgtagtacagaacgctattctaaaaggcttatcagaacgccgtaagttccttgttcttcggaaggttgacaacactatccgtgactccatcttccaagagttcttagtctgcttagaggaatggaaccttctcgacttctgtgaggttaaggcttcgtatatgacaatcaagctgcctaataaaacagagttcatcttcaaaggattagaagaccccgagcgaatcaagtctatccaaggtcttacagacatcattatggaggaagcaactgagtttacccgagaggattacgaccaacttcaaacacgtttacggcatcctacagcacggcatcaacaagtgtttgtaatgtataaccctgcctctaaagacaactgggtttaccaatacttccacaaccctgccactaagcgtcctaaaggctctaaggtaatctgtacaacatacaaggataatagattccttcctaaagcttacctagaccatttacaagacttgaagaacactaacccagtctattacgaaatctatgccttaggtaagttcgcaagcttaggtaaacgcatttacacaaactggaagatagactctgagttcaagcctaaccaactagttaaacaaggctatgagcctcgctttggactcgactttgggtttactaacgaccctaccgtaatcctttccacattagtatctgaagcagaccatgtaatttatatatttgatgagtttgttaaaactggtatgatagctcctgagatattcgatgtgattaaacgtaagaagcttaccaaccagcttatctatgctgactctgctaaccttgaaaccatcgagcagattaaacgcttaggggcacgcaagattaagcctgttaagaaaggccgtaacacagtccttcatggaatccaatatctacaaggctatacaatctacgttcatcctcgctgtgttcacacgattaaagagcttgagaactatgagtggaaacctgctaaaggctctgacgactacgagaacaagcctaagcaaaacggctttgaccactgtatggatgccttacgatatgctgtcaacgacctcattccacgtaacagaataagaaccattaacaagtcagtactaggcctataagacgtctagtatctgtcttgggtacaagtatcagcgaaaaatataaggaggattctatatggcaatcccaaacggacaaattaacgctggtgatataatcactactaacatccgacgtaaacatttcattagacgcaactacgatattcgagaattagtaacccttgctgaaatgcactctcgttcttcaagcgcctatggagtattgtacgactattacaaaggcaatcacattgctatccaatcacgtactttcgacgacactaacaaacctaactctaaaatcgttcataacttccctaaactattggtagacacttccacagcttacttggctggtgaaccaattacggaatcaggcgatgagaaaactatcaaagccatgcaaccagttatgaaagagaactatgtaacagacgttaactcagaggaaattaagctctcaggaatcttcggacactgtttcgaaatccattggattgaccgtaacaacaagcatcgcttcaaagctgtttctccaatgaactgtttaattgcttactcagcagaccttgacgaagagccattagcagccatctattacaatactgttatcagtgatattacaggacacgtaattagaacttatgagatttacactgaggataagattcttaaattctctaccgacgacgagagagacgtctacaaagagattccagaagtgttggacattagaggttatgaagaacatcctaacctacttaaaaagttccctgtattagaaatcattgctaacgaagaacgcttaggtgactttgaagctcaactatctttaatcgatgcttacaacctagctgtttctgacagcgttaatgatattgcttattggaatgacgcttacttgtggctacaaggatttgaccttagcgcagacagcgattcaattagcaacatgaagaatgacagagtaattgtaacagacgatactggtaatgtcaagttcattacgaaagatgttaacgacaagcatatcgagaacattaagaaccgtgctaagctagacatcttcagcctatcacaaacacctgacttggtttctaaagacttcaccgcagcttcaggacaagctttgaaagcagctacacaaccgcttgagaataaatcagctgttaaagaatctaagttccgcaaagtattagctaagcgttatgaacttatctgtagctaccttgagttaatgagtaaagagaaagacttgaaaccaaatgaagtaacacctgtctttgtacgcaacttaccacaatcttatgcagagttagctgacatggctgttaaacttcgtgacatgcttcctgacgaaactatcattaatcagttcccatggattactgacgctcgactagaagtagagaaagcggatgaacaacgtcagaaacgagctgacatcgccttgcagaacttcaaacagactagtgctgtacagggagcctcaacggcagctgctaataagctagataagaaccctgctaacacatctactatcacaactactgacccagtggctgcgaaggaacaagagaaagctatccaaaagaaacctaagactgactaggaggaataacaatggcacgcaagaaggataaagagaaacgtcaacaggaaattgaagacgccttagttgctctcatgatcgctcagaaccacaagtaccatagattcactgaccgcttcactgtccttcttgatggctttgttaatgagcttatagtaaacctagctgaccctaagttggatgcttttgcaatccttcaggtgagtcagtatgaggctatcagaaagcttcaagcagcattgatagactatcaagaagagttcagggagatgcttttagagagcatgtcagacaccttagaagagaccttgggacagctttttacaaataaggctataccttcagcgacagataatgcctacatcgaacaagttattgcagaggcttacgactactttgaagaaatcttcttgcaattattagtagagattgaggccatcgctgttggaactattccatcaacagaggacatcgtaaccactatccaaaagcttcgagatagattgtcctatacactacgtcgacacattgaagctcaaatgtcggcagtaattaacctcgctgttatcgaagcttctaaacagcatgagattgaattatggaaatggtgcatccgtccagagcttactgaaagcggtacttgtgcagattgccgagagcttgctgaaggaggtattggtaatgagggtctatataccctagccaccatgcctttgctacctagacatccacactgtgtttgcatcctaattccatacgtcttatagagcggtaatgttaaagggcgctcaagaggaaaagaactttacacaaactaatctaaacgcacgcacagggcttaattgaactgtggagggcagaaggagaatcttatattatgaatccagaagaacaaggacaaggacaacaagttgatttgacaccagaggttatcgttggagctattgaatctaatccagaattagcacaagctatccaacctcacgtcttaacgaaagacgcagtatctagtttcttaaagacagacgaaggtcttggcgtagtagcccctatgattgaccaaagcgtttctaaaggcattaacgcttggaaagaaaagaacttagagaatatcgttcaagagcgattggctgagttaaaccctgctgaaacacctgagcaaaagcaattaaaacaaatgcaagctcaaatggcagctattcaaaaagataagcaaatgttggaaatgcgtggagtagctcaagaagctttagcaaaagctggtttgcctgcctcattagctgggtacgttttatcagacaatcccgaagccgttaagcacaaggtttcagaattagatattgaaatccagaatatcgtttcaggactagttgaccagaaggttgctggaatcgcagctaaagcagctccaacaaactcagacgacatgtcaaacattggcggttctaaaactgtagaacggttaacagatttaactgttgaagaagcgacagaacttgctcgaactaaccctgctaaatatcgccagttggttcaacgtggataacaacagataatcatataaactataaactattagaggagactattaaatatggcacacgaagtaactaaaatttcagacttaattaatcccgaggtaattggtgcgttccttcaccagaaaatgttagacaacttagtattggctccatttgcagaaattgaccgtacattacaaggacgtccgggtgacactttaacagtaccacaatggaacttcattggattagcggaagacttagctgaaggtgcagaattacaatcagttaaattaactgctgctgaacgtacagcgactgttaaaaaagttgctaaatcagttacattaactgatgaagctgttttaaatgcttatgttcgtcctgttgatgaaacagttcgtcaattagcaatggctatcgcaggtaaaattgacaacgacttgtttgcagctatgcgtgcattaactccgtcagatgttgaaatgactgatagctacgagtgggttattgatgctcaagtagcatttggcgaagagtttgatgaagaaacttacttattcatctcacctaaacgccgtgcaacaattttgaaatctaaagacttcattcacattcaacaaggcgtgtctgtaatcaaaggccacttaggtgaaatctacggaatgaacattgtagtttctaacaaggttggtgaagacgaagcgttcgtattaaaacgtggagctttatcattaattatgaaacgtgactacatggttgaagaagtgcgtgaaggtatgaaacgtcaaactaacatcactgctgaccaacactacgtagcattcgttaaagatgctaaacgtgcaatcttcatcaacaaggtagctgcgggaaagtagcagcccccaagaatcttcaatctagcggggttactgaggactcagttactctgacttgggaagacggaggggcaagcctctagtaagctaaacgagaggttgcggaaacgttccgtgacctcttttactttatcataaatcaggaggaaaagcaatggcaaagacttataatatttaccaagatggagcgaaggttcaggaaggcattgcagagttaactaaaaccattacaggccttacgccaaacacttcatacaagtttgaggtaacagctgttgaggacggcgtggagagtgctaagtccacagcggtaacagccaaaacaaacccgcgtaaagtagctacagtaacagcttctcaaaagactatgtctctagcttctgacggaagcaaagcattgactttcacagtggctccagaagatgctactaacaaagaattagaaatcactaacagcaaccctgagtttgctacttatgcagacggtacagtaacagctgttgcagaaggcactacaactatcacagcaactgctaaagatggttcaggcgctactgcaaactgtgttgtaactgttcaggcaccagcttaataaactatcccaaggaggctgaggcgaatcgccttggtcttcttttaaggaggaagctaaatggaactaattgagaacacggagttgttcaagtcgtttgaagacgttaccctaccacctgaaacagaagctattgacatcaccgacttaaagcttatgcttggctatggtaacagcactatccgagacaacgttctgaaggttttgaagaagcgtgctagacaacatatatgcttattcattaacaaggaagttacagcctttccgatggagttggattacattgctgacgagcttaccgcagggcgtatgtcacagcttaactcagaaggccttaaaacagagtctactgacatcactcgttacgactataaagatgacatctacgcaaactggtatgccattcttaaccgctggctaaaacagcaaggagagtatcgcaacaaggcattattcatgctttaagaaaggagcttacaaatgcgttataacgacattgtggatttaatccaatttaatgattgggacgaccctgacgacgactacggaacaatctcttataagactcgtggaacaatcgttgttaaagaccttcctgtaagtgtaggctccctacgagttcaaggaaagctattgcaaaaccaagaccaacagtgggagaaacgctacttgatacagcataaagtattcgagttaaagaaccttcgggtagacgctgtccgacgccactccacaggagagattctaaatgtctattgggataacactactggaacagaccagacagtttcttataaggttgagtacagagacatccgaagagacaaggaggacggagttatatggcagggttcttagaaataactaaacgaatcgatttcgcaggcttagagagagagtttgttaatgaggtgaaaggcgttgttgaaaagaactccgcacagatggctacagctgttagatttaatatcgttcgtagaggcaacgtagacacaggaacttactacgatggaataaagtctaagacggaagtagaagggaagggtaaaagcgttacaggaattgtagagtcagacgtttcaggaaacccttatggacacagaggttacgctgtttacctagaggaaggaacttaccgacatcaagcattccctaactttacagacgctttagaagagtattctgatattcttgtcgagcagcttagcagaatcaaagtgtaggaggaattatcaatgagcaatagaccacctttccgtgcaagaagttcctctgtagctttgcaaagggctatcgtaaaggaaattagagcgcaaggaatcaatgtctgggacggtactaataagtttccagaatatccattcattaagattggtgaggagctaacttcaggtagaacaatctctaaggatgctatcgggaagatgcacaacctaacccttcacatatggagtgactacgacagctcttttgaagttaagagtctaaccgactttcttgtagacttacttaccaactctcctcttaacttagaggacggcttctgtattggagagaaatccctcgaccacgttcgttacacagaagctgcaaacggaacttataaaaacgagcgtgcatatctattcttagacttcgaggtaatcgactctacgatagagccataataacacacataaaggagactgacaaatggaagcatgtaaatctagctacattcgtggtacagcagtattaattgaggttcagaatgaccttggcgaatggattaaagtagcagcacaacgaggaggtacattaaaccgtacagcagcaaccttagacgtatctaacaaagaaggattcggatgggacgatgcagaagcaggtaacaagtcttggtcaattgactgtgacggattgttcgtagaggataacgctggtttccaagcattgaacgcagcttgggttaacggagattgtgtacgtgttcgtgttaaattccctagtggattaacttatgtaggacaagcaatcttaactgacttcccttacgagtttggttacgaagatgccgtgacttactcattaacattccaaggtaaaggcgctttagaagagcaacaagtagctcctacaatcttacctaagaaagttgagttcacgaacgaaactaaggaagttaaagttggagaaactcttcaagctacaattaaattcactcctgaaaatgtttctgacaaatcagtaacttacactgccttgactccagctttagcaacaattgatgaatctggtttaatcacaggcgttaaagaaggtactgcatcattcaacgttcgctcaaatgtcaacacagctgtttcagcattgattgatattgaggtaaagcccgcggggtagtagaagccccgaccgagctttcggcaagtagcgttagcgaagactcagtaacattaacttggaaatagactgcacagagggggcttgggataaattcccttgccctctttttacataacaaatataaaggagattacaacatgattataagattccaaggcaaagaccttaacctacgcttaacatacaagtctattcactttctggagttagcctttgaccaagactacgcttctttcatcgctgagcaaacgcctttcaaccagtccttatatatcttctgggcaatgcttcagaacgagtctgattacgaaggagtatccgtactagatgtagcagagcttctacaagactctctggatagctatgagtttaccttagaagaatacttcgagaaagttaacagctcgtatgcttcaagtattttagttaaacagctattcaaaaacaacacaagctcattacccagaggaggcggaagacgaggacgagcttccgaagctagacgtaagatactttatggtattgtgtacagacttaggaataccttccagcgacttttggacaagtacaccatatgagtttaatggaatgttacgaggagcttaccaaagacaatcaagagaagcttcgttattcctttctctagtgcaatctaagaagcctgtcaaattagagaagtaccaaggctttgaattagttaacgaaaccaacaaacctaagactactagagacatggcggaaacaatggatgaacttgatagagcagcctttaaagaggaagagctatctaacctgttcgactactttgactaggaggaaatttaaatggcagataaggaaatgcgaattaaggttagggtagacaactctgactacacaagtaaaatgaaagatatggagggcactcaatcacgcttagggaaaagcactgagcagactacaggaatcttcggtaagttcttcaacaagttaactggtggtgcgagcttagctaacagctctatgctaggacttggtaaaagctttctatcaaccagtgttggattcggtactctgacagctgctgctacacctatggccgctgctgttatgggagccgctgaagctactaaagttgcaggacgctttgcgatggattccatcaaggactatgctaactttgaaggaacacttaaacaagtacagattattgcaggtggtactcaagccgacatggacatgctcggtgacacagctatcgaaattggtggtaagacttctaaaggtgctcaagaagttgctgaggccatggtggactttgctaagctaggttttacagctaaggaaacttcagaggccatgaaaggtatcgtatacgctgccgaagcttctggctcaggtgtacaagagactgctggaatcgtagcaacagcgcttaacgtatggaatctggaagcctctaaggcagaacacgttgccgacgttttagctaagaccgctaacgaaacggctgctgacatgcaggacatgggatacgttctacaatacgctggttcatcagcttccctagcaggagcttctctggaagacctttcagctatggcaggtatcatggccgacaatggtattaaaggttctaaagctggtacatcacttcgtacagcattcacaaaccttatcaatccaacagacggtgcggccgctgcgatggaaagcttaggggtacagtttaaagatgctgaaggtaaggctcgtcctacaatggatgttatctatgacttacaagatgctgttaaaggtatggatgatattcaaatccaagagctttcaacaatcctgttcggaaagcccggggcggctggtatgtcgttcgtccttaaatctactaaagagcaagtacaagacttatcaaaagcattagtagactctacaggtacagctgctaaacaggctgctgctatgcgtgagactatggcaggtcaattagaccaactaggagactctgtggacgccatcaaattaaaaattggtagagcgtttaccgacatgtttgcactagacgctgttaaaggattcaacaaggctcttgatggagttgatgaaggcttatcaaactttggtaaaggcttcaagcgtacaagcgatttactagaaacttctaatggattaatctctggtactaaggatgccaacaagtttgttgaagctgttcgagatgcaggtactaatcttacaaacattcctttccaagagtctttagcacagtctcaagtatggggaatcggaatctctaaaagagcttatgaaactaacgaggttatgtatcagcttaacaaaagcattcaagagttcagcttcctaccagatgactgggaaggcaagtggggacaggcttcaacaatccttaaagactcagtaggtcaaatggagttgaaacttgcttcagcagcggctaaaggtaagcatggtggagaagccgatatttcaggtattatgaaccagactatccaagagaatctacctgccttgcaagaagctttaaatgagcaagtagcagttttcgggacagctaaccaaagccgtttagatgccttgcagacattcttcactaacgagaagactttaactgacgagcagaaatctattatgatgcaaggtgaactaactcacggccaacagctttccgataccattcaaacaaataacaacaagattttagaattgtatcaaagcatgggtcaacaggattatgcacagcgtcaagagactggtgccgctataaatgcattgcaacaacagaactctgaaatcctgcaaaacatcgctacaactgagtcaagtagtattattgaaacactgaaagcacaggctagtagcactggaacaatcactcaacaaatggccaatgattctattacagccgctaatcaacaatattctgaaactgtagcagcagcctctaaacagtatgttgaaactgttagttcaattaaccatatgtcagatgaatctatagctgccgctggaacaactagggacgagcttatcgaaaaagcacgccaacaaatggttggaacagtagaccatgctaagactcagaaagagcagacagtagaagaaatcgagaagattgctaaaaagtctgaggaagttgatgggacacacattcaaataaacgctgacgcagatacttctaacgcaatggaagagctcggacaattagctgctagaattaacgacgtgtttagagcctttggagaaactgcgggtaagattcaaggcggtattgatggctttgaaagcaagcttagacaagcggataaatgggttgcaggaaaggttggcggaatcttcaaggctcgtggaggacttacttcaggcgttggttacggaattggtggaggcaatgcacaatactctccaatggctaccgcagtaggtgtcggaacccagctaggacagggcggtattaatcagggcgtaatccataacgaacgaggaagagaagttacaatgcctattcaaaacgctacttacatgagacctttcgcagcagctgtggcaaacgagctgcaagcaatgggtgaaggacttggtggaggaagcattcctgaagttatcgtgccattgtacatcaacgataaagagtttgcgagagctactaacaaagctatgacagaggaacagcaacgtgttaaacggattgctaaccgagctgtcggtaaaaagtaaaggagacgtttaaatgacctgttctaataaacctaattatacaccttttaaattacaaggtctagcccccactaagcagtggggattaggccgttctgcaagttatgaacgatttaacccaagcgagttccatgcgctagaggacgaagttaagattacatttccagtagactttagaggaaaggttaaaggaagcaatacacctaacccttcacgaggatttagccacgctagtcaaatctatcgtgagaacgtgttaagaggtagccaattcctttctaagccttctttgctttttaatggagctgtatacaatgagaagacagtctacaatggagctatggttgcttctactcaagaagttaatcaaggcttgatgttctattgggaagactttatcaatcctgacccaagaattaaagaaggggatatggtaaccttctcagttgatgtacgaagcactggggaagatattccgacaggggctgtggccttcaaagggacttctaactttgaggaatactataaagtccttgaacagcctatcacaaaagagtttacaagagtatcttttactacacgattcttgtctaaggactgggaatgggacgaggcttttggaatgttctggggagtagagaatgttcctgttacagactatccaatgttccaatatgacaaggataagttagttggttttattcaggctcaagaaagtgttcaactagagttctcacggcctatggtttcaactatcggaaagactgcttacattgagtctggggacgacatgttctctaacaacaaatgggactggtctaaagccgtatctaaaggccgtttaaatgaatttgatggtaagtataacacaaacggaatcaaacaagactgggcaatgcctgagttcattcctattttcaaaggctctgagagaatccacttctacaaaaagactaccttaacggaaacaactgacgctggacatggctatggtaaaatcctattctacagcgctgctaacgaggattcttacatgaacgtatataagaagttccctcacgaggctggtgtatatggtggatacgcagctgaagtagaagtgcctatcggagctactcactaccgtgttcatataacttcagaaagaggaaaggccactacagaagcctatgtacaatcttctgctaacgactggtcagagtttagtcaagagtggtacgacggactgtcaggaaagctagatggaaagactgccagagctgagacattctatcgtaaagaaatggttgagatggagtttgagctacactttgcagaagctgtacagaaagctttaccagacatctttaaaggccttactactgacgctgagaagcagcaaagacttcgtgacattgcttatcaattcgattcaacaatgattgcacgaggccgtggccaaggcaataacttagctgattggattttctatagatgggctcctgacggctctattgaagagcagacaatgaaacagtttagaggtgagggattaacttcagttacccatccatcaagctatcaagagtggattaatccacaaggtaggattgtaacatctcttcgctctaaccgaatcattcctaactcaatgtacatgggaactgatacgctaagcggtaagtatgaccctaaattaacaacgcttcagctagaagttaatggggagcttgttgataagaaggctaccttagataagacctcagaggtatttacatttacaggtcttaaaggattcttaaagcctgaagataaagttaggattgctggatggattaatcgtaacaaccaatggtcaatcacctactctaatgttcttatgggaaacactcccgaaaacgttgctgagtttaacgaacgagctttcgtcgaagctgattacctagttacaaacatgtctattatcgtaactcaatcacagatggatgaatggggatttaaccctaatctaccagactaccgaattgaatcattagaacgtccagcaagtcgtactgaggagtatatgattaactcaatggtacaggtaacacatgcttatgacatctacggttttgttgaaagtaactaccctgagtttttcggtgactgttacacgttcgatgatagaataagaaagattaatgaacgcatcaagcagtttaacttagtggctactacttattcagaagagccttgggaagcaggtaatcctacaatcttcattagtgcggaagctaataatcccgacagagactacgatgttaaagcagagataaaccaaacagttgaactacaaattaacaattctaagggacactttatccatcctaatggttatatatacgtgggatttgcaagaatgcctagaagcgaccgtgagactggaatatccgttgactctgagttaagctttgagttcacgatggatagacagtacgacagccttccaagagtattccgctacaactaccagaaacagccttggttcttgtttgtaagaaacattaacagaagtgttcttgcgcctaaagtaaacactctaactcctattaacggaggcactagacgttataactttggagctacagaagacgctcggtatatctcaatggactgcttcatcaaagctcctgcggaagaggttatgcctaagttgatggaagagcttgctgacttcctagacgttggggaaacggtaatccaattctctgataacaaagaccgttattacaaggttatgttagatggctcgacagacctttctcaaacgcttcatgtaggaacgttgacgctgactttcgtactgcttgagaatacagccatcggtgaagaggttgtagaaagctttgacatagacagtacaactggttcagttccattcatcgagcttgagaacatgggtacggcggacgcttaccctacctaccaactgacctttgaagagcctgtaggatatgttgacctaatcggtacagatacctcagccaacgtgtcaattggaagacgtcctaaagatactgaagacgaggttaaggtagaccttcgtccacgtaagttttacagtaagtttacgtctacagatggagctggttggactgccatgaatgacacacagcttcctcaaatcgaaggataccaaactaagcttcagggaactgttcaaagagttaacggaatggccaatcaaaacaagtggaattacggagacactagccacagaggatggcacggagctggtatcgtagctaaccttcaaaagaaccttgacgacttctatatggaagcctctatcgtagctacaggaaagccagttaaaacttctgctaatgctattttcttgatattctatgacgaaaacaacaacccatatgcttacactaaggttggtacacggcctcaagagggtaacttagacagctacgtagcttacgcaggtgactggggtaaacgtaaagtagttaacaatggagctaagtggaaagacttctggggtaaggtttctgtacagcgcagagataaccgatggagacttattgtaggtaaatacaaagaccgtagatacagtccttcacctgaagcttcattcaactttggtcagaacatgttgaaagacacaagagacacaggatggttcgacttgcctcctgaaacttggggtaagaagtttgcaagggttgggatattcttcggacagtattcacatagacctaagctaggccacttatcagtacgtagactaattgtgtgggaaaaccttgaggagtatggagaaactcctttagaaggaactccaatcatgttccatgaaggtgacacagttgtaattgactcaagcaaagctcaaacataccttaacggagagcttactccatcacttgtagaccctatgaccgactggttcccaattaccaaaggtgataactacattggagtaaacaacttcaaaggcaagattgacatagtatataacgaacgatttaaataaggaggaaaaagtatgattacagtattaaacgcaaacggacaaacagtagcacactttgtcaacaacgttagcgaaggagtaccatactttgagcctactttgacggagaacatagagacgttggtatcaacgttctctttctctgttcctttagactgtgacgaaagccagtatttaaaaggcttgaataaagtattagtaaaggataaggacggagatttaagacagtttaacatcatccacactgaagaagttttccaagaggttaactcacgtatcttagtggaatgtgaagacttctcaattagtgagatgaacgatactgtaatctatcctttcaatgggcataatttaggagacaccttaacaaaagccgtaaagggtactggatggggagttgagtattcggcagacacttggcaagaaggagaagagcctttcatactagctgagtatacgaacatgcgagaagtgtttggaaacattcagaagacgtatgacgtagactttaaatttacagctgagagaacagccttcaaccaaactaaacggattgtcaaagtgtataaaaacagaggtcttcaaacaggccgttacttcacctatgacagagacgttctaggaatcactcgtgacgtgcagtatgatacaatcaaaacagccatcctcccttactacacaggagtcgatggaaaagtatggacgcttaaaggaatggttccagttaaccctatcgaaggcattaccaaagataaggaaagccctttggtagtccacaatcaagctcatgcagactatgacgaacctttcttcttcaaagcaatgcctttcaaagctgcatcaacaaaccctgagcaagtatatcgacaaggtgtagaagagcttttaaaacacattgcaccaatctatacttacactgttaatgtaatccttctaaatcgtgtccaaggatgggaaggggaaaccttagcacttggcgataccgtttggatgaaagagcgtgtaggctctcgtgaaattggattggaagcacgtgttattgaatacatttatcacgaagacgacccaagccttgatgaagtaacctttacaaacttccgtgaaatagacacttacgacacctctgacattgcaggtatccgagacgctttgaacgaccttaaagaccaagtaggctctaacacagttattattgaaagcactagagaacaaatcagtaagcttgaagaaggtcaggcaggaatcataacagaccttaaaggaaagaactccataagcattggagacacacctaagccaaatcctattgacggcgatacatggttctctacacgtgttaacgaagctggtcaaacaatccatgagattaaagtttgggatggtgttgagaaagtatggaagctttcaatggatactgagaaagcattccaagcagaggaagctgctcaagctgctaagaaagacgctgaggaatctcttgataaggctaaccaagctgtagctgatgctgacactgctaagacggctgctcaagaagctttagatagatacaataagcttatgataagcggacgtaaccttgcgctaaactctcaaaagattactattccagacacagatggagctactagcataaaccgtcgcaaaagcattccgttatcaattaaattaaagcctaatacacaatacttgctaaggtttaaatacgaactagaatcaggaactcttcctgaggatattacagtggtcttgtggcacggctctggatttgcctctaacatagtccatgttccaactaaagcaaataatgttggggaaggttcagcaacctttactacaaactctagcgaagctaatatattgtttatgtaccaaggtaaacgacttgaagttaagcaaggagataactttgattttacagaagtctaccttgtagaaggtgataagataggcgactggcaaccagctccagaagacgctattgcaagcattacaaacatcaatggtgaaatcacttccctagtaactaagacagatggattggaaacaagctatagccaaatctcacaaacggttgatgaaatccaattaacggttggtgacaaagccgataagagtcaaatcacacagcttcaagaccagattaacttacgtgttgagaaagacgatgtaatcaaccagattaacgtttctacagaaggcattatcattgatggtgcaaaggttcagataacaggtaagacttacattgaggacgctgttatcacagacgctatggtagctgacctttcagcaagtaagcttacagcaggagttatcgacgcctctaaaataaatgtaacgaatatcgatgccagcaacattaaagctggtactatccaaggtattgacataatcggttctaagattactaaccctttctcaattggttctgaaggctatacgctagtcggtcagacagtaatggaaagagctcaggttaaaatcgattataccgtatctgaaactggtcaaaaaggttggtcaatacttcatgcaagaggtattcaaaatcagctgcttaaccaagacggtaccattaactcattttcatctcttgcttcagacggattatctattcaagattctttaggaaatagaggttacttatcagccgagttgctaatgcagttctctaacactggcaagaagatttaccccggaaattcatgggtaactaacactgatagaattgtaccatcattgacaatgaacaaatgcgctattggatggctgttcttatggcaaccttacgatactactggcggtaagccttatacatgggactatacttactatttagttcctaaagctcatgctaactttaacaatggtaaaggtattaatatgcggctacaaggcgcaggtaaaggtggaggagcagatgatactgtgtataaatatgtatacgtatctaatgactctataacaggaacggccaataatggtactgggaatggagctagatgggttcttaccagtgtattttcagtttaaaggagggattattgtgagagtttggattgaggataagataggattcttaacaggctacactacagagcctatggaaggttacaagtgtgtggagattgacccttcagagtctttagaaatgcttggtggaatgcttgatttccacaactactactatgatggtgagaaagtatacagagacactaacaatgacttccagaagttcttagaagaggaagctaacaagcctcctgaaccttctaaggaagagatggcagaaagacttgctaagttagaagcacttttagcagacttgctataaagctttgggtgggttgtgggaataatattagaaaggagattcatacatggttaaagtaaacgatgtagtaagctatgtcaacggacttgtcggcaaaggtgtagacgctgacggatggtatggtactcaatgtatggacttgacagtagacgttatgcaacgcttcttcggatggcgtccgtatggtaatgcgattgccttggttgaccagcctattccagcaggcttccaaagaatccgtaccacaagctctacacaaatcaaagctggtgacgttatgatatggggcttaggatactatgctcaatatggtcacacagctatcgcaacggaggatggaagagctgacggaacctttgtcagtgtcgaccagaactggaataacccaagccttgaagtaggcagtccagcagctcctattcatcacaatatggatggtgtatggggctgcatcagacctccttacgaagctgaatcaaagcctaaaccacctgcaccaaaacctgataaaccaaatctaggacaatacaaaggagacgatgatattatgttcatctattacaagaagactaaatctaatactaccgaacagtggttcgtaatcggaggtaaacgtatctacttaccaacaatgacgtatgttaaagaggcgcaagatttaatcaagcgctatggtggaaacactaatgtaacaacctataactatgataactttggattggcaatgatggagaaagcttacccacaagttaagttataagcctataagaaaagccccttggaaggttactccaaagggctttttatattacaactcaaagcattctttaagcttttctaaagctactctataagctatcctcatgcctttacccatatctgactcctcgtcagcaaggtaatttaatctcctatccaagtctaagacaacctcggccaccttctccttgttaatggagtctacagcttgcttatgggaagcttctttaatagcatccacaatgatattgaaagggtctttcggtaagctgcttccaagggttatcttagaacagtcgtcagtatctcttagataaacttttggtacatctagctttatgaagttatcattacggtagtttaaaataggtcaacaacctcctctaaggtatattcagtctgtggagtggcttcgtcagcagccttctgttcagctttctctaaagctacactcatgaagcgttccatgtaaagtagtcgagcctgactgtaagaaagcgttgggtacctcatattgcttcggtagtctgcaacagccatctctaagaatatgcgcaaagcggtgtttccaaatctttccatatccttcttcataatagctcttagagtctgtagtgaagcattaataggagccttaccaaacttctgcttattaaggtgttctacataggctaggaatgtagttgtattccaaagactttcatcaactttccaccaatcctttgtatcaaccttgttcccctcggcgtctttataaagcttgttctctttggttctaatccatgccatcttaaatgccctcctcgtgctcgtctaaatacttccaaacgaatcccttatgcttacctcttcctttagtacagcatctactaatatgtgattgctggaatccatctgcacatgcgtctgaagccttattgtatactaccatttccccagttatctcattaaatcctacaacagctcttccctgtcgtttatacaaagttttcataataacctctcccttaactatttgatgaaccaatcatatcacgtattagatggaatgtcaatacctttttaacaactctcacgaaaaagtttcaaaggcgactgaaaggagtctttaggctgtgagggaactttccgaacgcctttatattatatgctatagctatccttaaaccataagaccttacggtctttaagttcaagagcagcttcgttaacactcagctacaacctcctaaagtcggttgtgaaactatttaataagcttctctttctctctctctaaagacaagtataacatattcctaaaaatgtgtcaagtgattttgcacaagaacttttgtggagttgttaattgtaaggttgttgaaacaattgtaacaaaactgtaataataaactttaacaaatgttcaaaaaggcttgacttatactttataatatgctatactaatgaagtagtaaagatgaataaagaacttattaggaggaaattaattatggctaaaggtttagaagcaattgcacaggcagcacaaacgcaatcaaaaggttctggtgagcaatccaaaaagacttaccttaaaaaaggacaaagcattcgtgcgcgcattccagaagacatcttagaaaacttacacgtaaaccaagtcgtttcagtttttgaaccgcaagtgttaccaacattatcataccatgcagaaggacgtacagacgttcgtgacttgtatcatgaagctactgaaatcatgttagcagaccaccgtgctaaagttgaatcaggggaaattgaacgtggttctcaagctgacaaagactcatataaagcagctcgtatcttaactccaaaaccacttatcttattcggtgtaattcctttggcagacttcacacaaggcactaagaaaactaatacttacccagctggtgagccaatcttattggaaactaacttaggccgtgacaacgctaatatcgacgccttaacgaacttcttatcaaaagaaactaacgctaagaaattccctaagaaagccttcgagattacttgtgaggcggctaatcgatacactttcacaccgttagatgatgaagacttaacgcctgaagaattagaagtattcaaagctacagaaggcgctacagtccctgaagaagatttcgagaacgcaatctttgaaagcactattgaacgccaaattgaagacttgaagaaaattggtttcgatacaactcgtttaccaaacttaccaacagctgctccagccgctaacaaaggcgctgacgaagttggtactgtagacccttcaggaatcgatttctaaaaactatacgaggggcttcggcctctctcctattatagggaggacataaagcatgaagaaagacacaccaaaagtgaatccaattaagtttaccgaagaggattacttccgcctgttacagacagtcgttatgacaaacacattcatcggctctctatcagctggcttccaaggtaaagaacgcttagagaagattactaaaatcgctgagaacatgtttgttcttaaccgcttgatggaatctgccgaaagcaacggcgaagactggggcgacgaaatgttgttagactcattatacacggattcagaagtgcttgtaactaagtataaacacttgctgtcagaagaccagttggagtctatcaataactctatcaaaaactttgcagaatcagccgagaaagctcgcaaagaagcctacgaagaaaaggttgcacaagccgaagtaattgactttgaaaaggccaagaagaaacgaggcaagtagccatggatagattagagttcttcacgaaagtaattgcaatgccttttgatatgcaagaggttcccatacatcctttagcaattaccttttcagacacattttaccaagacgactttccattaagtcagctttacgacgaggcaattgcagaaactttgtggaacgcttcttacaaaataatccataatgaaatggccaaggctaagtcggtaaaagtattaattacaatcttcaatccgaacaccttgatggaaggaacgcttgtatatgaagctattccagaagacttgcaagtagctattgacacaggagtcgtagaagacgttgagtgggaatctagtgagtcggtattccaacacgaccttcattacttctttaaaggatactaatggattactcaaagtttaagttaggcgatacagtaatgtatcagggacagctttgtggagcaggtactgttatcaacggcaatacctacactgttgtacagcttaccacaaagcctcgacacgcctttatcatagatgaacatggcaacaagaagcttatccaaatggggttcaacttcgctaaaataaaagaagcttaaaaagtgttcaaaaacgcttgacaaaagcttttaaatatgatatagtattatatgtaaggcggcactactacggtttgtcgtaacatagttcgggatgcttctcggctatagcggtctagggctacagattgctcccgcctgtgggctgctgtaaaaggcagtaaaaataatagcaggagtacccacccttgaggggatgagagggcgtagcagaggcggtgacgactgcctcgttcatgcgttgtaagtgtaatggctgcacaatggtctccaaaaccattagagagggttcgactccttcacaacgtgttcaaataagtcttatggaggtttgtggaatgactactgaaagtatgaaaagtgagaaagcttggaaccgtgccattgtgaaagctgagcaagaagctgctaagaagaagatggagcgccttgctaaaatgcgtgccaaaagtaaacgtaaataactccattaagtaggtaagatggatttcttatctgctattacataagggactaaccaactgcggaggagagttagctactttccaaggccttgccgaaatccctaaccagtcagttagcatagtttaggttaatgcgcaacagtcttcctatagcgcttgtcggaggctgattgagaaaggggttcgaatcccctactggcgccttacatattcccaataagcacttcggatagatgccagaagtgttccatggagggttggctaggggaacgctcaataatcccttgctgtaaagcttattccgtagcgtgctaaaacgactaggagcggagctacatgtgatttataggagggcagtagcagtcctcagctaaaactagctacactcgtgatggaaggcgaggtaagcgccttggccaaaacattacccatggtggagtaatccacttaggagagcgtcgtacgacaaggtgtccagccaccttataaaagggttgaacattaatgcacgctgttaaccaaggcctgtagggaggtcaccaacagcgcattagccaagaagtccagagtagctccctagtgaagtcttctgaagctggagttggctaccagcggccttatattcgggatacagaatgttgtcccctttggataagttctgtgaggcggttcgattccgtccataaggcattggctgtttatcagctcattccaaaaacctctttcataaagaatcacctcctttcgattagagcagcttaacggctgttctttttttgttaaaaaggccttgacaaagttttaaagctatgttatgattaattcatcaaagagatagaggagaggttttatgaacagtttaggaatatctaaggtaaactatgtgtgtagacactatggaggaacggttcttgaagacgaagttgtagagattgtcggagagtggactagcgctctaggagaccatattatggaagtattgccaatggattcagaatccagagatgaaacggttgttatcaaagcttataatatccatcgtatgaatccagaagaagtattgggttatcatttgaacaatcttgaatgtgacttattcgccaatgtagactatggaggagagcttttacagagtagtattcaaagctaatcaatatacttatggagaagatttaccagtatctcatttcacatcagtccgaatgcttagtaaggaggaatattaatggaaaccatgtacacagttatttataagaacgctgtagaaagtgagccagcgcttgagggaggaagcttcttaacggacactcctaaaacagatggattaaagcttatgattttcgggacaagagtatttgaagtggagtttattgaccatgcggagaagaaaatctacgcaactagaattagataaggagtggtaatatgtggaaccagtggacactttactggacggatagtgaaacatcagaggaaggtaacttcaagattcctcggccaaacgctttgtttattggaatgcctattgacattgatgagtacagatacactgtgacagctgtatcaacacctactaaagaggtttggacagaacgtattccattcgattttggccctaaaccaccttgggaacacaacaattaacttttaactggaggtttttaaatgcttgatgagacatggaagccaataaaatattatgaaggattgtatgaggttagtaatttaggtaatgtgagaagcttagatcgagctgttcctcattccaatggaatgtatttaagggcagttaaaggaacaactttgagtttatttgattcaggtagagggtatctaagcgtaagattaagcaaaaatggtaaaaagaggaataagttagtccataggttggttgcagaagcttttatagataatcctctaaacaaacctcaagttaatcacattaacgaagtgaggtgggataacaacgtgaataatttagaatggactacctctaaagaaaataacaaccatggttcaaggactttaaaagcctctaattccacaaaaaagaaaataaaagcaacctcaattgacggattagatgtaagagtatataatggagcaatagaggctgagcagctagatgggttttcttataagcaaatttcgctatgttgtacaggaagacataaaactcataaaggctttaggtgggaatttatataaaggggattttttaaatgcttgatttaatacatttatcaaaggatattaaaatacatgtagacatacaaagctttctaatggagtttgaatgggagcgggctaaatggacggaagaccgtttaatagcagcttcacctttcagggacgacaatcaccctagcttctttgttaattttaataatgactttgcaggaacttggggagactcagggagtggagagtcaggaaatttcatagagttagtttcaagattatatgaaacagattacgaaacagcttttgaaatgctaaaagaacggtactggactagaccttacgaagctcctgcaatatctgttaagctaggcgttaagaaagagaagtcaatctttgacatacctgtccataatccatctccatacctattaggaagaggaatctcagaggagacacagaagctttacagaacctctgaggacgagtataaagtatgtcttccatacattaacggaatgggattagcaacagctttaaaataccgtcggacagactctaaagacttcttctatgaggcaggtaacaatcatttgaaaagcatgttgtttggctatcacgcaatctatgaaaagcttcctaagactgttgttatatgcgaggctgagatagacgctatgacagcttatgatatgggattcgtgggtatttcactaggagctgctaaccttattgaaaaccaagtggaactcattaagaaagttggtctcgacaacatcatcataggcactgataatgacactaaaggaaacttagcggcagaagagattgaccaagccttttggaagactcataaactattccgatacgatatgcctgatggatacgacttaaatcagtattggcaagagtttaaaaaggctcctccaatccgtaagataagcgaacctaaactgcttagaagaaaactctggtgggtacagtaaaataaactttagaaagaggcttgacaaggcctcttttttatgctatcttaaaggagtagtaaggagatgttaaaatgaaattgaagaactataaaaaaccttggacacaagaggacatagattatttagaatggttctaccagaaccctgaagaaggctccatcaaaagcgttgcagagtttttaggaaggactcctgaaagtgttaaaactaagtattatgaattacgtaggcaaggcctgttagaatacccatcaagtattaataagaaatggactgaagaagagcgccaatacgtattagacaactatgggaaaatccctaacaaggaaatggcaagaaagcttggcgtaagcactgccagaatagttcagttaaattggtaccacacccataaaaataaaggcaatgaaggccttgacaaatagttacaagtgtgttacaatagtgaggtagaaatttttaggaggattccaatgagaaaacagacccttttggaaaagcttaaactagttacaggaaagacagataaagagctaaatccaactctttcacatatacatattcaactatgtggaggctctgggacaggtggtaagttcggcgccgctaaagttccatatgactattcagacaacttcttatttaactctcctgcaagagttacccaagagcaaatctacaagcagttagaagtctatgtaggaagcttcaagagagacttcatcaaagatggtaacgtaaaccaagatgaacggccaatcaagaacctatacttatggagtgagaacaaaggcaatgggaaaacttctacagcagctgccctcctaaatgagtatatgttcatgtcttggcaagcttcggtaatccgtaaaacaaacatgaaacaaccgcctgcctacttccttgacgtaaacagtttccaaacgctttacaataagtttactagaaatggaatcgcaaaagacattgcagaaaagacttcacgagagtattacgaaatgatggaactagctgagtcagctcctttagtagtatttgacgaaattggtaatcgaagcgctactgaagctttccgagcagaccttcacgacatcattaacaaacgaatggtaaacaagcttccatcaatctttacaagtaaccatccaattgactacttggaacaggtgtttgatgaacgcttagcagaccgtgtacgtgaacgaactatcgtgtatcatttcgagggcgattcacatagaggaatataggagggattaggatggcttcagtttcagctgagatgttattatcaaaggttataattgaaaacgatgtacaggctttaaatagatatggagtaagcgaggatttattccagtcgcctatccacaaagaagcttacaactacattattaattacagtagggaaaacgatggaaatgctcctgcttaccaaacacttttaagaaaggttcctgagttcgacttccaaagctctgcggaagagtcttatgcaagccttactaagagcttaaagaactctcgattacaagtagctacagctgcttttatcaatgctgatttaggagagttctgggaaaactcagtcaaaaaggacgacccaacagacttcattaatcagactatccatgccttggaaacaatcaaagcagagaacttagttaatggagctaatggacaccgccttgagaaggcctctgaatggtacctacaagagttctacgaccgtaaggaaggtaagtctgtcaagttctggaatagccacttcaagtctctaacagagcttattggtggaggctatcaatcaggaaacctttacacgatattcggtagaagtggtcgaggaaagtctactgtaatgctagttgaagcattagaagcagctatgaatggggctaatgttctttattactgtttagaaatgcctaaatacgagttcacttcaagagcagtaagcttcttatcagctcgtaaagaggttaagaaaagccgtatcaatggctcagattatctagcaggatttaatatttcagacattacaaaggcttcatttgaggacttaaacgaagaacaagatttcgttgactttgttaccaacttaaatgatttcatagaaggttcattcactttaagagcagtagacgacgacgactttgttaaccgctctgttgcccagcttgaacgagatatagtagaaacaggagcagactttgttgtagtagacccaatgtattatatgcactatgagaagaacacttctaaaacagcaggcggagacgcggcagaaacttctaaagcattgagaagacttgcaggccgtacaaagtctgttattatcgctgtaacacaggcggaggaagactccaatgaaaaaggtggagacgaacgcgaactaaacattccaaaacgttccaatgttaagaagacaatggcgttacttgaagacgcttctgtagtattggcttttgatagctgtgatggaagatttgctttggagattgttaaaggccgttcggggcatgaaggagaaagtgtcgaaggtatcttcctaccagtaattggatatgtagaagaatcattattagaagaagtaggaagtgtgtttgatggaatcgaattttagggaggaatttacatgattatttggtctttatttgatagtggtaacggatgttactcccaagtttttagtaaaaaggaaggagtggaaaattatagtataggaatggataaggagaaaggtactagcaagaaccaccttaatttagatttgtcggatttgagtggatactttggtgaatccaagatgataaaaagtcttgagaatttacccaagcctgacgttataatagctagtccaccttgtgaatcatggtcagtagcgagcgcaatggctggaggtaatgcttgttggaatcaccttaaaggagacccattcactatacgaacagccaaggaatatgaaagtgttcaattcaaacatgagaactcgttttataatagaatgaacggcgaacttacagtatttaatctcattaaaattattaaacatttccaacctaaaatttatataattgagaatcccgcttatggaaagatatgggaatacattgataaggtattaggatttgagttggagtatgaaaatttaacatattacaataactacggatttgaaataaagaaacctactaaatttaaatcaaatattaatttgaacctaaaatcagaaaatgttaaagctgacaccaaatttagagaagcttctaggataggtggctcgtacaatgtacggtctaatatacctttatccttagttgaggaaatatacaaacgaatcaaggaggaagccaatgagttattacctatctcaaatgaacaaccttaaagaaaagattcgctacgagaagacttctgttaagcttatccgagaaagcattgagcgtatcggaaagcctacaggagaatattctctaggctacaccgacgcattgaagatggaattactaatccaccagaagatgttagaagacgctcaggaagagttattgaagcttgagaaagagcgtaataaataacaatagtgttcaaaggggcttgacaaaagcccttttttgtgttatactagtcaggtaggaaggagctaaacaatgaccgtaactaatgaactttggaaacctttgatattcaagggaatccactcagacatttacgaggttagttcagaaggtttagtaaaaaacaagttgactaataggttattaaagccccaagactctggctatttacatgttagaatacctcttgacggcaagtattataacgctagaatccatcgaattgtcgcagagaccttttgcgaaaggcctgtgggatgtaatgtggtaaatcacatcaacggcaataagaaggataatcgagcagccaatcttgaatggattactcaaagagataatgttatccactctataaggttacgtgaagaggaatctaaaaccctctctatgattgagaaaatggacaagcttctgggaaaactattatcgccagaggctaaaaaagagtttatggaggaatttgtaaatggctaaaggactaaaggcaattaacgaggcggctggaaagactctagtagacactatcgcagaggactttgaacgccaattaaataaatggggagcaactggttatacatacgatagcgacgtacatcaccaacttatgcgagactatcttaaaatagttgaccgaaacccttttgaagacttcccagaaaacgttccagtattccgttcaagtggaactggtaaatgcttacgtgaacagactttgttcgctattgataagcttgaaggaagcgaccgaaaagaccctcctaaaatgcagtctcaccaaagccgttgggtacagattggaaccaaggtaggggacatgattcaggaacaagtcttaatgatggagaaacattaccaacgctttactggagaggagtgccacttccgtttcgaacgtactgaagaaggcttcccacacttcgaggagttctcaacaaccttcaagaagtataagtcaggccgtatggagttcattacaggaggctctatggatggcattatgatttggactgacccagccactggagaagagtatcgggtaggccttgaggtcaagtctaaacaaactactccagcagctactagcaagttctctatgagacagcctaactcaaaacacgtgtggcaggttaagaactatgctatgttaaaagacttagacatgtatttaattgtctatgtaaactgcgctcacaagtcttgggaaatgactgaagaagactatgcgaagaatccagacttacaagtattcggtgtagatattaccgaacaagataagaaagacgtccgcaatcgtttcttcacagcgattgaacatgctcatgcaggaacgcttcctccattagagcttagtggatttactttcagcgactataaatatgccttggcaaacagccttacttataaggaattagaagagcttgagaagaaagctgtatctaagtttgaccagaaggccttagaagaaattaagaagattagaggagatgttaagtaatgaacgaaagcatttatgatggcattccagagttcgacctaaagcctgagatatatggagttgtaattaacttctattgtaacaaatgtcagaaacctatagtaatgcgtttggacgaaccatctttagtagctttggatggaatttaccaagagcgtttagcagatgattccaacgtaatcctagaagactgcgtgtcaggctatcgggtagcacttgacttacaggatgttgtgacatatgcctctaaaaagcttgacagagcggatatggacttctcttggagtacctttattgattgggtagacgttttcacagagactgaaggaggagattaatgtgcgctttattagtttcgatgtaagtagtgtttccacaggcgttgcggtgattgaccgtgagccttctggataccttaccttagtccatacagacatcattagcacaaaccctaaacacaacgtagggcgacgcttaaaagacttcgcagaagctgttcaaatccttcttgaaacattccgcccagactatgttgttaaggagcagacaatcgctcggatggccactcaacacatcttgctgaagtttgctggagtgcttgagatgatagcctctaacgaaggcttcccaaagatttacgaatactctcctacgactgtcaagaaggttgtgggaggccatgggcgctccacgaaagaagcagtgctgatgggcactacagaatacattaattggaacgagccaattgaccttgtaattgacgacattagcgacgctgtagcaatctgtctaactcacattggaaaagaatttgtattggttccgttaggtgaagttgagaaagctaaagaagaagctatgattgtagaggcggaggcttctaaatatcttgaggaggctaccgaatgaaacagcagttgagaattgccataacaggaacttctaggagcgggaaggatacctttgctcaagctatccagaaaaagttagttgaaatgggttttgcagaagctatgccgatagcctttgcagaccctttgaaacagctgtataaaagatacttcttctatatggaggacaaagagaagccaagagatgcctatgttaccattggaaatgctatgagagaggttgacgaaaacgtttggattaataaccttttaatacaggctgccaaagactgggacgaaggcttctccacactagttacggacgttcgtttcgagaacgaggccaaaacacttataaacgaatatggatttatcttggttaaggtggatgccgaccctcttattagattaggccgtgctgaagctttaggtgaaacacttgatttaaacaataagggagacattgaggtaggaatgattgagcctcacttaaccttcctaaataatggggagagcgacttaatgcaaatggacaaatacgctgaaataattattaatatggctcaggaggttgctaatggctaatctattaatctctgagaaatcatactacgaaaagttagtagaagcggaaacagcaaatgagttccgtatggttttaataagattgattaatagagttgttatgaaagttaaagtaccacttgaggttagagagcttttttgtgaagaggttttagagatgtattacgaacgctttggcgacgtagcattgccagatagcctagcaaacatcctctcaacatattatatgcaagacgatactagaggcgacttggaaggcactaacaagttcgctcgctgttctaaaatggagtatagctttgcttctgataaaaaggagaagcgaatccgtactgaggacttatataaagaatctccaatcaacttagaagtgttggaaggaaatggttattcacgaaataatattgcctcatcattggatatggagcgagcatctcttagaactgacttgttaaaggcaatggcaaaagccgatttaactgagatggagaagaaagtccttgagctaaatcttatctacgattacactatgcgtgagattgaagtgcttccagatatgccttcaagaagcaccttgagtagacaccttacctccgctcgcaaaaagattatgcaacaaatttaaaatactttcaaaaaggggcttgacgaagcctcttttttgtgctatattatattcatagacaaagataactaataaaactacttggaggaatatataaatgcctagaacaaataataaaatcagccgtaagaaagcgttagaagtgtatttagaagggagtaatccattagcggctatctcagagctaattgaagagcatacttggacagttggtttcgacatggagtcagcaaccttttataaagagcgtacaagcaatccatatgacacctgtaagaatcctcggtgcaagctttgtaaacagattagagaacacgctgaacgaatccctgcttactctttaggtaagactttagctaagcctttcgaggaactttctttagggcactttggtaagctagctgcgaatgatgttgctaaagctgatatgcctaagctattaaaagtaactatgaaagatgttaataaacacattgacatgcaggtagaaaagattggattagacaattccatcaaccttctaaaagactatgagttatctgaacaagttatccaacagcttttaggaattggtgtttatgatatgcgacaatttaagaaacgcatgtacgaaggcaagaagcaacgtattgccgaagctaagaaaggtgagtgggcttaatgaagaaatatataaagctaggagcagccgttttgattttgcttattggagtagctgtgtggttaattgaatttatactgccttttgttttactaaaatgggcattgtagaaaggattgtggaacatggataattcactaagcgtatatgaggtgcaaatcctcaacactaacacaggctgctttgacgttttcttagtcacagcaataagcatcacttttgcatatattaacttttcggagacttttgaagaggatttccacgatgatgggaatgttaaagtaatcaaattggaggagttttagaatgaatatgattttaattttgttaggcgttgtttttttggatgcttcttacttgccttagaaaggagaggttttaatatggaacttttagaaagaatcacatacagcttatttatagctttggtagtagttttagcagtaggagcattttttgtaggtgtttattggctatccgtttggactagtggattaggagaccttggaaccttcgttgcagtaggtattgtaatgttcgtttttacagctttagcggtgtttcttggatttgattaaggaggaattttaaatgaaattgaaagacttattaaaggtagtagacccaatgcaggacatctctttggagattgctgaattaacggctccagaaggtatttatgctaaagacattccagaaatgcgtccaatggccttggaaatggatattgtagatgttcacacagcttggtataatacagaagatagcattgaaacaactttgggagtcgttgtaaaaggaggtaaaaagtaatgcgtaaactatttgaagagaactttacaattgacgaaatgtcagatatgtggtatggttgggataatgaaggccttttatatggctgggaaaatggcgaagcaggagaagtttatgcaatacttgaggaaaatggatataacgtggactccattaaaattatgtatggagcgttcataacacttggggaattgattggagcgatttagacatgcttattagattaaatgaagcagacaattatgaagaatacaaggaatatattgagctttctgaaacatataatggaaaagttcacctagagctttatatagaagaatctgaaacagataattatattagtgtaaaagaagcttacttagacgaagaatctattgacaagcttatcaaagcattacagagctttaagaaaggggaaatctaaatgtctttaggaatgtttgacaaagagcttttagcagctctagcagctttacgatgggttgtagaagaccctgaaatcaaagagcgtcacgatgaaattttaaacactgcgtacatggaaaacgcctacgagaaaggcgaatcattccccaatgaaaagtttgtggagtggcatttcattaatgccttaacaacgcttgagatagaggcggctgcacgagaccttattattgatgatgaatcctacgatgaagaagacgatatggactgggcaagcgacacctattcatgtggctgttgcacatgctgtggatgcacctgtgactactatatgtgggaagatgatggaagctttgacgaagacgatttggaggactaattgatggctaattactatgtgttagaaagacttgacgacggctctggcaaactccatcaagtaaagcagtataaaagcttagataatgctattaaatatgctaaagaaatgagcacctttaaaaagacttaccaagtggctggccaattcgatatgaacaggcttgctaacactgggatactagtttagaaagttgtacgagaggccttgacaaaggtctctttttatgttatcataaggtatcgaataaacaaggaggaagtttatatgaagatttcagttaacttacctgatgataaaaaagctaaggaagcaattaagaaggttaaggggaagaaacctctattaactatggaagaggcgtgggcaaagattctatctatgaagaactccgcaaaggatttagaacgccttaagcaagttaaggaatacctcgaagaaggtaaggtaagccgtgaggaagacaagttaaacaagaacttctcaaaggccgaggctctacgtatttatcaaaaggttcaagaaatggaacgagaagctaagtttgacgaaatccgtaagaaagagtgggagaaattccctatcataaacaatattgtagagcttgctagttggattgacaacgctcttgaatgtgataatgaatacttggcgatggactttgaaacagtcggtgacaacggcggtactgacatatatagggaagagatttcaggattctctttaacttaccgttacaaaggcgaaatcattaatggttatgtgcctatgcgacaccgagaagaagacggctctcctagtcctttaaatatcgctaatgttaagtgggctgaggaaggtattaagagagtctttgagtcagataaggcaactgtatggcataatgcaaccttcgatatggggcttgctaaagcttctttaggaatcgctcccagaacgcttgtccacgataccttaatcttaatgcacctacttgacgaagaccttccaagttatcagttgaaagttttagcaacacgcttcttgaatattccgtcagatacctttgaagaaatgttcggaaagaatgcaaagttcgctgacattgctgttgagattgctcgttattatgccggtaaggatacgtatgtgggatttcttttatttgaatggcagttgaacatccttaataagccttctttcgctaagattaaaaaggtatatgagcggattgagcgaccttgtatcatggccacttttgaaatggagtcggaaggcttccacattaacatggaagaggttgaggtacaacgtaaggaaagcgaggcagagttagaagagatttctgcacgccttcaagcacgctttggcgacgttaacttcagctctccatcacagctgttaaaactgctttacgtagacaatgattggagtaagtatgttacagctgaccataaatccattctaagaggtcacgtaggttatgatgaacatggtataagcaataacaaattgtttgcattaatgcctaatggaagtgttatcctagaccctatggtaaatgctgaaggaaaggtcgttccaaagaatgacagaaacaagttacaagctaatgctaaggctatgaaaaagattgccaaagctgttgacgaggttcaagacatccttgactacaaggacttgacaaagcatttgacagctttcgtaaacaagattgacaccttcattgcgcctgacggaaagcttcatggacagtttaatcaattcggtactgttacaggccgtttcagcgcctctaatccaaacttacaacaacaacctaagaaagctcgtaagatgttcgaggctccagaaggctcattaatccttggagcagatttttcgcaacaggagcctaggctactagctcattcaagtggatgtcaagaacttattaacatctataacgaaggccgtgacttgtattctgaaatggcttcagcaatctttaacaagcctatcgaagagtgtttggatggctcaatttaccgtaagaacactaaaatgattgtccttgctatcatgtatggaatgggtgcctacagccttgctgacatccttcgtatcgacgctcaggaagctcagaaaatgatcgacgacttcttcgtagtataccctgaagtagaaacttggattgaaggcaataagaaaacagttgttaagcaacgctatgttgaaacgctgtttggaatgcgtcgcagattcaagcatgaaaactttgacatccttaaaaagaattggaactccttagatgaaaatgataagaagctccgctcagcagcagcaagagccttgcgacaagctactaacgctttaatccaaggcggagcggcctctcagactaagcttgtaatgaatgcagctagaatccgtttgaaagagttgtcagaggctcgtggagaacctaactcatttggattccttgctcaagtgcacgacgagctgttatttaaagttcctgaagacgtaacagaagctgaggtagacgctattgaagacgttatgattaacactgtgaaactagtagttccaagtaagactgatattgagattggtaaaaactggggtaaaatgactgctagaaaagattggtttaaataaatttcagaaaggggcttgacaagcctctttttgtatgctattattagtccataaagaagagggaggaatcaacatggtattgcgagtaggggataaagttactattaaagaggatttaaaatcttacgaaagttttggtaaaggagttacttttgttccagaaatgagtaagtacctaggcaaggaggctaaagtagtcacggttgcttcacatgatggattagaggttagcctagacattgacaacgagtgctttttgtggcatgaggaaatgcttattaaggatgaggttaagccttcagaactaactttaggaatgcttttgagtaagctaactgaagacattagtgtaaacattgatttaagttttgaagacgcatctaccagaatcgtgtcggaaaactattattcatggcagctagagccttattacagtcgagttgttaaatggtttgcaccagactttgataatggagagttagcaatacttttggaaggagagttttaatatgaagcttaaagtaggagataaagtaactgttaggaaagacttgaaaacaggtcggtatggcaatgatttagtttttccagaaatgcttgattgtaaaggagttacaactagtattaaaaaaatccattctaatggtgccatagaaataatcggaagctcatggtattggactcctgaaatgtttgaggaaactccttctgaaatcactttagaaattggctatcgacactctttagacactattgttcagacatcctctcagacagttatcgatgatgattacgcttatgagaatgcctgtgaacagtttttagaagagtatatgaaggattacaatagtgtagaaaatatccacatctgctttgtgagggaggccgtcgaaaatgcctaagaaatattacctgaaggccatttcaatgtatatattatatactttcatagcagccgtggttatcggcggaaccttcctgttagtaaatgcttttgtatgggtaggtacattcatctacggaagatttggggacactgttggaacaattcttttactctccacagctggactgatagctttatgtacagccctttactatgaagctagaaaagagtttcgagaagacgctttgagagtccgtatccaagaccctgaagatggtattgatacacagcgctttgatattgtttacatgcttccagaagacgctatccgacaagcctcgacaattgttggaattattccagaagacatacaacacattgagtccaaagagcttcggaaaaaggttatccacgccatcatgaagcattcaccagtagagtatggatttacgcttatcactaagtatgacccagaccttgactatatgcttcgtgaaatctgggacttaaactacactttcaagactagaagaaagcttatggaaaagcttagagattgtggagtaggccttgaaggagaatttttgaagtatcttgttgactaattaattaaagtgtgttatagtagttttgtagaagacattaaggaggagattttaaatgaaatacactaagaaagaccttaaagaaggcatgaaattacgtgttattgacggagctgactttgatttttgggaagaaggctcagtacacgaagtaattaagctttttggaaagcttgttattgatggtgacgacgaacttggaagaggaattagaaacagtgatgacatcctaaattacctaaatttagaatatcctgtaaaaatggaagtagtggaggaaggcattatgaaaagctctggggaacgcttaactaaatccaatattaaagaaggcttgaaagtagtgtgtgttaaaaacgcttatgagccgtatcgatactttactgttggaaaagaatatgaagttgtaatggataactgtggtgacttaggcattgaggatgatgatggtgaaggatttatttgggataatgcaatctttaatgaagaccagtttgtcttcgagcttttggaagaaccttcgaaaaaagctgctttagaagctttagatagcaaaattagagagcttaacaatcatcagcaagagcttttccaaaagcgtgacagaatcaatgagcaagctatccaactaggcagcaaagcacgccgtttagaagaggctaaagcactcattgagaaatacatttaggaggcagtcttatgaaagattttctagtagtcgttatgattggcaataagatgcttaactttgctacttctacagaagccatgacaatggagtttgtggaaagccttaaaaaagagctttcagaacagcttagcgaagacttaacacctgctgatattacagttttaaatatcattccaatggataagaaacaaagtagccttattacaggcatttaggaggagtttacacatgttaacgacagattttattgaggcggtagagaagattgggctagaggtagataatagctactcttcggtgctttacgtagaaagtcacgatggcgttgttgtaagtattaacaaaggctgttctgaagcttttacatggtgtgaaggaagagacattcatgtgggaggccttttaaatcttatcccgcttgtggaagagtacgccaacacgcctatcgaagagcgtgagaaaaaggtttccgagaagctagattatgagactattaaagagtatattttcgaaaacatgtctgaaaatgatttagcaagacttttgtcagaggcgcttaaacacagcggcgaaacaaatacctcatatataattactgacagaggtgttgcggttagtcctaagttcacatttttagattaaatactttcaaaaaggggcttgacaaggcctctttttcatgttatagtaagactatagaaaagacataggaggacattatggaagacttattcaaatttgcgtgcacgcttgtgttaatgactgttctaatctctgggtatgtggccattcaattagttattatagcagtggcaggaacctttttgccaacatgggcgtttgtaattgttttaggatggcttgtatacactaattacagagtattgttgaaaggtggagaatactaatggatacagtttaccaagacactcaagacatctatttgaaagctttttggatttgcattgatagagctagaaatagggcaggagtcacttggtcttatttacagcacggagataccactagagcaattaatgggacagctaatccatctatcaaaaagactttgcagcttatggacaagcttgacttagatattgtagactttcaattggacgttgcagaaacttatgaaagacttttggaaggaggactttattaatggaatttaacgaggaagaattattctatttactagctcttttaaaaggcgatataaatgaacttaaggaagcatttgacatgatcaaggcatttggagcaggtggaaatacccttcaccatattaatgaatacatccttttaaaccttaaaataagagcaagcctattattaaagttagaaaagattcaggaggactttgcgaatgctaattaaaaaggaaaagaaggcctacctattcaccatttatgaattgcattcctacccctttgtgataggcgtcgatgcttactccgattcagtggctatagaacgtttctacaagatttggagaaagcattatcctaagcattataaaaagcataaggggttctccgttaaaaagtttgatatttagtattgacaaatccaccgaaaggtgttaagatagacttatcaaaggttaaggaggtaattactatcatacccgaaggaagttatttaaaagattcgtcaggcctcaaccattactttatcgaaggccatatcataggcgttaggacaggagtaagaggctatcagacagttgtttgggataaggaattggacaaaatgtatgaacaaaactttcacgaacagtctctcatgaacgatgttaaaatgtctaagaaagaaattgaagaatttaacaaaaagtattatgaatggagttggggacaagatgtctaaacatttctatgcaaacactagcccagacatggctgtaaactatccaaaaggatggacaagctttttccataatattgtaggctatgacgagcctttgtcagaagatgtcttaacggcttatcagcttaaagaaatcactgatttaggagagcttccagaacaccataagaaagtatttgaaacgctttcagcaatggagtatagcaccgtggagcaggctctaaaaacatttaaaacaaactatgtggagggaatttaatatgaattttgaagaactaattacacaggtagaagaatggtcagctaacaaaggattagacaaaactgctcctgagaaacaattcttaaaagttattgaagaggtgggagaagtagcggcggctatggctcgtaacgaccgagaagaacttgtagatggccttggagatacttttgtaacattaattatcctttgtcaacagcttggagtagagcctcacgaagctttggatactgcttatggtgttatttctaagcgtacaggaaagatgattgacggagtattcgttaaaagcgaagacttgtagaacagttaaataaactactatcaacagcctttccgaagagattcacggaggggctgttttatagttttcaaaaaggcaggggcgaaatttttaaaaaattttttctaaactgagaatttttaaaaagatttttccaaaaatttaaaaaaatttttcttaaaagtttttcctaaaagcgctactggattccattattagcgcttattttacatatttattgaaatagcgtgtcgcacaggcgcattctgagcgcatttcgcactgctttctgcacaactatccacatatttgttgtgtggcgccttatatatgctgctatacatgcctttccactgcttttgataaacattattggattaggctgctatatacacactatcatgtgcctttactatagcctatcccctatgctttatagttagttttcctataggctactttaggttatactactataccttactctactatactccccccccccagtttccacgagaagtgccctataaggggctttttaagcatttttacgcctttttaaaggcttttcttgctctttttacaagcctttttgcacattctttcttaaaatccatcaaaacacctttataatagctttttcagattgtttttaaaagtttctactatataatacgccgtttttatgtaaaagctgccaaaaagaatttaaaaaaagttgtattttattgttgacaggcatttttgaaagtgatatattaagagtgtagcaacgatctactaaaataaattataagaaagaggttttataaaatgatgaaattaatcgaattagacaatgggcggaagcaagttttttacaacaatgttttaatgcaatacgaaagacgtggcagcgatatatatggcaatcccttatatcgagcatatccaattaacttttcttttaaacgtttaaaaagcgtatatagaaattacgaaaaaagttacggagaggaatcctactaccttatccaaagctataacattttagcagatattcaaaacattgctaacgaggtaaacgcaaaaaacacttttccagactttgaccaaactttattgaaagactatcgggaggttttggcgtatgtctaataaaactattgaaaaattatataatagttacatgagtacttgtaaagagttccgagaaacggtaacatttactcaatatgtgaaaggggaatattagaaaatggcgttaacaatgtttgaaaaagagagtttgcaaaaagaaaatgcacgacttaaaagagagctagccactttaaaggctagccaaaaactaggcggaggacttgacgaaaaagaattacaaaaggcattaaatagttgccaaaggattttcaaaactttaaataggggcaaaagaagccttgttctaagtaaatccgccatggaggctagtgtggaatattcgggaagtggtcgctcaaaaacttataaagattgttccaggacagcaataagagaagcagaaaaaagcgcatgggagattatgagcctagaaaatgactttagaaatattcaccacttcttaaaacatggtacaatgaaagcggaggaaaaagacaatgcttaatattattgtaacagtaatttcaacggtggttattttaaaggcattggaatgggcatataaaaagctttcgaaaagacttgacaagtctattaagttttcaagaaagaaatctaaaaagcgctttattattgcacgagtgacggaggaacaagcttatactttgcgattattaaaagccatttctaaagatgatgaagctgtttgcgaagctacaaacaaagctttgctggaatacggttacgaggaggcgggcgggcattcttatgagaaagctcgggaaaagttttcatcattacctgacgtaaaaaacggcataccgttggacgatctagaaagtgatgaagaagcggacgtgcaacctttttagaaaagtttattaaaatgcttgcaatccacttggtgatttgctattataaatgtagttagaaaggaggtaacaagaaaatgagtaaagctttttacatggcactaggcggaatgttgacaagctttttcctagggcatggcacagtagcgtattttatggcaggcgctgcagcgttaacaatagccgtccaaacaatttacaaaaaagattagtcaaaagtgttgacaatggttttcgcaaatgctataataaagaaaattaagaaaggaagtaatgaaatgacacaaaaaatctacgttgacaccattctttacaatccatcaattattgtttatgaatggaataagaaaaacatggaagtatctttctataataagcttaaggagagagaagaaaccaaagaaattaaggcagaccgtgatggcgatttatatttttatgcaaacggtcaaacattctacaaaaggcatttacatgtaattgaatataaagaaataaacttgtaaaaagttattgacaagcggttaaaaaagtagtaaaatatatttataagataacaagtaataaatactcattcgataaggttagggcaatcctttaaaaaagcctaaaataaaataacagaaaaggcggtttttaacatgacaaaaattacaaaagaaattactttagaagaaattaataatgcagagtatacaggttatcttgtgttagataatgatagcattattgtaagggtggaacgtaacaaggtaacaaaagaaacatactgctatgtttatgcagacagcgacagcgacgactttacagcaaaatttaaaatagagtagttaaaaaagtttacaaaaagctattgacaaaaaacaaaacatagtgtattatagacttataagataaagagaggaagttatagacatgacaaaagaaagcaatgtatttttagacgaaaaaggattttttgaggaaattatagaaactttggaaaatggctacaccggttattattgcgacctgcacagtgaaatttttaactggggcgtaaatgctgacattaaagaattagaagaatacggcgtttttaacgcaatcggagaaattcaggaatatgaagaggaacacttctgcgcaattctaacagaccttgggaacgcttcggcagttgctgatatgctttactatattaaaggtaacgagtttttatttgatagaatagattttaatgatgttttagcagacgttgcagaggggctaaaattagataaagacttatggggcgaggaagccaccgaggaagtgaacaaggctattattaaatgcttatcggaggaatttaagaatgtttattgttaaaatttataaagaaaaatcagatcgtcagttaaagcttttccacaactccaaagaagctgaaaactatgttttgagaaagctcaagggaactgacaagaaaactattgaagtttttgaatgggataacatagcgttagaattaagctactggaatcacttcacacggcagcaagaaagttatttactagaatattgaaaaagtttatgaaaaggggttgtaaaaagcccctttctatgatattattaaaccatcaagaaaagagaggaggtaacaacaaaatgacaacagcattaacaatcgctttaattagtttggtagcaactttggcagtaagtattcacgaaattaatcgttaaaaagttttagaaaagtattgacaaaagcagttacaaatgctataataaaggtatagtaaaacacaaataaaaaattatatgaaagaggttttcaaccatgacaaaaacatttaaaaacattatcgcaactttaacaatcctagtaatcgctttggcagcagctacaggaatcgcaacatttaaggcagtagaaaacgcaaatgataaagctatccttgccgaacgtgtggaagctttggaaaaactttccgacaggcaagaatatgatattgcagtaaagtctaatgtaatcggcgcttacctaatcaatcatgaggaagaagcacaaaaggaatataccgaagcttataaagcacacaagccaacgcttcttaaaaactatagagaggcacacaaataatttaaaacatttttttcaaacttaataaacaggaataaggaaagcttttgggataacttctcgagagcttttcttttttgtgttttcaaaaagtctgatcagaaaaggcgccaccttaatttatggaatgcttttctaatccatctaacctaggcatttcttacaacgtatataaagctttctaatggttaactacccaacttctttcttgaaacgttacgagaagccctctctcacacacataataaagcagtaggcaaaggaatatgcaaagagtattcttaaatgctgttattaatccaccaaaaaggcaaggaaagaagcggaaatgtgagaaagaaatggtaaaagcctattaatcctagggtatttttaaaggaaatgagagggcgcctaacaatattattttaaagctttttctagggcgttgttatgggggtttttctgaagggtatctagagggcgtgaaggggcgtaatctcaaggcgaatctaagaagcctaatcgaaagctttgcggtggatttgtttttattaaaggaaataagaaggctttgcggaatgctggtgtggtgggctttggggagaggtggctcgagagggtgtccgatagctttcaccacaggttaaca

SEQ ID NO: 5 - DNA, 166367 bp, synthetic construct
  source 1..166367: mol_type = other DNA
aattttccttattaggccgcaagggccttcatagttttagcgatttgggaaacttcatcatcacttaaagagttgcgatatccgatgaagtcggaaacaatacggaatttcttggtaaactcagcaaccattttatcactgttttttgaagcattatttgataatacatcaaaaagattagttactgtccagatatcatgaccgatggtatcttttccaccattaaaatatacaccgcgcaatgaactaactatattagcgagtcgtgtatattcttcagaaacttcatctgtactgaagtacttcatcataaaatctagttcaggatacttgataattttatcaatatatcgttgagctgaacttgaataacctacgtacttatcataatctacatcatcaaaagcatctacatataaatcacgcagagtttcaaaaatacattggcactgaccgagttcttttacctttttctgcaaaagcggacgaataacataaaactcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagcaaatcaatctgcgattctacttctggattaataaacagaagacgctcattatgatgaatattcaaagtgttattaaattcactatcatctaacgctcgtgctaatccacgaacaatattaacacgatttttaatattatcaataacgatattaatttttgttgtattaataccaaacagacgataacttgatgcaacggctgaagtttcatgactttgcttaatgcgcttcagtcgaggatcaagatttacttcatacacaactcctgcattacataacttattgtcaggttcaaacatgctctgcatctttttatatgacagatttttagtcgtgaatttgactgaattactaatcatataatctcgagcagaatatcccatcttcatcaattcacgatatgtgtgacgaggagatgtagattctttaaatcgttttacatcttcattaaatgctttctcactgagttctttaactcgttcaataatatttttacgagtacgatcatctagtgaaagagcttcgcgtgatggagcaatatcaagcgaacccattggaaacttaatgtaattcacttcattacgaatgcttagccagttacggtctttaataacaccatcgataggataaacaataccgccatagatagcatataatccaccacgatcaggccagtatctttctggatttatgccgtaataatcatcaaaatccggaaaataatcaatttcgcggtcaagaccattaatgatagccaaatctttgaatggtcgcatgatataagaaacttcataagcaaagtttctaaagtctttttcttcaactggaactacgatttcaataccagttttatcatctggacccatttcttttacgaatgtaggtttaatctgtgggccatcaccatccatgtaagctacataaccacgaatttcacctttatgatacgaagtaatactaaacgtatcagtataactaaacggagatttagaacctaaaccaaatccgccaataaagtcattagattcagctttagatgaactgaagtatgaattatacaacccaggagaattatcatcaccctgaatatcaaaatcactcatacccggaccaaaatctcgacaaacaaatcgtgggtctaaacgtccaggaacttgaatgataaatttttcaggatttccattgagagcatgggcatcaatcatgttggtaatcaattcacggactactgcgcgaatcttgtttgtgtacaaatcagatgatagaattttaaatactttaggagatgctgtgatgctaaatgcttttgatttagaaccattaccaagaattgtttctttttcagtggtgataatcataatttcctcattaattcatattgcgtttaataacttcagcaacttctagtagttcatctttagttgcggtgtcggattgaattttatctctaatatccttaaagcggtttttaaactcttcagcttctcctatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactgggttttgaatcatctcacgatattcagatttttccaaagagccaagtcctttaatataacggatgctatgtttaggtagagcatctttggcactctcatattcagcgactgtataaaaccattcttgttttttaccgacctgagcgatgattacaggagttttgacgaagcgaattcttccttgctcaaacagttctggccaattactaaaaaatccaagcagagaaggataaatgcttcctagaccatcatggtcagcatcagtcataatagcaatattatgataattcaagttttcagctttttcaccgagaactaatccagtgattgcgcaaatatcaaacagttctttgtttttaagcatgtcagcatatgacataccccaactgttgagaactttaccacgtaatggataaccaccatgaagttctttattacgaacatcaataagatatccgatagcagaatcaccctcagtcaagaacaatgtagtatcagcatctttaccacaaagattcgctttgatatgtttatgaaccttagctttagatgcctttttagctgctttagtttctgctgctttttctgccgccaatttacgagccaaagcagcttcaataattggcatcagaattgcttcattattcaaaatagcacgtgaaatctttttagcatcaagctgaatatgactacggatttcaccaaatggagaagtcaaacgctctttagtttgagaatcaaatcgcatgtttttcatatcacgaacaaacataacgattgtcaaacattctttaacgcgtgctttagtcacatcaattttgaacttacgtttgatttgtggaataaggtcttcacaaatatcatccataacacagtcaatgtgatggccaccattcttagtatgaatgttattaacgtatgttaattgacgaaaaccatccggtgaacgaccaactgcaatagaacagttttcttgttcttgaacgatagcatgctcatcatattggcgtgcatatttcttaaaattgccctgaacctttttaccattaaaggtaaattgaatatcaggataaacaacagcaagtgtctggagacgatctaatgtaatgtcaagataaacttgagataattcattagtttcaaatgacataaaatctggaatgaaagtaacacgagttcctttccattttccaggaatagtttcccatgatttattttccatgccatttgaacaacgaactacaatattattttgaccatcgccagtttcaccgacaaacatcacagaaaaaatgttagttaaactagaaccaacaccattcataccaccggtgacgcgttctttatcatcaccaaagttaccacctgcttttggaatagtccacgcagcaactggaccaggaatttcttcaccagtaggtgttttaaccatcgcttgtggaataccgcgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacgaatagttgaatccttaaagaacagcccagaacatactgttccttctactttctgcccagtaggtccaatagcacgaaatccagtatgttggaaatcattttcagaacaaccgaaccagttatatccagtgatttcaatattagtaaaaccgcttgaagacaaaactttggttgcattatcagcatcagtacatcctactaaagacactgctaatactaatgccgcgatagaacgattaatatatttcataattttcacttaaatttaatggcttgaagaagactaataattctcaagcgacttccttcatctttaactgtaaaagaaagagggtcaccagatttcatagtgatagtgcattcaaaagcaaaaccttcgggaacttcttcgaagaagtcaaattcttcatcataaattagaacattactctgaaaactgtgaagaatttttccgtcatttccagatgctgtactaatcattgtaacattattacctttcatatcttcaacgataaattcgcttgtagatattacagcattaatagaaccattcctataaatagcagaaaatagatatttcttttcttcaccttcgcgaatgcgatatttcttaccgattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccatgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtaccatcttcagtgatttcacgaaatacaccgtaaattggttgtttatccccaaccttttcatacacataaaccgaagtcaagtgagtaaacttgatagtgtgttccttttgaactactaccaaatctggatcgaataatacatcttcaaattcatcattagtgcaattctgaacaattttacgtttcatcataatttcctcattaattattagaagagtatcagcgcacctttaacgaattatccattttattctccaagttgttttctgtatcagtagttgatattgatatagtaccataatcaactactgatgtatatagttttatgaaaaaattttaaactttatgcatagagagcattgctgtagtgtttaatccaactttcaggaatgactttatatgttcctaaaaataccacgttgtacaacttaacgccatcttctacccattgatcggtaatgtatccacacatagcgcgagtataaacagcctttccatcatctttgataaatttaaattcacaaggagcaatgaacttgatagcttgaccgagtttccacttaaagtctacacctacatgcgaagtatcaatcgtttcaattcctttagcaggaacagctttcaaaaacgcaggctcaagaaatttccatcgaacataaccaaactggggcttagacattccatctttagcaatgatacgtacttttacttcagaatcttcatctttaacaccgtgtttaagctgaatgcttacaacttcgaccaattttcctgctgctttagaacgggatttatcagatacacgagcaatttcaccaatattaataatcatagttatctctcacttgttaaaaagattttatactccacaggaccattatactctggtcccaagagtttgtaaactattaattcaaaatagctaccaccgcactacgaggtactacactaaaatctcctgcatggacaacgttcagaagctcaacaccatcttcaatccactggtctgttacccaaccacagataggattatcaaaaggacgacggatagacacagcagcacacaacaggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcatagtaggttccttaatttccagtggtttaacagggcatacataagtacttacaacgtcaaaatcaatcagtttagctgccggattcggtgtgtattcaggattataattaaatttcataattatctcatttcaataaaatctacaagttcagcatgggatttacggaacattacttgatgcccgccaacgataacttggtcatctggtacttcgtatacagcaagataaaatcctttcgaagctaattcttcacgctcttctcgtgtgaaccatctcatcatatcatattcgctagcgaaagcaaaatgataaagagctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacgtgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgatggagcatcttcaagacccatagcatatcgcaaagcgtacttcatcatcaggatgtctttcgcgcagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatgtgtcaagttcattctcagaaacaccattaagacgttgaatatcacgaatgagatcgactaaaattggaaaatcaaacgacattccacggcaccagccttgagatttccaaggatcgatattatgtgcattgatgtaatcattaaatttcgcaataccgtcgatagtgcttacatcttcatcggacggtgcaatattttttcgagcttcaggagactgatttttccaccattcgatagtgcttttagtaaaaagacgatgtcctttttggctttttaaatcaaatttgattttaatgccgcgtgaaactaattcatcaaatgtttcaactacttctgggttagggtcaaaagcaattacagctaaatcaataacagctgctttttcaccacttcccattgtttcaaaatctataataaaatcaaacattaaattttcctcgctaaatcgcgaatttggcctacagtatagtcttgaatataaactttattaataggttcatcaataaattttgccatagattcaatatctttttgcatctcttcaagactgtatattatctttaaagctttttcgcgaatagtaatattttcaggaccagaatttttctcaatgacagctttaacatttgtcataagagatttaaactgacaccaacttaattcaatcattaataatcgccttataaagatagctaatttcacctaaaacataatcactgattgtgacagttttcacttcaccacaaaagaattctaacgcaattaaatctcgttcaatttcttctaattgaagcatcaacttactagattcaatttttacagtttcacgatttttactataagctatttcataaatttcgctcactttatcttgaagcagataaaactggtctttagttatttccacgaatagcttcctcaaatttaattagtaatttacagacactttcatctagtgtaattaccgtatctgtattactgtgatatgattgtttttcaattcgtttaattgctaatatagtatcacttataagataaagcttatgaaggagctcagctcctgttaccataacatcgagattatcttgcttattagtatgcttccttatacaatctattagacgatttaaatattttgaattgatgttaatcatatatcctcacacataaaatacgtcataacgaccacgggtaacaccaacataaagaagttgttgagccaattcagcatctgcataatgaatacaaggtgtatagatgaaagcacggtctacagacataccctgcgctttatggaatgttgatgcaggaagtgctttcactttactaaactgtgatttagcatcccaaaaatcactccatggagcttttccacccttattccagtttttataagtttctgctgttttacctaaaaataggttaaacttatatagctcttcatcagatgaaattattttaatcttttcacgataatattcatcatcgccgtaagtttctactgttaaatcccaatgacgaattaagtattctccagaaacaccacgagctttaacaaatgttgatgtatactctgcttctataatacgaactaattgtccgttattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagagatttgacgattgaaaaataatttaccataaaatcgcgtaaagcggtatcaccagtaaatccacgtactccatgcccgtcaacaactttatcataaatccacttaccgttacgaacgtcagtagctacatcaataataggagcattactgcgtttaacttcagtgagttcacactgataaaaatctttatgtgtaaagaatggactgatataagcagtattttctcctggatcaacaggtctaatttgcttattatcacctattccaattatagtacaccaaggtggaatagttgaaagcagaattttaaatagctttctatcatacattgacgcttcgtcgcagattaataccctgcatttagctaaatctggtacttccttctgttcaaaaagaacgttttcttcatacgtaactgggttaattttaagaatactgtgaatagtactcgcttctttccccgacagttttgaaagaatctttttagctgcatgtgtaggagctgctaaaataataccagtttcacccgtagatattaaagcttcaatgatgaacttagtaagagtagtcttaccagtaccagcaggtccattaatagttacatgatgtttcttttctttaatagccctcataacgatgttaaaggcatttttctggccttctgtcaaatcatcaaatgtcatcggaaagtccctgcaattggaatactaacaatacgcccagtatctagaattcgttgatataatctttgtgtatctacatcaggcttaacatgtttaacttctattttattaaaccaaaacttgcgtggagtctcaactagtcttggaattcccatacctaaagctagtttatattggtctttgagagtagtaaaaactctatcagcaatctctctttcaaaaaacacagcaggacgatgttcatcaagtggaactggcgccgtaaatccgtctttgtctcggtaaactatcgcatatacataaaccatattatcctcggataagtttaaaaattgaacaatttagcgggtatcctcttttcagtttaagtttatcaataaaagacaagttttgataccgctctacaccttgaataattttatcacacatatcatattgcatttctgcttctgacaactttttcacaattttccaatccgagcctttaagaagaacgttcagtttaacaacttcagcgccttctgctatgcgagaaccatcaatacgagctttaagtgctataattcttagcttaatgtcagaggtctgttttgatttagaaagctgagaaatgtgttcaattcgattttcacgctttttctgtatagctttaatttgattataagtctttttgattttagcccatttcttttcatctaaatttagtttatgaacttttttcgcagatgaacgaccaattcgcaaagcaaataaatcccgtttttcaatcaactcttctaaagtataatcagaacgaaatgtattatactttttctttactgcaataacattccctttaatgtatccaatgttattatcaaaacgttctaatgataatttctctccttcaatacgattatcaaaaggttctcctgaataggcacaaactttttgatctaaaatattcttaatgtaattgaagtctaagttaaaatctttagaacgtctttttgcagatgcctgagtgtgctctaaacgacgtttaattttacgaatttgattattagacagtttcatatttttctcacatcttacggacgattgactactatactataacatttttaccttggcttgtaaacaattttatgaaaaatgcttcaaaaatttcatggtataatgaatctaagtccttccattatagattaaatccttcaaaatcaagagtatagatagtgtatgttgaatactttttatactcatatctatctgcaattctaaatacacttccagctggtatcattacttcttgttcatctgaaactaattccatattacgataacgatggctatccggaaacttaaagtttggattgtattctttacagcgcagagcttttatagcatactcctggaaattgaataccataggagctttgaattcaaaaataacttgtgtgttatactctaaaccggaagcaaaatgtagagctatatttttatcatatgaagctgatacgactttatcaaatgtaataatatcaattccttgatttaatacttgtttagtctcagctggaacacctctccaaagaggtttatcgtttggttccaaacgagatttgattatttcatttaaccaagtatggtcatctggtttattagtaatacaatgaattaaaagttcaatttcagataaattaaatccttcagaaagtaattcttcacgaatagaagcacgcaccgatgcatccattgatttgattttaaaatcttttaattgcattgctgaatatttcattcaactacctcaatatcatacactttaaatgttccaaatgaatcgtgtaatttttcttttgaaatagaagttattttatactttccaattggaatcatccattcttgttcacgtacaatcatcattaagttatcagtacgctctgaatctaatccatcagtatcttcatacgtgtacttaaactcagtattaggagaagaaagtataatatcgctgatatggtcagaataattaaaagctttattagtttttaagcgaagtattattttagtaaaatattcagcgtaagaaaaagaacatgctgtgaacaaactagtagtaaatgaatctactctattcgttgaaaacacttctccaacttgtaaatctttaataagttcttctgttgattttgatataccacgatataactgataaggagatttagttaaatgctttttaatgattttattcaactgcctatgaagagcttcattctttttggcttccatacattgccaaagaactgactgctcaaagtcagtaaatttttcacagacctttttatacatatcatattgaaaatcaacgctttcagcttttatagataactgttcaacatctgcaagattaataatcatgatagcctccgtatacttcagaagctatcatatcatcgttagaaaggaaagtaaacaactttttgaattattttgcccaaggagcccaaggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatactaattcctagcgataaaaaccaaattgacgattagcttcaataatctttctttcttcttcggacattctccagcgtagtccaacatcaaaatgagcccagaccatcttaacaaatgcatttatatctttaatatcttcaataatgaatgttttacttttagaaggttgacctgctaaattaagtgctaatttaactttatcgtcttcaaacagggcaaaaagaccatattcatgagctcttttatagcctttaatagttaaagcttcagaagaagaaaacggtgaatcagtattctgtaaaatatcttcagtatgctttataattagaataacattttctggatattttctttcttttatatctttaattaaaagatccggattttctgctaaaggaataattaatgagcattttttatcaagtgcatttactgatttaccttctttagacataaattctattgaataatgttttgctacttcaatcatgcgatttcctcttgcctactaatggaccgtcaggaattttgttttcctggatatatttctcattttcttccatcattttactgccaattttaagaagcaaatccattgcttcatttgctttagctttagcctcttctaatatcatatctctgttcacgatttatccccatagatgtctctcattaatttaagcgctgagcgttctaatttcttttctttctcagcactaatcattgatttcatccattcttctgattcgttctgcatttctttatttgcttgttcaacccaaccatcatcaatatacatcgagtttggtctattgaaccattcaagcatcttcttcagagctttcatttgttttacctaaaacaacagtaggagcatcatcaaattcatgaatttttagcaaatttggatgtaaactattccatacagaagaaataaagtatgataacgcatcttcacttgcaattataaatttatttcctttatctattttccaactatatagtgaatcgtacgaataaaaagataaaggcttatcattatattgttctgcgctaacattaatgtattcggatttagtaaatgcttcaattgctctaaatggaatatttggtacagtttcaataataccaatctttttaagttttatttcagcatcttctggaactggcattgaaacgaaattttctacgagatacattgggtcacaataacccttatcaatcattactgctacggtaattggaacgtctttagcaaacgacatactattactgctaatatacatttcaaacaaaatcgcttccataattttcctcaatcacaagatgtagatgaacaactagaatcacaagaacttccacatgaatcgcccgtccatacatgaacaggaacattagtgtcatatgaatcagaactagactgtgtattctgcgtattagatgatgtaggtgttgaccaacgccaaggatttttataatattcctgggcttcttcataagtcatagtaaccgcttctactgttccatctcccatataaacatattcaactacagttaaaggaaggtagtcatttgaaataggaactacaccttctccgggagttgtagagaaaaaatccgtaaagaaacttttaaaccaattaaagataaacattacaaaaagcctcttttgaattcaacttgcttctcgccataatcatatcgaatctctgcattaaattcaacagaaccatctgcgtacatcataaatgaatgcacaacaacttctgtagaccatggctgtagttcatatttcttcattacatgccgtgaaatgataatatctaaatcttcatttggtttaatccagcgatttaacatagtgctctcctctataagataattctattataccatactcattttggaaagtaaaccggtaaaatgaaaaaaggactcccgaaggagtccttgaattattaaccacctatttctgtaggcgtaaacattgcagcattcttagttttccaagttgttgcatcggaaactacatcagaataagctgctttttctgacggaaagatttgataatgagaatctgcaatacggtgttcatttgaatatacatcaaatgctacagaaacttccatacctttaacttctttgccttcacctgctggatgagtaaaggtcttgatgttaacgaaaccacccataataaactcctttattgtttaattacaggtgtatttatatcagtcttcaatgaaaacttgtgccaggaattcgtgttcatcttgaatttgtttatataaagccattacagcatttatattagagctatctactttaagttgataggcataccactcgtataaattaattaaagctttttgtcgtctaataaattcttctttggatattttcattttgaatgctctataattagttttaaggcttctttactgacaaaaatttcatcaagaccttcttctacaccccaatcaactacacgaagctgattagataagagctcgtatgtgagctccttgtcataatttttaaatagctggtcaatacgtttcttgtgggctttcttaagctggcgtttatttaaacgagccattaataacctcggtcttgacgagcgaagttttcagcatttttcagataataaagtttaaagatttcttcagccgtaagaccgaggccttggaacatgttcagaacgaaatgaagaatatcaatcatttcgaatttaatttccaactggtcttgtggagacaaatcagtaatcagagtttcacgtcgttcaccatgttgagctttccaaggcttccatacagcagatgcatctttttcaccattgctcataccaccaagagaagtcaatagttcgcggaattcatcatcaatataatctttctgattacgcagccaatcaacaacttcacccgcagtagccaaatcatcaggatgacggttatattcaggtttatctttagctaaacgaacctgcagagatttctgcatatcaagcataacttgcaacgggtctttttcatcaccgagaatatcccagtattcattttgagctttatcagcgccttcaatcagttgtgaacattcattaaagtatgccattatttttcctttcaattcatgggttagtagattaattatacaataaatatataaagcaataaggaggacatatggtacaaaaattaatggcacttgttaatgccatcaaaggtaataaaaagcgtatagcttttactatttctgctatggtaggaattttactctggaactttattttatcacctgttgcaattgcacatggtattaatattccagtagttactcttgatacattcgtagatttagcattcgctttagttgggttaatttaaatcttagcatatttagataaccgcattttagccatcaacccctgagcaatattatttttcatatattccataatttgttcagtggttgcaccttcctttctaatcatatcattaacatcttttgatttccagggagatttatcccaaaacataaccctttctcctgcatcaactaatttagtcattcgcttaatagtgtcaggatgacgaggttcattatctaaaacccacacacgtctatctttaaatggaacaacttctaggtctaattgaccacctgtaatagctataccattttcaataaaaagcgaatctataggtccttctagaacatatacatcaccatctttgactcgttcgactccatagatttttgttgcctcaggataagctttgatggtgatatatttttgaggagcatctttctttaatgcacgtccttgaaaagactcagcttttccgttagcattataaattggaataacaagacgaggctcaggtgtttcctttttatatgttcctggagctatactattaactaatttaggccattcagttgtaaaccaaagatatttccatttatcctttggaatacaacgagcttttacatattttataattggatggtcttccgccaatttatctaatctgatgcatgacggaagagatttaattattttcttctcaggttgtttaggaagttctttaggtttttctactggacgacttttacctttttcttttcttatttcaaagatatactcacgatataaatcaggttcaaactcctttaaatatattccgattggtgcatgatagttacagttataacaatgaatatttccttcattattatcgccataataccatccacgggctttattttgatcggtttttgaatctccacaaacgggacatctaaaccgtaatttaaaagttgaactattatttacttgtgcgaatttaggtaaatgagccaatgcacggtatgcaaactcattatcaatccaaggtattgatgacatttttactcttctttttctttagattcctcttttttctttttaggaatctgttcaggacctttatttactacagcacctgacgttgttccagtggagatattttcaggattaccacctgaatctccagctaccatatcttctttaataaattctttatatgttttcatattaacctctattcataaaagcattaaaaatttggtcatcaatagaaacatctactttagactgtttttctgatggtaattcatatccacatattacaattttgtgatcaatatcaaaatacacagaagcaatatgattaatgatgttttcagtaaagtctaaatcaacatcaatatctttttgaccacagcccaaaggataaataatgcgagtaattcgattatctttaacaaagattccaccgacatactctgtgctgcgtttaaagtctacacgccaacgaaatgaaaaatattcaggctctttatgagctctgctcataggacacaacgagtaactagaataagagatgtcaaatcctacgccttcaatatgagccaaagtatcatgattaaaccaattataatcgtacgccaaatccattagattataatatgtaaaaggcaccggattaacgtcattaatcacaagcatgtaattagcaactgctataatttcattgtttttaacgaatacaaaccgtgattgatgcgaatgacctggacccgcgttttcacgattaatgatataacactgggcacctttatatttgtatgtatctttgcacttgtgcatttgatagagcattattcacctaccacttcagcgatgatatttttattattaaagtttttatcgcaatacagaacataattatactgcattacaccaccagacttaagctgtttttgcacttcagctttcatttcggggcgatcgcgctcaacgatattcataatatctgcttcaatttgagtttcaacctcagtctgatccgcagtcatagaccattcgcacaaatctttatcatagcctgccatggcaggttgagcagcgcaagaagctaaagcaaaaattgcagcaaagataaattttttcatgataatctcctcggtagtttatgtttatataatatctcaatttccaacaaaagtaaatagttattttaaaacttctgcgtaatcacatgttacaaactgtttctctagcttaacgattttacgaaagtatcttttgcattggcgaatctgcctcttcgtaggacgtacagcaaacttaataaattccactcgaccaaatggaggactttcttctgctggaatatctaacaccaattcccacgtatctgcaacaagtgctttgaattgcgtatttttcctgacattatacggagtaggtttaaataaaacaatatgcatattatcctcggcaatctacttcacatactttcttgtcatcaatgaaagctttaactaatgctttattaacttcagcatactgagtagtaacccattgaacatcatctttcatcattgtggtttctttagtaaacatgctttcattcttaaaccaccccataaaaactacctttaccaattccataacaatctcctcatttaaccaacaagactactataccatagtcttgtcagcttgtaaactaaaattttaattcattcgccaaagcatctaactgagctcgagtggattcatttctttgatagcgattctgctcagcctgaatctgttgtgaacctgctacttcattcacttcagttggagtagaatcttgatcaatttctacccatttttgatttcctttttgaacacccatcaaaaacttattccatttattcttatcaccatatcgtgatttgatttgcttaatgagttgttgttcagcagctgctagctcctcggtttcaatgaccgcaagcataaaatcggctgttgctggaagaccagcagattctgcgatatcgctcatgttaacatcggaagagtcccaagcttgtttgccgacctgcgctgcagtccaaagaacagtttcggtttcaacagcaagagcacgtaattcctcagcaatggctttaacagttgtgtaactattttctgagtaaactctaatgcggcaagatttacaaatacccagatagtcgacaataatgattgttggaacaaaattcttcttgagcttcaattcgtttaaaagtgatcgaaatgtattagcgtctgctccaccagtaggatactgtttaacgattaaacgaccaagagtagatttctcacgccatttttccatttttcctttatactcagcgtaagaaatatgcccatcatcaatgtcatcaagagaaacatcaagcatattagcatcaatacgcttagcacagacttcttctgccatttccatggaaatgtaaagaacattatgtccgagctgcaaataatctgctgccaatgaacacaatcctaatgacttaccaacgttaacgccagccattaaaacgttcagtgttccagtctcagctccgcctttagtaattttgttcagaattctgagtttaaatggaaccttacgagctttattcatataagatagccaacgtgcttcatagtcatccatccaatcatggccaacgtagctatcaaatgaaattgataatgcttggcgcatgatgtcaggaatagcacctacatctggcattttcttatttcgtttttctggaggaagctcagcattagtttgaatttcgattattttagacgtagcattaaacatcgccctttgctgaacatatttttctgtttcttttattaaccaactgtggtcttccggagaatcagctagttttgaaataagtgtttttacaccagaatattctgtttcagtaaatgaactattttctaatgcaacatttaacgcattaatagatggaacgctatgatactcattgacatgagatttaattaatttgaatgtatttttagctggaccactttcaaaatattctgaatccatatatggccaaacttttgaaaaataagcttgatcaaatatgagatgagaaagaataatttctaccacacttactccttaaaagaatttaaattttttctttgaccttttattaaatgcatcttgcagttgcattgtaatacatttttctacatgaggagctaactcagcttttctttcttggtcaagaacagcaaagtccattacaacctttccattaacccaatccagttttgttacatatactatatgcgtagaaccatcttctagtttaatgacaatctcctggataacattttccatagcggatttaattatcttaagagattcattaaaaagacgttcttttctttcttcttccccctccgaagagggggattcatcgataatttctagatctaagtctaaatcatctttattcattaaattcttccatatcacttaactgctcgaggtcagtttctaaatcagcagctgatttacttttactttccggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttggtatcttttgcgcgccaagatttttcttcgcgaatcatctcgccagtttcttcatcaagaaattcacgagcataccagccatttttaggttttactacaaatcctaattctagagccatatctaacaatccagaataaggatcgataccaccatcaaatttaacatcaataaagaatttacttttttctttaacggtacgagatttttctacatttagaacaaattgatacccctgaagatcagaaccatctttaatctgacgcttaccgataatgaatacggtatcagccgaatacattacgcctgtaccacctgtcatcacggttttactaaacatttcaattgtttcaattgtatggttaaccgcaacacatggaatatttttaatgctaaaataaggagtaacaatacggaataatgacttcagtgatttagcacgagtcatatctgccacagatttttcattcaaggcatcttcagtttctttcttagaagccatattaccgattgagtcgatgaatacaataactttttcaccgcgctcaatagcttcaagctgattcaccatatcaattttcagctgttcaactgactggattggcgtatgaattactcgttccgggtcaactcccatggatcgcaaataagctggagtaataccaaattcactatcatagaatagacaaaccgcgtcaggatatttgtttaaatatgccgcaaccatagtcaaagacatatttgatttaaagtgtttagaaggccctgcgaaaatagttaaaccagactgcatgccgccatcaatcgcaccagaaatagcaatattaagcattggaatttttgtacgaattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctatcggatgaatagcattaaacttatgaaatgcttctgatttttctttgcgcgaaacacacatgcgaagaacctttaatggctcgtcttcttcacccaacgattttcgtttttcgatattagaagttttccaacgagcttgctctggaaactctctattgatttgctcaagcgctctattatgtttagaattactacgaattgaactacacccgccaggagcttgtgcttttccagatacaaccagatatttgaacaaggccaaatgcggataaccttgattaattaaattgagaaatgcatacatatcttcgcataaatcaatttttccatacccaatttgttctgtcgtaagttttccgaggtcataccatgtattcgtaaatccatatgaattttcacgataattaccccaagatgaagtaattttaaaaattggtagacgagcatggccatgataatacccgcaatccatggcatcctcaacatattgaatcaattcatagaactgttcacgagtcaattgattgactttatctacacaacgacggtcatctctttttcgcattgaactcatacgaatagtagtatcatcgtcaatcatccagattcgttgacctgcatacatatcagtaattgctttacgagtaccggcaattccgtttacatcatcaggaatagttataattttagctctagacccataggcatcataataagctttttcttcatgttcacgtactacgatatgaggttcataatcagtcggaaacatatcaagggcagaaactgcccctacacgttgatagctcggaattacgaattgaatcatttccactcaccgttataatcttttttcacaatatgagtttcgccagtattccaccaatgatcaaccaagtaaaaatgacgagaatatacatgaagacttccaacattccatataatagaacctgctttatactgacgagttgaatcgccggcattcaaatcagatactaatttatctaatacgtatttttgccatgcataatcattacggaatccgaagaccacgtcatttgagcgcatgcttactactgcattgactttcttatcacgaatcaggtactgtactgtattagtacacatgaaatctgacataccatctttattgtagtcaaattgcatggatggacgagtataaatcatgataccacgtcgagaatcaggattttgaccaagttcagctaaacacatatcatactgggcatagttatcttctgaccagatagcccaaccataattcgagttaatttcgcctttagaagatgctacctgctgccaaatctttggtgtttcacctggaatatctttaacaaacaagctcttagatttataccattcaagttcacgctgaatgtattcatcattaagagcgccaaaaataaacggttcatctgctacaaatgatgcgccaataatttcaatagttttaacaccagttttatcaactacgaaatctttttcctttaatgcagttcccaaataaaaacggatttcttcaactgtcatagagtcattaatcatttaaacctcaattgatgcattcatatttaaattgtaacagtaataaaccccaccctatgataagagttggaatcatagcaggaactgttacgctatagtatatacttattataaccatcaagattaaaagcaacactgctataattttgcttttcattccttctctctgatgataattacctgatttggctgcgcagactttttagtttcacctgcaattgaccaaataaatgtaataaaccaaccaataattgaccagttaaacagtaaagacgtgaaaaagattcctactgtcgattttgacccacgcatcaaggcaataaaccatggaagcatgtatataataatagccaacacacctgaaactaaaaccataaaaattgaacctgctactaaagtttccatgttttcctcacttagtcaaattttttacacatgaattataagaattcactacatactccatcggagcatttttaccggtacgccattggtaattattagcccaatttgcccaaagctcggcgcagtagttttcaattttttcttcgcgtgtaattacatcagaattacgatatgcttgagcagattcatctggacgaatagcctcgtcaaaattcgcctgcatttgttctactgtctgttttggagcttctttataacacttgacattaggattataaaacttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacagtgctagattcaatcacaggttgagtatcattttcaacactaacaaatggaactgctgctaatgcaactaaacaaactgctaagcatcccataacaattttcattttattctccaaatccgtatcagtagttgatagttgtatagtaccatggaagaacattcttgtaaacagttttgtgaaaatttttttagggaattctaaatgtccagaatcatctgtttttcataagtatagatttatattacttgtatgaaaaagggacccggaggtccctagatttattctatcagccaaacaggaagtctaacgaagctttttcttcatagtccatacctgccgattcacacataccagcaagcggtttaacaaacgatttttggaacaaagttgagtagtcaatccaagacagtacatcagaacgaatttcttttggaagttctgtacccgacggccaagcaatgcacttatcaccaaatggatttccttcacgcaatggaagaaccattaccttatttccatccaaaattggagctacacctaaaccgctaacagctcgacgataagttagcacaccacgaatatggaacggacatttaaatcctggccaacctttatcatcatatttcgctatatcgttcgcagtttttacttcagcaataactttatagtcaagttgacgatattctttctcgaagttcttgtaatattcttggacagactcttcaccttcctgaagaatacgacgaatactttcttcgagagcttcttggaccgctttaggcgttgaactctgctgagtttccatacccatgatttttagatgcggttcagcaaatcgcttatcttccatatcataaacgttcagagcataacgctttttcgctttccaaaatccaccaacgccctttgaaccaagtggagggcaagaaatagcttcacggtccatatgcatcagatgctcgcggttattcatataatcacataactcacgatatgcaacatcaatcataggttccatctttttcttaccgaactgattcatgaattcaactaaatcgttctgctctttgaatcggtcaagaccaactttttcaataactttatctacacaaacatataccgaatcagtatcacctgctgcgatgaaatcttcgccattagttccacatactttattcagatactcattaattttacgagcaatccactgaataccgacttgaccaaaaattgtaatagcagtagcatttcgcaaatcatagtaacggaaatgaatattaccaagagcaccataaagactgttaataagaattttacggttcagctgatttgtgttagcaagtgtagctgctttttcacattcttcgatcagactattaagaacagattcagtataattcgatagttcatttaagaaatcatcactgaacttaacatatcgttcaacttctggtttagttgaacaagaccctgcgcctttcataataatctttttaatagcttcggcattcatttcttcagcgaacattttctttttccagtctttacgctggaaaaatactttagcgatttcctttggaatgataccttcttggtgcttatcatacatccatccattcggagagcaagaatattcatcacttggcttaggagctgttcctgcgatatattcatgaattggatgaactttaaactgcccacgaatagtctcaggactaatgttaacctgacgaataatgctaggatacagagacgtcaagtcaaaactcataatgtatcgacgagcaatcggtttaggttcaaacacaaatgcacctggaaaactctgtttaacgtgcgaaccttgttgaggaataaccttatgttcacctttcagtgagttaaaaataatagcatcccaagttttaataggactcattacaccagaaaaaggcattttagcgtaataagacatacttaaaactagatcgataaacccacgaattttatcaattgcttgaactgattctacgtcaatgatgttataactaatgtatcgttgatgattagtctcacgaagtttattaataggaccatcgtacggcaatttaccttttttggtttcatgttgagcaactgattccaaagagaacgatggcaaattagtaaatgcgaacttcttgtataaatctaaataatcaagaatagatacgccatcaatagaataaatttctttgctaccgtacatattttgaattagtttagattttactcgaccgattggagagaagcgtttcatactacgttcaccgagaaccattttaacacgattcatgatatacggaacgtcaaatccctcaatattccaaccggtaaaaatagcaggtcgtttctgttcccagagattaatatattccatgagcatatcacgctcattatcaaatggcatataaattactcggtcaagaatttcttgaggaacttcatcaccaccttcacagtcaagcttagcagctaactttgcatcccattttgatactgaaccgtacattgaattcaacaaatcaaagacgtaaaaacgatcgtcaattgaatcataatgagtgatagcatcaatttcatattctgctttcattgggtcaggaaatttatcaccagtaacctcaatgtcacagttagctacacgaacaaattttcggtcataagcaatttctgaaccatatgtatcactgatataagcgagtttaaaatcgttcataccgagagcttcgagaccaatgtcttccattcgtttcatccagtctcgtgcatctttcattgatggaaatttttgaggagcacaatttttaccataaatgtctttgtattttgactcttccttacaatgcctaaacatagtcggaagatattctacttcacgggtacgttcctttccattttcatcaatataacgttcaacaatgttatttccgactgtttcgatagagatataaaattctttcatagatattccttagtttatagcccgagttattaggctcttgatatattatactccaaataaggggccgaagccccttgcttaaattaataccagttgtcggtgaaaaattgttaatccatctgcattaattgacttaaccactgcggtaaagtgtttttgttctgggtgaactaatttttgaaattctacctgaaattttagttggaggttttctggtaaatcaaaaagtgtttctgttgcagaaagattatatttttctttaagagacgccatgtattcttgcggagttatagcagtcatattaattaccaatcgtatatttaggaacgagtttccattcatgcttttgtttaaaagaaataactcggaagttattagttaaatctttcataaaagttctttgaccaggaacgatttcaatcagtccccaatcttctaatagccatgcaatcgaatcacgacgaacttcatcttcttctgtcatttcaacttggcgaccatccatacgaagcatttctttaaaatgaacgatataatatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaaacctttaagttcttttaatactaaaggtagttttccatttttagtaagaattgatttatagttaattgcatcatttgtattaacttgataccgtttagtaagtaacttaataatcaatacttcggtggaatcttcaaccagttttgcccatttaccatatcttttaccacgaggaactgcagccattagataattaaaatgagcttcatcacttaatccagaaccgattaaattcattgcatatacagctggcatgcattctggaaattgtgataatgcattttcaaccatgaattttgaataatctttttgagcaatagagcatttagttttattattgatagctccaattatttcaaaaaattcattttcggctttttctttaaaagaatcagcagcggattggacagctgtccaatcttttgaataccaagcaatctgatgctcgtttaattgaatatcatcttcaaataagctcatatcacttccactgcatttcgcacgctaattgaatgaaaagatatgctaaatgtaattccgtattagccgcaattccatgatactgattattttcgccaacaatttcgtacatacgaataatactctgtggagttacacgtgaatagatttcttcggcaagtttacccacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaatgtaataactcgacagcgtgactgaagtggtttaataataccatcaatattgttagcagtaataataatactacagtttgaactataagcttccataaaggaacgaagatgtcgctgagattctgctaaacctgaacggtcaaattcatcaataacgattactttttgacgaccatcaaatgaagctgcactagcaaaattagtcaaaggaccacgaacgaaatcaattttacagtctgatccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctctattaaaaatcatgggtagaatcagcttcaagagctactacataattcgcatgttcaccttcaaatttagcagcgccttgtttaccttttgcccaaagcagaagtttataatttcctggttgcattttcatatttgccatattgataatgaaattaaatgtgttttcaccatcataatcaccaagagtcaaagaatatttaacacgagtcaaagcagaatcttctactttattaaaaccgttaattacgattttaccttcttttaccgtgatagcaattgtatcaatttgcagaccacgagatacacgcaacagttgttgaaggtcttcagctttaatttcagtaacaacagatgctaccgggaatggaattggtttattaggagcaactactgtactcggatcggctgctggccaaaaaattgttgagcgggcatcagcaattttaatatttccatcttctgactgggaaatttctgcatcatcattaactagagacagaataccgagaaaaccgttcaaatcgtaaattgctacatcaaaatcaataacgtcagaaatatttgcttccgcataagttgtaccattaactgcgcgagtcataataaattgaccggatttaagcataataccagagttaatagtagcgaaatttttaagcagagcagtagtatctttagacagtttcatgtaatttccttcaattcaaatgagatttaattttataactaatttaataaagcaattaacgattaaaatcagctgcgattgtttcggcaacaatttgagcggcaacaatcagacgttcatctgcattgccacaatattcatcttcaaggcgttcaccacatgaagtcataataaatttagcaccagcgtttagggattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcatttctattggacattatttttgtatattctgctttaaatgcattcctaagcatagattcagtaactatatgctcttcattagaaaaattatttctcagaatatatcgttttatttcaggaatagttaatagatgctgtccggttgaatattccatgtttttcctccatagagattatactctaataaattaaagcataatctcttataaattaaaccattacagtaaatcgaccaactttcttcatttgaagatgctgaccgtatgcttgcgggtcatggtctctatgcgaaataacaaaaacgttagtattttttaaactatctaaaatagttgaaatagcttttacaccttcaacgtcggtcgctgaatcaaaaacttcatcaagaattagtgtgtttattttaacacctgaaactttttcagcaatatcacgccaagtaaataaaagagcaatatcaattcgtgctttttcaccttgactgaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagccgctttaacttttttagctttatctaccgtcgtgattagagattgctttttattgcggatatcatttgccaacgactgttgggttttaatattatctcggtattcatcaacaagaacttttaaattatcacgatgcgttgaaagctgttcaaatgaatgtgtgcattcagaaactttatctttaattttagaaacaactttatcaccggaacttaattgtgacaaacaggttgggcataatccaccttcgtgatacatattaatgactttattatacgagtcaatttttgatttaattaaaactgcttcttgaccgattttattaaatgcatcagtcgggtcttcgtctaaaacaatattaactaatctttcattagcttcttctatttccgattttagcgttctagcttcttttgccaaatcatcatacatattttgcagacgagtaaggttgtcacccgttaattttttctggcgttcaacgttatcattatatattttaatttgttggataatactatcttttttaacatcaagcacttggttttgtgaatttaattcgcgtattagtgctttattaagcttatccatttcagctaatgttcctacctcaagcaagtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcgaaaacgttcggtttttgtcctcttttgatatagtactttttctcatcatattccatccacagttcaactaaaagttctttcttatttgtgctgtttattaattgacctttctttacatcacgaaatggcttgccaaaaagcccaaatgtgatggcttctaacatagtagacttaccaccaccatttcgtccagtaataagagttttttgaaccttatctaattgaatgtcaataggatttccacctactgacattatattttggtacctaactcggtttagtttaaaattcttcacaaaagattccttttaatgtatcttttagaccattctatcatatcatcataatctaaaaagtattcatcaaattcagccatgcaaacaacaccttgtgctgtttttgatgtaatataaattattccaacatatctagaatcttcttcggtataatcaatgtttgctatgaattcatcattaatgtcaaatgtcgaaaacttcacagtatgcatccttaatacaagatacggacatatctcgcaatgatttaggtgtgtcattatctaaaatgttgaagttaaaagatacagcccaatctgtacagaccgtaacttttttaatacaattatcttcaacctctagcggttcaaaccaatattcaataatttctttatgaccaatatcatcttttacttcgcattcaaaatgctgactcatcataacatttttaaattcatcaaaagtcattgtgttgcctctacatataactgatttgcatattgaataagtgcttcacggtcagaatcagtgatgtctggaattgcattaatgtattcttccatcaacgtctgaagagattgaacttcaacttcttcactgtcatctgactcgacagagttatcaatctttgacacaactcgtaatgaatgcacaactttttctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcacctgcagttagtgtccatggtgtcccaatatatctgacgttagcagcctcagagatagtatggaagtgaccagaccacacctctttataagtcttaaggaaatcaggttcaagaccgtgagatttcattcctttataaaaataaaatccattcagttcccagtgaccaacacaaaaagaagcagatgaagttttgatatgctcaagaatttcaccagtattttcttcacacatccaaggaattaaatcaattaaacatccgtcaaaatctactgtagtaggcttatcatatactttaacattaggatatttagccaaaagctcagtagaggcatttggagttaaagtatttttaaagtgcatatcatggtttcctacaatagtatgtagggtaataccagcatcatcaagcatttgaactatttcacgggcgaactccatagttttgtgtgtgattgcttttcgcacatcaaaaatatcaccgtattgaatccaggtagtaattccatttttcttagaatattctattgcttgtttaattccatccaactgaatggattgaacccactcatcatcggctttaacgcctaaatgccaatcacctaaatttaaaattttcatatatcaagaaccgtcattgaaatgcaaaataaaattattgaaataaacccatctggcgtgctaaagaacccaatccaacatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcgcgttcacggtcataaagagttcggtcagatgacagttctttaatacgttcaaatgttgattccatgtcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaactgtttcaggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcgtattcttttgctaataaaaccggaattgaaaatgatttataatcatgcgcacaattacgagtaaatgatttatctttagcataaaccaaagttacttcatgaccatttttaataaaccaatcacgctgctcaagagaaaatttagttacaccgcaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcataactgccaccattttttgacttgataagaatcaacccacactttcatattggggtctgctcttacaataggaggattaacttctttaattgaactatcatggtattctttttcagaaattttcacacaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgtttcagaatatcccgacttttcttgatagcatattcgtattgagcaaaattattgttttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgttggacaaatgcattaaaacaagcttgagttatatacgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaagcagtatgcttggaacactttctccatcatctttttaaattcatgaatatctatgtaatgatcattaatatcagcgcgatataaaaagtctaaaaactttttatgtgtactaacatattcactttcatttaattcagaaacatggctttcccaatatccaacaccagttttatttgggaaaaatgaaattttcatgtattggtcaacatagaaaataccaaaattttcaatagcaatagaaatattaattaatttcatacattcatcaacttagccgcttcaagagctgcatctagtgaatcaaattggtcaacatattcaatcaattcgccgtaattggcatataaccaccattggctaaattcatactcaaggatgaatccgtttccttcaatttgagttaaaccaatgccatttgtatttacttcatatccggcaagacgcaaatcgttaataagagcttcgttcataattataccttagtaattttcaggtctgcaaattttttcttgcgttgatttttcatacgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcagagaaactactttatcatatgcgtaagaattgatggcgtttttaatttgaatagtcatacattatcctcaattgcattaaaattttattatccaaaaagggccgaagcccttagctaaactttttggcacccttccagccttcgtacatcattgcgactgacaatgacaaagctccttcgcatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattaccattttcatcaataaatttaatccagtcatttactaaccacttagttgtatctccttttggagtagcatttaaagtatatagcccttgcttaaaaagcatgcgtttgatattcatattttcctcagctataacgataacactcgtttgatttgcgcttagcaactcgttgagaagtattgtaatcaaaatcatcgtcaatgtaaactgattttttcaactttcttacttcactacgtaattgacgatttagctcatctttaacttctgaatcaatgcctttcattctacgccatttatcagagcgaaaaatgttttcaaccatatctttatgacttacaccatcaggagctttacgctttccgaaatagtcataatcacgtacttttaaatctttacgacgatacgttttacccatggagtttaatttccttagcaactgaactaaatacagcacgatcacaaatcatctgtttatgtaacttgagtataaaagataataaacttcaaaaccgtttacataagtaacacgaacaacattaccattaataaaataatattgtccctttttaatctctttatcaaccacaaccatatcaaatcctcaaaggcaattcatatgttaataataccacagtttgaacttgttgtaaacaactttgtgaaattattttagggaatgataagaagggaacgatagcttagaatggtaatatacagaatgtgagaaagaaaggcccagagggcccgtcttagtcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagtggacgatcatactcaatcttaccattatttgtaagaactttatagaaagtaaaaggagcattgagctcctttagaagttttgtaactgattgacatccaggacaacgacctacttcatctggaattccatagacttcaatcttattctttaagttcgagttttgttccacgagaaataattccttggtaagcccaataaggaggattaacagaatcctcaccagagttttcttcaggaaaataaacctggataacgaagccggattcatcaaaggtgaaataagtagtaggcagttcacctaacaaatcggcacgagcgttgatttcttcgaggtcttgttcacgtccagcccagaagcttgggttcagactacattcatagaaataatagtcattaccgaacatatcaaaaccattccaactctctactacataccgctcaaaactaatcataattaagcctttttatcaagaacagcattcagcttgttagtaattttatccagacgctcattaaactcactagaagataagcccttttctggagaaattaaactaatcacgaaaaatatagcaataaaaggaataaggaaaatagctccaactgccataaacagaaagaatgttacagttgtaagaaaatcagctaaacctttacgaaatttatacatattttacccttaattaattaaccaagcattgataagcactaaactatattgggaataaaattctggaccaaaatgaaaaatcatatcatttatagtatccataatataattcaatttaatcatgtttccacaccccataggtatttgaccaaagtcgctgattatctgatcctcgccacagctttttagtcggaagatttttctcatactttccatcaataataacatcaacatatttaagcatttctagttgtttaatatcttcaaacttatatcctgtccacaaccaaatgcttttattgggataaagattttttactgtttgaacgatgcaatgaatcacgtctctgttatcaggataaagagggtcacctccggttatagttaatccttctatataatcattattcaaacattcaattaattgttctagtgtttcaccagtgaatggaataccatttctagcattccatgttgatttattataacacccttcacatttatgcaaacaacctgtaacgaaaagaacggtcctgcagccaggaccattaacaaaatcgcaaggataaaatctatcataattcattggtgcttaaccctatgcatgatttctttatttttgccgagattaaatccgcgttcgttcggatttcccaaataaccacatgttcttcttattgtgttcatctttttaggatcagtttctccacaaatagaacaaacaaatccgttttcagtaggagtcatttcatgggtacttccgcatgtaaaacacttatctactggcatattaacaccaaaataatctaaatgttgtgcagcataatcccagacagcctcaagaccttttaggttatttttcatatcaggaagttcaacataagaaatgtgaccacctgtcgcaatgaaatgatatggggcttcgcgagaaatcttttcaaacggagtaatattttcttctactgaaacatggaaactgttagtgtaccatcctttatcggtaacatcttttacacttccatatttttctgtatcaagtttacagaagcgataacaaaggttttcagcaggagtcgaatacaaactaaaagcaaacccagttctttcagcccactgtttaagacgagcattcattttagttaaaatttcttgtccaatatcacgaccgacaagaatattcaattcatgaataccaatgtatcctaaagacactgaacttctaccgtttttaaataactcaattatgtcgtcatcaggtttaagacgaaccccgaatgcaccttcttggtaaagaataggagcaacagtcgctttaactccttttaaggaactaattctacacatcaaagcttcaaaacataaatccattcgctcattgaacaattcagtaaatttctgttcattgaactgtgttccaatataagaatccaacgcaatacgaggaagattcagtgttacaacaccaagattattacgtccatcaagaatttcattaccggttgaatctttccacgcgctcaagaaactgcggcaacccattggagaaacaggaatagatgagccggtgatagctttattgttcttagctgaaataatatcaggatacatccttttgcttgcacactctaaagcaagctgcttaatatcatagttcggatcgtctttataaagattaacgccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggagtctgtccgtttgaactaaagagagtatttacttcatattcataagcttggaatgcatcgtatacatctttttctgttttagattgagcataatttaacgcatcagcgatttgccatttttctgcatcctcaatatgttttgcataggtgcgtttaacataaggagaaagtactttatctacattagcaaaagtcgttccgccgtattggtgagaagcaacctgtgcagtaatttgcgccataattgcagtagcaacgccaattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaattgtgttttggtgtcagattcattatattcaaatcctctttgaagcatctcggccatcatttcctcttttcctaaacgagaaaattcctttgatttatctccaacaaagttaggatgaatattattttgggtgtaatcggattttaaataagtaagtaaattttctaaccattcaagataatcaacaccttgtccctttaagccagaacgattaaatttgtgcttcatttgaccttctgcagcattgcagagattacaaagcaatccacgtacctttcctgcttttggtccatttaattcatggtcatgatcaagatgattagcttgaacgtcaggatttagttctcgttggcaaattaagcatttaccattttgtgcatcataaaatttttgtttttcttctttgtataatttgccagtcaataacataataaatacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgtcctgtcagaaaaagaattttgagtttttttcaagtattgtaaaacatttgatgcaatcgcttatattgccgaatcttttggtcagaaaaagaaatttgagtttcaagccattcaatgtactctgcggcagcttgcatcaggttaccttcatagccatcgttattttcttgcgcagctaatttagctaatgcgtatgaaatacgttcaccttgaaaagcggctttaggcttctgaacatcttggctagttctctctacaacttcttcaatttcgccattttcaacggattcagtattccacaaacaccagtatgtaattggcttatcatagatgttaataatctttccgtcggaaagttcaatttcaataattccagtatcaggttctatatcatcttcgcattcttttgcaagttcacgaactttaaagacagtacctgcactaagttccggccagtaattacatagccctgtatcaacacgattaattctaaaccacttatctactgtaatcatgtcccatctccatatcaattaagtcatttatcgttggttcattatatactgtttcttcatcaatgtaaaccggttcttccggctctggctctacagtttcccatctagccgcccaccaaggtttaaccccgaagcttattaagttcttcataatcaatccaggattctaatcctgatggcaaatcagattcaatttcccaaagaagctcttcaattttctgaagacgatctagttcttcggctggaatagtaaccattgacggagttcttgatacattaatatcgtaaatcatatttaccccaatttaaccatacaatcgccgtatttccacttagaaatagacttttcaccattagaataataaacttcgagtttagcacgattatttttaatttgaataaccttggctgtcatcaaagttccatacccataataaactgcaacttcatcacctacatataccgcgcttccgcggtaatcatgaatatagtcagttccttcgagcatcatttaaaatattctcgcagttggtcaaatccaccaatatgacttccatcaggagcaaatacctggggcattgtcaagccgatttgagtatcacgacctagtttagtcagaagctcagcaattttctcatcatcaaaaacacctttttccggcataatgttgataaattcaaacggctgtttcttcacggtcaaaagacgttttgcattatcgcaatacacacatttatgaatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccatgttcattataataagctattgctaattcacggactgccttttcagcagcctccatatattctttacgcttggtcatttttaatccaaaatattattaggcattggttgaacactcacaagttctttaaagaactcagtagagtcaggcaatttaaccatttccggagcatgcttactgaatttatgtttacattgacggcatttatattcaagctctggtttacgccagttaatcaattgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgctttggcggttaaagccttaagaactttagtatactcttcaatctgtttttcaacttcaatcaaacgggcactgagatattcgcgttcttctttcatagtatcatttccatgattggattttggtgtaggtttaaattcactagggtcctttaatttaataacaaatttagtttcaaacagcgaaagaccataattcgtattatcatcaaaggatttgactacatccatatcagataataacacgcgtaaattataagccaaagaactaatagtttcattgtgtttattagcttcgcgtggtttcatatacggaaggtttttatatatctcgtgcggagcacaaatgataattgacaattcaaattgcccattctgggacgatggagtgaatttagccgtaacccagtcttttacattcacattaatagtacggttatcaccatgacaaaacagtctacgagaatgcttaaaaagcatattcacgttattattgaattcgtgtgaaaattcactagcaaatttttctttactatctttagaaaaccattcttctaaataagttcttttcacgtcgttaataatattaaatgtaacaacactagcatttgatacattagtctcaatgtagcttggatacataaattttttaacattattaacagctatcacagaagatagtaatcgggaacgtttgaaccactcgagcaaagaaccaagagaatgtgaatacgcattttgtgtatctttacaaatatggttttcccatccaatatagtctaaaaaatcacgaagaatattattgattactgctctgtgtcctatctgataattacgatgtttagtaataagactgtcaaaataatcaatataatgtttacgagttttcatgttcttctcacttggttaatgatttatactccgagccatccttggctttaaattacttaattaactgtaaagcttgttccagacgatcaagacgattaacagattcttcccaaatccttttagcctgctcatattctttctgcgctttattagaaatttctagaacttctttataagctttttctagtgcaataacttctggacgaatttctatcggttcaggtgaatcatcaagacattccattagttcctcaagggtagtttcttctttaggagtattcacaatttcatcacatttttgttggtaaatttctttatcagtaggtgaataagcacatttcacttcacgaaggctaattacgagtttatatccttcccaaccgcatatattcttaaaaggatatgtatgaatattttctactgtttccatacaaagtaatgcggtctctaattgacgagttatagtgctagcaattgagaaaaatttattaatattcttttggttagtttctggtgtaaaaaatccataattcacaaaaatagatactttatttttatcaagttcatattcttttatgataatcatatcagaagccaaaggatgaatttgacgataatcgccataacataatttagaagctgattttagaatttgtttcttaaaaagtctgaaattactgatccaacgacgagtaaaaatattctcagggtcttctttaatattaagatgataagaattaacatcaccgaaccaattgtatcctactacatctttagttcgtttaatttctttcccaaaattaccaagaatatcccgattaaccaaatatgaaagaagacgagactctttaaaggttttcttgataacatctttatctacacggctagaaattttacgaatttcatgaataaatttagtagaagaaacaatacttgcatcaacactattgagccattgattgataatagaaagaacgctattttggccaaacatcggtatagctttatcatcaataacgctattgaatgatttgatatattcgttacgagtcataataatctcctcagtagaaagtaaaaacattataccacatccttgtggcaaagtaaactagttcagtgcatttagtgcattgttcagtttagaacgttgctttgtcagattttgaacccttgactgagcttgttctaacgccttttcagcttctagcacttcattggtcgctttaacgagttcatcatctactgccttaagagacttctcaatcgcgtcagcgtgccatttttctacaggtttaaaatttgaattttcagtaggaagaaaactcactttattaagtttacatgcatctatattgcttgagctatacatccaaaatttaggatcgtttgataagtaattggataaatttaaatttaaggtatcttgcacttcctgctttttctcttgaacaatttcatcctttctcaaaaattcatatttaaatgaaacgatcatatcaagttcatatgttgttgtatgttcccaatttcgctcaaaacgaggtaaaatcttagattgaacagcagcaacaacatccatatacttaaatgcttctgtcagctgtgatttaagacattcacaaattgaaagagaatttttagtattaggcttaaagctaattcgtgcagttctattattttcttttaacggtcttacttccatctgaagagtataaccatcaaatttcaggttctttaagttaatatcagagccttttaatcgactagcagtagacaaaatttgctttaattgtttacggaatagagcaataaatctccattcaatacgataatgatttggattgaaaaatccagatgataaatcgaccttactttgaccaacgccttgaacaatcaaaggatttttataatcaatagttttacagaaatcggtgagctgttcacgagcagtcatttgtgtaatataccctgctttactaaaattacgcacccattcactgctattcgtatacttaaagtgatgaataacacgattaactttatcagggtctaaattattttcacacaaaaatgtcataacatcacgagtatagctggcattacgaaccatatcttcaatttgagaacgagttttcatggtgttccttaagatttaagtaaatcaacgattttaattaatttttcacgctcagatttagctttactactcaatccagatagtctgaaaatttcatcatcatattgctgaatagaaatatttagctcttcaatctgcttattaaaataagcaatttgttcagaatgtttttcattactgcgaactggtacaggttttgtaggtaatttagttgaactggattcatctgggcgataaattaaaatgcaatttgaaccaatcggacatttagcaccagacacatattctaatgttccggcttcttttaaaacttcaaaagctaaacagagatgatgccccatattaacataatctgtagagcgagctctgatgtaataatcatctccacgagtactaaatttaaagcatttaaggtcttctgtattattggtcttaaaaatcatttgtttatctagacctttagctaatcgagcgcctaatgctaataatcgtcgttgattttcccacaaatccgcaatcatttggtcaaatgataatttcggcattagtcgaccataaaggtcatatcctttattataattgcgaaggatttcactcgcattaatacgagacaacgctccaattttattaagggctttcatgatgcgattagataaacccattccagatccgtttgttcgttgcaaatgtttatctaacccaaacccaatatcaactttaaatttatctaaaatttcagcgtgaacatctctgtcaataacattcaaatccaaagttgggttaaatctatgaaaaaatttatctggctctccacgacgaagtacagtccattcatttaattttttattaactaaagatttaattactgcattgacattattaattactactgacatattttcctcactcaatttcaattttactaaatatacagaataagatggaacagactatataagcaccacacacagattgaactaataccattccaaagaaccaaacaatattatcaaacaatgtctgttttacgtcgaaaggacgtaaacttacagtaatattatcacctttttctattgatgaatacatctctggggaaatatattcactaaatctataaccatctttgagttcatatacggcaataaacgataaactagacccttttccttgtgttcctgtaatggtattaactacagtaacatcataatctttataatgcatataatcattaattgcgtaataaccatatgcaattgctatacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttgtaagtttcaatacgctctgaaatgagagtgtatcgttcatttactgattctttcataaaatcaggaatttcacgagaagctttaatctcatcaaatttatcaataacagcttgctcttcagcaattaagttatcatacatcaaaatatctttcttgatgaactcaatatcttcttgagttacacgagataatttagatgctttatcctttttgtactgttcgttagtatcacgagaccagtgtaatgtacgatttttattcgtattcttgtaaatttctacaataccaatctcatcgataataacgatccaattccaacgagatttgtaaatttgtcctccgtcaaccgtgatttcacctccgattgagatgtcattaaagaacttactttgtgcttcagatttaaatttaccatcgttgtaatttaccaggttgaaaatatctttagcgttcattttgtgttcctccgtagttgatagttgtatagtaccacagaggaacagtcttgtaaaccactaaaagaaacttctttcacaattttttccactgaaccatgcgcttaccgctttcttagtctcaggagcagtgttatccataaaccattcaaaggcagcctttttatgattctggagggcttctcgggctttaatctgctcacggtctattaacactaacatatgagcctttcttgtcaccatgggcttcttatgattttttgaatactcccagtcatttgtccatcgcattgtcgttgcgaacttaaatactgcttctttaattttagtttcgtaaatttcacgagcctttgagtataacatcattacctccattcaccagtttaattctagtcatctttttaatggcagtccatataatctatttctgaactgcctttttgtcatagaagtcctcttatgaattatttcagaagagtaacctcagcaatttcttcccaaccgtttttgtcggtcataataaagtcagcaagataaagagcagtacgcagtgaaacattgcgtaaacgattaacattaactttcatccatgataatgctttataagtttcttcatcagaaagaccgcgcttttgcatcatgtcagttgaaagaataacatcttcaaccctgaccataatttcttcattagtgtgaacacccaaatccaaataaaccgagcgggacactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagatgcggtgctccagcagactttacgggtctctccagtgtccagagcagctttcagaagattaagaatgtccatatcagagaaaacatccacatcatcaatcaaaaggacagaattctcttcacgattattccaaagttgttcataaagaccgataccggagattttaccgttaatgcttttatattcaatgtatccattatcatttgctttattcaaagctttatctaaagaatacgttttaccaatacccgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcacctaagagctcaaaagttccagagatttctttaccgaagtagatacccttattgatagttacagttttcattttattctccaatctcacatttgttttgatagggtaatagtatcacactactacccttctgtaaacaatttattttaacgttcgccaaatttttactgcttcacggcgagatacttctacagctccaagttctacagctttttggcgtcggcgagcgtgtaagtcataatgtttaatgcgtttatcttgaaaccaagaacgtttcattcctattgcttctgccatttcatgaagctcttcaatatctccatcagtgaacatatgacaatttttagttggatgaccgcgaagtttccatccatgattcattaaaacatctacgtaaactgtcattgattcttctccaaataagtttcgataattttctgggcgagataaaccgcgttatcttcagttgcgtcttctaagaaactttcaaaacactctgaaatttcttctgtatcaatcaacttttttacttcaattggtgtaattttcattttgttttccgtttaagtgtttgttttgatagttgtatagtaccataaagctttatgcttgtaaacagttttgtgaaaaaatttttaaaataaaaaagggagcccgaaggctccctatcatttataataacttcgatggttttcaagatagaccttctcaaggaagtcatcccagaaactcatgtctactttttgctgcataccgttcttagaagcttcagtagatgctgcttctacttgatcgaccacatcttccaaaaactcttgaaccgttttaaatggatgtttacccaacttcacgtcgagaataaatggagcatcttggagtggataaaccaagtcaccagttttgtaaatttccaatagttggagtccaccacggcaagcatgactcagagctttccagtcaataccttcattggcttcggccttacgagcgcgttcaccatattcagcatctaatttgttcagtgactgcttaagctcaataagagaaagcgttgtctgatatttacgacccaacactgtgtagaacgtctgtgggcctgttttctcatgattatggaacacccattcacagaattcgttttctggaagacgatgcttaatatcttcaactttagtacgacgctgcttaatagaaccatcttcttggtaatcaacccactgctcagggatttgattaactactttcaatacatcacgtaatgcagccaaacgagaacccttaacgccgtatttagaagcttgcttacggacatatcctaaataggatttcatgttagtcgtataaaaacgagaacggttgtcttgaataaacttccacacatcaggcaaatcagatttaaccactaactcaggtggagtgtgaagcatatctaacgctacagtttcaccatctgctgctaatttaaagaaatatttaagactgtatagttcatggtcaatatcatctttagtgtttttagatgatgtgttgttagtgtttttactcatatgctctttaacatttccgataagaatatcgcgagcaggaggaacaaagatttctttaaaatctacatcagattctggagtagaagttccataaagatgactaccaaaatagcttttcattactgttttcatcattcagccttatattcaataacaggacatactttagctttacgcgcttttaaaaattcgacgataatagatttcttgggttgaataggaggtaaacctttatacgccctatcaatattttctacatgtaaagcataatcctttttccatttataatctttatatttttcatgtagttgtgcaggaataacaaatgaaccgataataagtaaaacaagcaaaatggcaagtataaatgctgatggaataagagtccataaactaccaaaaataagccatttctgtatgatttctgcacagataatagttagacctgcgagtatagtacatccgaaaaaagaaacgaaaaatgtagggataacaatagaccaaaaatatgcacaaagtgtcttaggtcgtttccattcgtcgttaaacattttgaataatttataatgccaagagttttcattaataatcataattatcctttcattgaaggtgtaacagttgttaaatacttaatcatagcttcagcttctgattttgataatgaaatttctccattattttgacgaatagaaataaaatccggatgacggtcaccaccagcttttaaaacacacatataagtatcagtttcatcttcaatatttgaaatgattgaagcagttccacatgaatgtggtttttgataaactaatacagcttttcttccaccatttgactgttcataaacttttaatacatcaaacaaatcacttcttttatcaatagctaaaatgttgttttcatcttcaatgttaaatccttcggatacttcataaagtgtcacccataaatcacctatatcgatagtagcattttcctttccatgactttcaagagcatgacaaattttcttgatttcgtcataactcattttaataatatcatctccttgactaagaaagatgtcatttttaaattcaacacgaattaaaccgcttccacttgaaataaacatatttcctcactttgaaatcatagttggaatgacagaatcaagataagtctttaacgcaatagcttcgtctttggtaaatgtgacaatatgtgatcgaaaatcgtcaatttggcgaatagttaagacatctccctcttcataacattttgatacatttaaaagagtttcatcattctgattgcaagcgttagtaataatagcattgcaatttttgagccattttaaactatgttttctttcattagaataataaaaatatttaatcttatctataaaactatcccaatggataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgcgtcaaacgatacatgttatttactttttctatagccaattcaccaaaaagcggactaacttctaatactaatcgtttcatattaatcctttttattggcacgaatttgttctaaaattttagaatattcctttgtatcagatttacgtacaattgatacactataaggcatactatcggtgtcttttataaagcgttccaaatgacactctaacaaaatttctggattataaatcgtgtacatcaaattacctgttgctccacgatattggcagatttctactgattgaacaccattccataattttgttaaaactaaatcacctacttctaatttaggaaagcccatgttattcaccaattaaagtttcaatataagaatcaagatttactttagcttcttccataagagttttgtatttaatcttgttagcatgtccggagaaagctgattcatcaataactgttgctgtatgaacagctttgctatatgtttcaattaattcttttaattttaaaagcctgctcacttgtcattacatactcctttgaataatatcaataatgttgttcaccagattataagtaaacattgggtaattatattgaatcatcacatacacaacaaacaaaactttcattctcttctccttggcagttgacaagattactatatcataaccttgccaacttgtaaaccattaaatgacgttttcaataaaattctgaagctttgtatgagcatcaaccatgattttcaattcttctttagcgaaagctgtacctctttcacgagaagaacattcatagtcagaaactgcattagcatattcttcaattagcttcattaaaaacatctgcttttcagttttcattattccacctaatcatttcaagatattgaactaacttagctttagatttatccaaatcctttttagctgcttctataccatcgtatgaatatccttcacaatgctcaactgctaattgatatgaatctatttcaatatcacgtgctaatttaatgattttttcaaactgttcgcgtgttagcatacttacactctcgtattatgatcgataatttcatcaagaaacatatctaacgcttctaaagcattatcaactttagcttcaaatttttcaatacctttatttgcaatgcctgccgaaaaccaagcaaagtcactaagttcctcatctgctttgcgaattaaagctaccaattctttaattttatctgcttgttcaattctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattaagtgcttcaattttcatgatgttctcctctttatccgatagttgtatagtatcacagctcaaatggaaagtaaaccggtaaaatgaaaaaagtctcccgaaggagactaatgttattcgagggaaagaagatatttactctggtaaaacatcccagtaatatcatctatcgtgctttgaatggctggaggcatttctttataaatgctgttagattggtctagtatgcgatcaatcattttaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttattttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcgttccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcgcgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcatattcacataagctattaattcgttttctttcttatcaaaccgatcagcaaattcttcttgctgttcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatactgtaactcaaaactattcatttcggtttaccttctttaacgaaatcaggataaggataaaatcctgaataaaatccttcacctttatgattgatgcatcctttattagaacaatagcaccaataatcgaaatcacaagccatttcatcattacataaagcaaaaacaactggccattcacacttttcgcagtgggcatttttaagaatactagtttggctcataaccatgtaacctttaaacaatattcttctacatgttgtttacgacctttcctatcaataaaggtatattcaacgaatgttccaatatagtctttatctacatcatgtggactattaattgggcatttagtacggcaaatgcgttcccattgacgaataatttccactttgtttttaggatcaaacggatgcgggtaatgtactttcataatccaccactattaaatcaatatcaggagtaaacatgtcgattaatttagaaaccttatcccaatcgccgccagcaataccgcaacctatgcgtggaatgtaaattactggtttaaacaaaagggtttctgcctgtagatttaattctatcatgcagtttactaaagcaccataatcaagattaggacccggttcgtattgtgtatacaggttatagcatataccaaatcccgtaggactatgtttaaaaacaatagacatatcgcctaatttatcacgagaaccgtactcggtagtggttttatctatttctaaaattttgggataggctcttgctaattgacccgctacgccagagcccattgtgtggaagcaattgcacccgtgcgcaataatattaccttgaagaaatagggcgacaatatcgcccttgatatattttacaatcatctagtactcaatcctcgattataagaatctactaaacggtcaaccattgaatgacaagcggctttatctttctcctccgcaactgaacattctaaggtattccactttttagcatatcgttttaacaatgtatcatttttgtatctgcttgatttatctctttctccgtctttatatgcatatattaatttctgcgcaaattcagcttggcatgctttatttttcccgcaataatccgctgcagtacggtttacatactctctaatttcagtatatgatgtatctgctaacacagaaaatgaaattaatcctatacataaaaccaaaattttagtcatttactatttccaaaagtttattatttttaaggtaattagccttttctaggacttcagaagcatatttagaacctgctttaacattccatcccgaattataagatgatattgcttttcttatatcacccttatgtatatttaaccaataagaaagttcaatgtacgcccaggaagctgaattggaccgtttattcaacattctttttatttcagcatcggtcatattataaccaagttccttgactctcgctcgcatagtaggcaaataattttggaacattccataggcatgatgctttggtttagattttaaattaactccggcagagctttcttgccacaaaatagcagccattatatgacccaatccgctcttatggatgtttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctacattgaagtgacgggtctttgaacttcgcgttaggtttacaaactgtaaatccaagccaaagatttccatctgtgatttctaaacgtccaggacgatattcaaccccatcaataaaatcctcgtcaatgtcaggacgcggaggcatactcaggaattcattaacttctaaaacatggtcttttattttatggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaagtgacgacgaagcttatttcgacggataaaaacttctgtattgatagtcatgttattctcctcttaactgatagaaaaattataccacagtcaagaggaaaagtaaacagttattctttaaatctaatcaatttattcatagactttgaaacttctgcacgaacctcatgtagatttttgagctgttcaagacgctgctcatagtaagcaatttcatcttcttcgagacagtcctgtgaatcttctttaagataacgtgcatagtcctggaaagcgttacgaactacttcctggaagtcatcaagactttgaattttcttaggagcaacagatacacgacgaggggcagtataatactcataaccaaaccctgcgcttaattgagccattagtatttttcctctggttggaacactgcgcgacaagcccacatactggcttctttgagtttcattttagcaatagttaactgatcgaggctttcggcgtaattcttcgcgagttcatcatcttcacagctatcaaatgcttcccagaattcatcatataaagcatcaaagataagccctaaacgaacttcagcatctttgatagcattcactttactgattttatcgtcagtatgtggtttataacctttaatgtcttcaatcatattttacttcctcacctgttcccaaatcatattcaactaaacgaataggttcatgaatgccatatccttgaacagaaatttctgtcgtaggataaattccattaatatcacccatgttccatgcttcgttaaattgctgttcgcctgaattactaaaccactcggcgaaagcatttagcacatcttcagaaccttcaataattatctttgccattacaaactctcggtgaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattaaaaaataaatttatccaagattgttctttaattaaaaatggctcagaatcatatgccattaaactctgtgtgattagtcctttaaaaggcccatcaataaattccatggtaaaatatggaattttattcattagccgtgcattaggagccgtgcacaaaactctgcatcctttgaatacgcctttttgtaatttgtattgcttgggataaaattcgctcaaaatgttattttttgccaaaatttcaaaatgattcaccaatttatttttaatagtttttggcgaaaaataaagatattcgaaaagctgagtgtctgtcatcattgcattccgattacgaaaaactgtggacgagtaataccaccaatgcaacatttaatattacagcagcagtgtacagtgtcaatatggacactataaatcttatccatatcaggagatttgacaggctcatcaattatatacaaaattcgcgaaagcgataaacctctgaacttgcttcctttattaccaataaaactgcgcacagaatcagtaaataaacgaaaacgtatatcatcattagaataacgcgaaaattcctttttaatattatctgcggaaattttagcgtaagctgaagtattagaaagaacaataactgttccaccgtcatacaaccaattagcggcaaaattagttactgcagttgatttaccagattgacgcccaccatctagtcgaagtgtacaatactgtttaagtaagtcttcaaatggcgggatatattcgtttttacaaatttcttctactctagcatcagaatggtgtgtaaaagcattcatcagggatagataaggaccagttaaaaatgttctcattttgttctctctaggtttgggccattccatggcgcatgaattgtccatttctgtatttacccattaccgcacttgggctcgaccttattacaggttggcgggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacacgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaggtgtttgattataccatctacttttagctaagttaactgctgcttcatcccagcgtttttgctggagcatgcgtaaagaattagtaaatcctgctacgccggtttcccccatttggaagaccatgttaatcaatgcacagcggcgaacagcatcaagagaatcataaactggttttaatttagcatttctcagaattccgcgaacagcagcatcaacatcctgattaaagagtttttcggcctcatcttttgtaattacaccattacaattacgcccaatagctttatctaattcagatttagcaacacttagtgatggacttttagtaagcaaatgaccgatgccaatagtgtaatagccttctgtgtctttatagattttgagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaggtcttctagaaggtctggattataattgctaaaaccggtctcttctaagcattctctttttgcagcttccagtgcattcaaatcagaactttctacacgtccctttggaatatcccagcgatgtgccatcattccaggcttacgagaaccagtaacccgacccataaataaatctttatcttctgtcatgaagataataccagctgataatgttttcattttaatttcctgcattcagtgataaagttatttaaattttgagtatatttcttttcatcaaaaatcttttgttgtctgcgtagccgccatggcatttcaatgaacgtgtaccatatcccagataatattgatgctgtaaaaatattaacaagtatggttaaaagaatccaatctcctattctgtccattggattttttataaaaaagtaaaatacgaatgatgacacaggaagactaatgatataccacagaatcataatcttatctgtgaaccattcagcattcgttaacttagcacgaccattatgaatacacacgaatttatcatctgttacagtagatggcttaactgcttgatatcccattctaaactccctaattaatcgtttctttgtatcttcagaacagccgctccagtcaactctatcaactgaaatgccatcgtccccatcatctaaatcataccagcgagtttttaaaatcatttaattttcctacaatcactcacaaactcttccattgattctttttcaatataagacatatagctattatattcctttaattgtattttgtaatccttttttctttgccaatttattttaaaattatcataatgaaaatataacatggtaccaaagaatgaaaataatgaaatcgctatagtaaaacgaagttcactccaaacctctgttataattactgtgccgtcgatatttaaaataaaacagtcaattaacaatccaataagactacccgcaagagctgtaaatactgatacagcaagaattaatagtgcctcaggaaacgaatatttgactttatttagttttggcttttgcatcgtgattccttaacaaatttcataatttcatcaaattcatacatatctagcttaagctggtgttcctttttaatctttttacactgagctttccaatcacgtacacgtttacgataatgtcttccttgataccagtatcctacccaatttacgggtactaataaaagtggaactattaatggaagaattagcattaacacaagtatttcgccagaatcaatatcagtcataacatctaaaacacctccaataatcaatagaattacaaatgatatgagtataacaggacctattaacacatcagtagaaattatctgacgctttggttcatacttcacaggtttacttggaaggtatagtgatggttttgacatattctctacattccttaacaaatttttctagtaataaatcactttcaaaattgggattttctacaaatttatcaaaaagatcatcaacaatagttaagatattctttttactaagaatacgtttattttcatgcttcgtttcagaatcaactataagagtaaagaaatatttcttgccctgaaattttacagtagtatcaatataaaataaatttgacttttgtaaattacgtttaaaccatgcgtcacttaaactataaacaccgagataatcaaaatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatgcgtttaagagcatttagtaattggtctggaacatcaacctgtctttggaactcttcaaacattgaattgaaatcactttgcattttcattttcattcctatttactccaagtataaggggccgaagccccttatcattatttcagagaattaatgtattcctgaacatcggcagaggtagtttcaaccccagaaatattaccgttaaaggtttcaactcgagcaagggtatcttcaatatcaaccttagtcagtgctgcaatttcaactacatcatcagcagtactaattccaagggcatttgctgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcgtcaaattataggctcataatatctcaatcatgagcctgcgtaaacttatttcatattattgaaatattcttctgcgatttcgtcgttatcatggtaaactttagaagacagtttaacataaccttctgctgtgaacatattaatcacaacttttacagtataccactgaccgtcttcattacccattactgcgtaagtttcaaacatcggatgatcaggatcgataactttaatatcattcactgtacgaccgaaatattctgaaacgcatttcataaagaagttgaacagttcgccgtaattatccatttcattctccaagttgttttctgtatcagtagttgatagttgtatagtaccatggaagaacagagatgtaaacagttttgtgaaaaaatttttagggaattctagggcagggatgggcaattaaaggataggataatatattataaagggtataaactaaatgatgcctagagaggtccagaaaggcctagataccaaaaagccctatcatttagatagggatttaaaattatttacctagtttacttattatagcttctgcagcagcttttagcttagatgcagtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccacttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtaacagcgttatccgagtgattcaaactaaaaagccccaacctttcggtcggggctaagaatgtcatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttacccgaagcctttgcaaaagcagcgccagtagcaactaaacttttccaggccatactaactgcatttcccgtaaatccttccgctttcatgtcgcgtgcaaactggaatcgcgattcatcagaagcatctttataggaatatttacccgcggcaatggcagcttttgcaacagcttgaatttcggtgctagatgcttcatttaacaccgcttcatttaaaaattgagtatatgatttcatcttatttcctgttttaatttgtagatttaatatactaatatttataccaaaaagccccaacctttcggtcggggctaagccttgcggcaaccttgtcggggttccacctgctaaggcaagtgtttgtacgaaacgccgggattcgaacccggttattaagtagttgacgctactcaatatttttaaaaggccatatctcgaccatatccgaacgttccgtcaaaaacgctactcggcttacggcaaagatatttcctcgaatcgataattcggtgcgccgtttctgctgtgatagtaaagagccagaacacagtaaaactgtgggaggaaactatactccagggaacatcagtccgacgacttaccggtagcgacccggtttcttaatattcttttaaagaatcaatatattcacggcgtttacgccacaaatcaattgcttcatacgcggattcagcatttcgaattagccggcatttatgtaaagacttatgattttgatattgtgtagatagcggaattgtatctaaaaggtctttacgatcaaaatattcgtaaccatctaaaccaaatgaacgatttttgagaaattgccaatgaccatattcgttttcgacataaacataatctgcatgctgataaagcaaattaattacacgttcagaaataacagtatcattatgattaaaatagaatgttaaatcatgaactactaaataaacattacctttcatattttcctcacttataattggtcgaggcagtagggatcgaacctacgacctaggacttagaaggtccttgctcttccttctgagctatgccccgtaattggggtgaccgatgggagtcgaacccatgactacgagaatcacaatctcgagttctaccaactgaactacggccacattaatacctactccaacaatcaagatgtcttcacacgaaattaagagaagagtgatcagttcaacccctataatcgcgtcaagtagatattaatgtgacagttgtcacaaatttggcggacgtgataggattcgaacctataaccaatcgcttaacaggcgatcgctctgccattgagctacacatccaaattggtggggaatggtggagtcgaaccacccgagtcgcaatgataatggatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccgtggcaggatttgaacctacgacattctgctcccaaagcagacgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttggccattctcgcgctgggaataaaggactcgaacctttgcatcctggaatcaaaatccagtgccttaccaacttggctaattcccaattattaacaaaggctcttaagcaagaacccttgatgatagagggtattaatcagtgcgatatgagttaataataacaaataattcttaaagcatatttaccatttataataatacatatttacgatgcattcaagacccaaaggattcttgaaaatatcatattcaagaggacctttttctgtttcaataaagaaatcaaaatttactgtattaaatttacgttcttccttcactaatttaacttgagaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaaaacattttctgccgtagtcaataatccgcatataaatccaacaaacattgaaaaactgaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttgtagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactcttgaataacatatagtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgcccttcgtcatcaaaaacaaacacacctttaattgggcttttaccattaagatagcaaaatgcttgttccataatcgtgattacttctaatttagttagatttaaattagtctcacgatcatagtcaattccttcaaactctttacgagttaagcaaggatagtcggtatttgctgcaaatactccccatgcataagccaatgcatccttaataggaccagcaagttggtatttaactgcagaataattgctcatgataaaatcagcagtagtatcttttccactacgctttacaccgcttaaaaagattagtttcatatgtttctcctcaaatttagttaagattataacacatgaaactgaagcattaaacttccgctataatttttccatctttttctacttgaaaatacgtataaggaatcgttgctgtacatactaaagccgggtctgaatcttctgtgtagctaaattctacttcagacaggtcagaaacccaaggcttataaaaatttattgacatcacgatttcagttttgctattatctaaaatgtaaagcgtaatgtattcaggacctgttttttgggcagtattttcacctgtaagatagttgctagttcctagcatccattcatacattcctatccatgacttaagttcttcatcaactataaatctcacgatgagtggatcgtactcaaatgtagcacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataactgttggtggtataatgggtctaagtcccttccattcaattccatttagaacaaacaacagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccaggtatatatgccttaatcatttggtctgcacccctaaatcctttcacttgactccaatcaatttttaatttcgttttattagtaatagtaggtgtatttgcatattgctttaaaagctcttctagaaactgttgacgagctttaggtggaatatagtgcaagttcaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcgcgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgattcctctttcttcagcaaattgctttccggtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgttaaaattctaaattttattccacgcttttcagctaaagcttgagctgctttccatttgtcagtattaacggaatatgtataaatttcattcataaatcttttcttcgctgcagttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgtcgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctgggggttctggcagtaattctaggtcatcctctgatactactgaaccgacggatcctcctgctccagtaagaaaaactctagttaaaaattacacaaaaactatagttggaaattggagtcgttgggctaataaattaagaagctatgtgtatgagaggtcatagatgtcaggattaagttatgataagtgtgttactgctggccatgaagcatggcctccaacagttgtgaatgccacacaaagtaaagtattcactggaggaattgctgttctcgtagcaggtgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacgtttgctgaaataaaacaaaacctcattgaatggcttaatggccaaaatgaatttttggattatgattttgaaggctcaagattaaacgttctgtgtgaccttttggcttataatacattgtacattcagcagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattacaattcctcgcggaactcgctttttagcatatgcaaaagatacttctgttaatccatataactttgtatctaccgaagatgttattgctattcgtgataaaaataaccaatattttccgcgtttaaaattggctcagggacgtatagtaagaactgaaatcatttatgataaattaacacctattatcatttatgataaaaatattgatagaaaccaggttaaattatacgttgatggagcggaatggattaactggacaagaaagtcaatggttcatgctggttctacatcaacaatttactacatgcgtgaaactattgatggaaacactgaattctattttggcgaaggtgaaatttccgttaatgcttctgaaggagctctaactgctaactatattggaggtcttaaacctacccagaactctacgattgttattgagtacatcagtactaatggtgctgacgcgaacggagcagtcggattttcatacgcagatacattaacaaatataactgtcatcaatattaatgaaaatccaaacggtgacccagattttgttggggcagatggcggcggtgatccagaagatattgagcgtattcgcgaattgggtactattaaacgcgaaacccagcaacgctgcgtaactgcgactgactatgatacattcgtttcagagagatttggttctattattcaagcagttcagactttcactgattctactaaacctggttatgcatttattgctgctaaacctaaatcaggtctgtatttaactactgtacagcgcgaagatattaaaaattatctcaaagactataatttagctcctattacgccatcaattatttctcctaattatctttttattaagactaatttaaaagtcacatatgctttaaataagctgcaagaatccgaacagtggctcgaaggtcaaataattgataaaattgatcgttattataccgaagacgtagaaatttttaattcatctttcgctaaatctaagatgttgacatatgtagatgatgcagatcattctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgatgttcgtatagtatcaacagaccgagattctaaaggaattggtaaagttattattggtccatttgcttctggcgatgttacagaaaatgaaaacattcagccatatacaggcaatgattttaataaattagcaaattctgatggacgcgacaaatactatgttatcggtgaaataaattatccggctgacatgatttattggaatatcgctaaaattaatttaacatctgaaaaatttgaggttcagactattgaattatattctgacccaaccgatgatgttatctttacccgtgatggttcactgattgtatttgaaaatgatttacgtccgcaatacttaactatcgatttggagcctatatcacaatgacagtaaaagcaccttcagtcactagtctcagaatttccaagttatccgcaaatcaggtgcaagtacgctgggatgacgttggtgctaatttctacaaaatagtagaaatcgctgagacaaaaacagactcgggggaaaatctcccgagtgatcaatatcgttggattaatttaggatatacagcaaacaatagtttcttttttgatgatgctgatccactaacatcatacattatcagagtagctacagctgcacaagattttgagcaatctgattggatttataccgaagagtttgaaacttttgctacaaatgcttacacatttcaaaacatgattgaaatgcaattagccaataaattcattcaggaaaaatttactcttaacaattctaattatgtcaattttaataatgacactataatagctgcattgatgaatgaatcgttccaattcagcccatcatatgttgatgtttcatcaatcagtaattttattattggtgaaaatgagtatcatgaaatacaaggttccattcagcaagtatgtaaggatattaaccgagtttatttgatggaatcagaagggattctatatctttttgagcgttatcaacccgtggttaaagtatctaatgataaaggacaaacctggaaagctgtgaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagtaatgcacctatagattctgacccgttatcaccaacatactcggaaagactttttgaacctgatacaatgactataactggaaatcctaaagcagtatgctataaaatggattctatcggtgataaagtttttgctcttattattggtgaagttgaaacattaaatgccaatccgagaacttcaaaaataattgattctgctgataaaggaatatatgttttaaatcatgacgaaaaaacatggaaaagagttttcggtaataccgaagaagaaagaagacgtattcaacctggatacgcaaacatgtcaactgacggtaaattagtttctctgtcttcgagtaattttaaatttttaagtgataatgttgttaatgaccctgaaactatggtgaaatatcagttaatcggtgctgttaaatatgaatttccccgtgaatggttagctgataagcattatcatatgatggcatttatagcggatgaaaaatctgattgggagacttttactcctcaaccaatgaaatactacgcagaaccgttctttaattggtctaaaaaatctaacacacgctgttggataaacaactctaatagagctgtagtagtttatgctgatttaaaatacactaaagttatagaaaatattccggaaacatcaccagatagattagttcatgaatactgggatgatggtgattgtacgatagtaatgccaaatgttaaattcacgggatttaaaaaatatgcgtctgggatgcttttttataaatcttctggtgaaataatttcttactatgattttaactatcgtgtgagagatacagtagaaattatttggaagccgactggagtatttttaaaagcatttttacaaaaccaagagcatgagactccttggtcaccagaagaagagcatggattagctgatcctgatttaagaccattaattggcacaatgatgcctgattcttatttgttgcaggattcgaattttgaggcattttgcgaagcatatattcagtatctttctgatggatatggaactcagtataacaatttacgaaatttaattcgtaaccaatatccacgagaagagcatgcgtgggaatatttgtggtcagagatatataaaagaaacatttatttaaatgctgataaacgtgatgctgttgcgagattctttgaatcacgtagctatgatttttattctactaaaggaattgaagcatcatacaagtttctttttaaagttctttataatgaagaagttgaaattgaaattgaatctggggccggtactgaatatgacataatcgttcaatctgattctttgactgaagatttagtaggacaaacgatttatacggcaacaggaagatgtaatgttacttatatagaaagaagttattctaatggtaaattgcaatggaccgtaactattcataatcttttgggaagattaattgctggtcaagaagttaaagcagaaagactccctagttttgaaggcgaaattattcgtggagttaaaggaaaggatttgcttcaaaacaatatagactatattaatagaagtagatcatactatgtaatgaaaattaaatccaatttaccttcttcccgctggaaatctgacgttattcgttttgttcatccagtaggatttggatttatagcaattacccttttaacgatgtttattaatgttggtttaactcttaaacacacagagacaataattaataaatataaaaactataaatgggattctggattgcctactgaatatgctgatagagtagctaaattaactccaaccggtgaaattgagcatgattcagtaacaggcgaagcaatttatgagcctggcccaatggctggtgtagaatatcctcttcctgatgactataatgctgaaaataataattcaatatttcaaggtcaattgccgtctgaacgacgtaaattaatgagtcctttatttgatgcatctggaacaacatttgcgcaatttagagatttagttaataaacgtctaaaagataatataggaaatccaagagaccctgaaaaatccaacacaggttaaaatagatgaatgattcaagtgttatctatcgtgcgatagttacttcaaaatttagaacagaaaaaatgttgaatttttataattcaattggaagtggtccggataaaaacactatctttatcacatttggaagatcagaaccgtggtcatcaaatgaaaatgaggtgggctttgccccaccttatccaaccgattctgtattaggcgtaactgacatgtggacgcatatgatgggaacagtaaaggttcttccatcaatgcttgacgcagttattcctcgtcgagattggggagatactagatatccggatccatacacatttagaattaacgatattgtagtgtgtaactcagctccttacaacgctactgaatcaggcgcaggctggttagtatatcgttgtttagatgttcctgatactggaatgtgttcaattgcatctttaactgataaggatgaatgccttaaattaggcggaaaatggacaccttctgttaggtcaatgactcctcctgaaggtcgaggagatgctgaaggaacaattgaacctggggacgggtatgtatgggaatatctttttgagattccacccgatgtatctataaatagatgcacgaatgaatatattgtggttccttggcctgaggaattaaaagaagacccgactagatggggatatgaagataatctcacttggcaacaagatgattttggattaatttaccgggttaaggcaaatactatccgttttaaagcatatttagattcagtttattttcctgatgctgcattgccaggaaataaaggatttagacaaatatcaataatcacgaatcctcttgaagctaaagctcatccaaatgacccaaacgttaaagctgaaaaggattattatgacccagaagatttaatgaggcattcgggcgaaatgatttatatggaaaataggccacctattattatggcaatggatcaaacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcagcgtaaaatggcagtagcaaatggcactggagcagatggtcaaattatccatgctactgggtattatcaaaaacactctattacagagtacgcaactccagtgaaagttggcactagacatgatattgatacctctactgtaggtgttaaagttattattgaaagaggcgaactcggcgattgtgttgaattcattaactctaatggatcaatatcagttactaatcctttaacaattcaagctattgattcaattaaaggtgtttcaggtaatttagtagtaactagcccatatagtaaagtaactttacgctgtatttcatctgataattctacatcggtttggaattattctattgaaagtatgtttggacaaaaggaatcaccagctgaaggtacatggaatatttctacatccggatcagttgatattccactatttcatcgcactgaatacaatatggctaaattgttagttacgtgccaatcggtagatggaagaaaaattaaaacggcagaaataaatattcttgtagatgctgttaattcagaagtcatttcttctgaatatgctgtcatgcgagttgggaatgaaactgaagaagacgaaatcgctaatattgcatttagtattaaaacaaattatgtaacagcgactataagttcttcaactgtcggtatgagagcagcagttaaagttatcgctacgcagaaaatcggggtggctcaataatgaaacaaaatattaatatcggtaatgttgtagatgatggtaccggtgactacctgcgtaaaggtggtataaaaataaatgaaaactttgatgagctttattacgagcttggtgatggagatgttccatattcagccggtgcctggaaaacttataatgcttcatcaggacaaacattaacagcagaatggggaaaatcatatgctattaacacttcatctggaagagtaactctacaacttcctaaaggaaccgttaatgattataataaagtaattaaagctagggatgtatttgcaacatggaatgttaatccagttactctagtagccgcttctggtgatactattaaaggatcatcgtcatcagttgaaattaatgttcaatttagcgatttagagttagtttattgtgctccaggacgttgggaatatgtcaaaaacaaacaaattgataaaattattagttcagatattagtaatgtagctcgcaaagaatttttagtagaagttcaaggacaaactgactttttagatgttttccatggaactagttataatgtcaataacatcagagtaaaacaccgcggtaacgaattatattacggcgatgtatttagtgaaaacagtgactttggctctccgggggaaaatgaaggagaattaattcctcttgatggatttaatattaggttaagacagccttgtaatattggcgacactgttcaaattgaaacgtttatggatggtgtatcacaatggagaagttcatatacaagacgccaaataaaagtgctagattcaaaactaacatcaaagacttctttagaaggaagcatttatgttactgatttatcggcgatgaaatcaattccattttcagcttttggattaattcctggcgaacccattaatcctaattctcttgaggttcgttttaatggaattttacagcaacaggctggaacagctgggtatcctctgtttttgtgcgaaggcgctaattcagatacgcaagaaggatgtatatctcttggtggcgaatggaaagaatcaaacacagattattctatagaatatgaagatggaaaacctgtcagtcttttatttgatagaaaatttgaatcaggtgatataatcgttataacatggtttaataatgatttaggaactcttttagaaaaagatgacattattgaattaactgatgaccgttatgttagtaaaggatcatctactgaagttactggggatgtagccttaacagattttgataaaatcggttggccaaatgttgaaaaagttgattcttatactagaacgtataattcaatatcatctattttcgacagcatttatcctgttggttcaatttatgaaaatgctataaacccaaataatccggtgacttatatgggatttggttcatggaaattatttggtaaaggacaagttttagtaggatggaatgatgatgttacggatccaaactttgctttaaacaataatgatttagattctagcggaaatccttcacatactgccggtggaacagttggtacaacatcagtaacgcttgaaaacgcaaatcttcctgcgactaaaactgatgaaagagttttaattgaagacgaaaatggatcagttattattggaggatgtcaatatgacccagacgaaactggtcctatatatacaaaatatcgtgaagactacgcaacaacaaactcttcacacactcctcctactaatattagtaatattcaaccgtctattactgtataccgttggataaggattgcataatgagtttacttaataataaagcgggagttatttcccgcttagcagattttcttggttttagaactaagaaaaatgatatttcggttatgaataatcagccggtaggcgctgtaacaatttcacaaatagcaaaaggtttttatgactcaaatgtagaatctgctatcaatgatgttagaaatatggcagagcaacaggttggagctgtattaattaatataagcggcgtatctcctactggcgtgcaacaaaccgactattggtcatttgaaggaactgttactgatacttcagccaaaccaggtgacccagttattgttaacatgtttggtattccagttaaagctactaatggaatgacttcaattgaatttactagtgctgttagaacagctctacaggaaatggttgtaaaatttattgcaattgattcatttgaagaccatcctaccatagggaataaaatacaagttaagtatttagataaccaagaacatatcttagaacaatactctgataaaggaattactttcaaacaagaaataatttctccttctaaacccgggtatggaacttggcaattattaggtgcgcaaactgttacgctagatagtcacacacaacctacagtattttattattttgagagaatagcatgagtaacaatacatatcagcacgtatcaaatgaatcaaaatatgttaaattcgatcctactggatcgaattttcctggcactgttacgacagtacagtctgcattatcaaaaataagtaatatcggcgtaaatggtattcctgatgcaactatggaagttaaaggaatagcaatgattgcatcagagcaagaggttttagatggaacaaataattctaaaatcgttacaccagctacattagcaacaagattattgtatccaaatgctactgaaactaaatatggtttaacgcgctattcaacaaatgaagaaacattagaaggctcagataataattcatcaataacgccgcaaaaactgaaataccatactgatgatgtgttccgaaatagatattcatctgagtcatcaaacggggttattaaaatatcatctacgcctgcggctttggctggtgttgatgatactacggcgatgactccgctaaaaacccaaaaactcgcaataaaattaatttcacaaatagctccttccgaagatactgcatcagaatctgtgagaggtgtggttcaattatcaactgttgcgcaaactcgtcaaggaactctccgcgaaggatatgcaatttctccgtatacctttatgaattctgttgcaacacaagaatataagggtgttatacgtttaggaacacaatcggaaattaacagtaatttaggagatgttgcagtaacaggtgaaacactaaatggtcgaggagctactggttctatgcgtggagtagttaaattaacgacgcaagccggtattgcccctgaaggtgatagttctggagcattagcgtggaacgcagatgtaattaatacgcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggcgattggaataatcctggcgttcctgatatgcggggtcttttcgtcagaggagctggcacaggcggtcatattttaaatcaacgaggacaagatggttatggaaaggatagacttggcgtaggatgtgacggaatgcatgttggtggtgttcaagcacaacaaatgtcataccataaacacgccggtggttggggggaatatagcagaagtgaaggcccatttggcgcgtctgtttatcaaggatatcttggaattagaaaatatgccgactgggataatgcttcatacttcactaatgatggatttgaattaggcggaccgagagatgcccttggtacacttaatcgtgaaggattaattggttatgaaactagaccatggaatatatcattaaactatattattaaagttcattactaaggattacaaatgattgaattaaaagatttaccttttgttgatagcgttcctgatgaaggtcaggaacgtatttcatggattaaaaatggtgaagaaatactaggagctagcactaagtatggaaacgatggatcaatgaatagaccaattgtttccgtgtttaaaaatgttgaggttcttgacgaaaatataggaattcttaaaactgccattgaaacatcgcagaaagatattaaaacaattcaaggagttttagatgtatcaggagatatagaagcactatcgcagatcagtgttaataaaaatgacatatcaaatttaaagacacttactaatgaacacactgatatattaactggaactaataatacagttgacaaaattattgctgatataggtccatttaatgatgaagaaaactctgtttatagaacaattagaaatgatttattgtggattaaacaagaactagggcaatattctggccaagacattaacggtcttcctgttgttggtaatgctagcacaggaatgaaacatagaataataacaaatagtacattattatcttcacaaggcattcgtttaagtgaattagaaaataaatttactgaatctgacgtaggatcattgacggttgaagttggtaaattacgcgatgaacttggtaataaaccagtagattttggaccaaatatttataatagattaaacactatagatgataaacaaactttaataaattctgatatagcagaaattaaatcttctattggatacccagaaaatgtttctataataacagaaattaataataacaaaagtagcattgaatctattaataatgaattaaatcagagtgaaggtgttaaacagcgcttaacggctattgaaacttctataggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctataaaaacgaatgaaactaacattgcggcagtcacgcatgaagtaaatacagctaaagacaatatatcctctttacagagcagcgttcaagctctacaagaagcgggttatattcctgaagctccaaaagatggccaagcttacgttcgtaaagacggcgaatgggtactactttctacctttttatcaccagcataacatggggccgcaaggccccaaaggattttaaatgtcaggatataattctcagaatccaaaggaactcaaagatgtcattctaagacgtttaggggctccaattattaatgttgagttaacacccgatcaaatttatgattgtatccagcgtgccctagaattatacggtgaataccattttgatggacttaacaaaggttttcatgtattttatgtaggagatgacgaagaaaaatataaaactggagtcttcgatttaagaggttcaaatgtattcgcagtaactcgcattttgcgaacaaatattggatcaataacgtcaatggacggaaacgctacatatccatggtttactgattttcttttaggaatggctggtattaatggcggtatggggacttcttgtaatagattttatggaccaaatgcctttggagctgatttaggatattttacccagcttaccagttacatgggaatgatgcaagatatgctctctcctattccagacttttggtttaattcagcaaatgaacagctcaaagtcatgggaaacttccaaaaatatgatttaattatcgtagaaagctggactaaatcatacattgatactaataaaatggttggaaatacagtaggatatggaacagtcggtccacaagatagctggtcattatctgaacgatataataacccagaccacaatttagttggtcgtgttgttggtcaagacccaaatgttaaacagggtgcttataataatcgttgggtgaaagactatgctactgctttagctaaagaattgaatggtcaaattttagcacgccaccaaggtatgatgcttcctggcggtgttacgattgatggacaacgcttaatagaagaagctcgattagaaaaagaagcattacgtgaagaattatacttgctcgatcctccatttggaattttggtaggttaatatggctacttatgataaaaatctttttgctaaattggaaaaccgcactggttattctcagaccaatgaaactgaaatactaaatccttatgtaaatttcaatcattataaaaacagtcaaatattagctgatgtattagtagctgaaagcattcaaatgcgaggtgtagaatgctattatgttccaagagagtatgtttcccctgatttgatatttggcgaagacttaaaaaataaatttactaaagcttggaaattcgctgcatatttaaattcatttgaaggatatgaaggagctaaatcgttctttagtaactttggtatgcaagtacaggatgaagttactttgtccattaatccaaacttgtttaaacaccaagttaatggaaaagaaccgaaagaaggcgatttgatatattttcctatggataacagcttatttgaaattaactgggttgaaccatatgatccattttatcaattaggtcaaaacgctattcgtaaaattacagcaggtaaattcatttattctggagaagaaattaatccagttctacagaaaaatgaaggaattaacattccagaatttagtgaattagaactaaatcctgttcgcaatcttaacggtattcatgatattaatattgatcaatatgctgaagtagatcaaattaattctgaagctaaagaatatgttgaaccttatgttgttgtcaataacagaggcaaatcttttgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcgataaattcacaagaagatgtggccaaggttgaaactattctacctcgtataaatttgcatttagttgattttagctataacgctccatttaaaacaaacattttaaatcagaatttactgcaaaaaggtacaacttctgtagtatcgcagtataatccatctcctattaaaatgatttatgaattgagtatctttactcgttacgaagacgatatgtttcaaatagttgaacagattcttccatattttcaacctcattttaatacaactatgtacgaacagtttggaaatgatattccatttaaaagggatattaaaattgtactgatgtctgctgctatagatgaagctatagatggagataatttatctcgtcgtagaatcgaatggtcactaacatttgaagtaaacggatggatgtatcctccagtagatgatgcagaaggattaattcgtactacttatacagattttcacgccaatacaagagatttgcctgatggcgaaggtgtttttgaatctgttgatagcgaagttgttcctcgagatattaacccagaggactgggatggaacagtaaaacaaactttcactagcaatgtaaatagaccaacaccgccagaacctcctggcccaagaacatagaggttattatggaaggtcttgatataaacaaacttttagatatttctgacctccccggaatcgacggggaggaaattaaagtatatgaacctctacaattagtagaagttaaaagcaatcctcaaaaccgtactcctgacttagaagatgattatggagtagttcgtcgaaatatgcattttcaacaacaaatgctaatggacgcagccaagatttttcttgagacggcaaagaatgctgattctcctcgtcacatggaagtatttgcaactcttatggggcaaatgactacgacgaacagagaaatactgaagcttcataaagatatgaaagatattacatctgagcaggttggcactaaaggcgctgttcctacaggtcaaatgaatattcagaacgcgacagtattcatgggttcaccaacagaattaatggacgaaattggtgatgcttacgaggctcaagaagctcgtgagaaggtgataaatggaacaaccgattaatgcattaaatgatttccatccattaaatgaagctggaaaaattttaataaaacacccaagcttagcagaaagaaaagatgaagatggaattcattggataaaatcacagtgggatggaaaatggtatcctgaaaaattcagtgattatcttcgtttacacaaaatagtaaaaatcccaaataattctgataagcctgaattatttcaaacttataaagataagaataataaaagatctcggtatatgggtcttcctaacttaaaacgagctaatattaaaacacaatggactcgtgaaatggttgaggaatggaaaaaatgccgagatgatattgtatattttgcagaaacatactgcgccattactcatatcgactatggtgtcataaaggttcaattacgtgactatcagcgtgatatgctcaaaataatgtcatctaaacgtatgactgtttgtaatctatcacgtcagcttggtaaaacaactgtagtagctatttttcttgcacactttgtatgttttaacaaggataaagctgtaggtattcttgcgcacaaaggctcaatgtctgcggaagttttagaccgtactaagcaagcaattgaactgcttcctgactttttacagcctggtatagttgaatggaataaagggtctattgaactagataatggttcttcaattggcgcttatgcttcctctcctgacgcagttcgtggtaactcattcgcaatgatttatattgacgaatgtgcatttattccaaacttccatgattcctggcttgctattcaaccagtaatttcatctggtcgtcgttcaaaaattattattactacgactcctaatggattaaatcatttttatgatatttggactgctgctgttgaaggtaaatcaggatttgaaccatacactgctatttggaattcagttaaagaacgtctttataatgatgaagatatttttgacgatggatggcaatggagcatacaaaccattaatggttctactttagcacaattccgtcaagaacataccgcagcgtttgaagggacttctggtacattaatttcaggaatgaaattggctgttatggatttcattgaagtaactccagatgatcatggttttcatcgatttaaaggacctgaaccagatagaaaatacattgcaactttagactgttcagaaggtcgtgggcaagattaccacgctttacatattattgatgttaccgatgatgtgtgggaacaggttggtgttttacattcaaataccatttctcatttaattctgcctgacatcgttatgcgttatttagtagaatataatgaatgcccagtttatattgaattaaatagtactggtgtgtcagttgcgaaatcactttacatggatttagaatacgaaggcgttatttgcgattcatatactgatttaggaatgaagcaaactaaacgaacgaaagcagtaggatgctctacattaaaagaccttattgaaaaagataagcttattattcatcaccgtgcaactattcaagaatttagaacgtttagtgaaaaaggcgtgtcttgggcggctgaagaaggttatcatgacgatttagtaatgtctttagtaatttttggatggttatcaacacaatcaaaatttattgattatgccgacaaagatgacatgcgattagcatctgaagtgttttcaaaagagcttcaagatatgggggatgaatacgctccagttatatttgttgattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaacgaagtagatttagttaatacttttggtcaacctacagctgaaactgctgactattttatgtctgcaatgaatttcttacaatatggaaatgatttgcgagttgtgcgcgctgtcgatagagataccgctaaaaactcatctccgattgctggtaatattgaatacacaatttctaccccaggtagtaactacgcggttggagataaaatcacggtcaaatatgtttcagaagatgttgaaacagaaggtaaaattaccgaagtagatgctgatggaaaaattaagaaaattaatattcctactgcaaaaattattgctaaagctaaagaagttggcgaatacccaacattaggttctaactggactgcagaaatttcttcatcttcttccggtttagctgcagtaataactcttggaaaaattattactgattccggtattttattagctgaaatcgagagcgctgaaactgctatgacagcagttgattttcaggcaaatcttgaaaaatatggaattccaggagtagtagctctctatccaggcgaattaggcgataaaattgaaattgaaatcgtatctaaagctgactatgcgaaaggcgcttctgcattactgccaatttatccaggtggtggtactcgtgcatctactgccaaggcagtatttggatatgggccgcagactgactcacagtacgctattatagttcgtcgaaatgatgctattgttcaaagcgttgttctttcaactaagcgtggtgaaaaagatatttacgatagtaacatctatattgatgactttttcgcaaaaggtggttcagaatatattttcgcaactgcgcaaaactggccagaaggcttctctggaattttaactctgtctggtggattatcatcaaatgctgaagtaacagcaggagatttgatggaagcttgggacttctttgctgaccgcgaatctgttgacgttcagttgtttattgcgggttcttgtgccggtgaatctcttgaaacagcatctactgtccaaaaacatgttgtttcaattggtgatgctcgtcaagattgcttagtattgtgctcacctccgcgtgaaactgtagttggaattcctgtaactcgtgcagtagataatttagttaactggagaactgcagcaggttcatacactgataataactttaatatcagttcaacctacgcagcaattgatggtaactacaaatatcagtatgacaaatataatgatgtgaatcgttgggttccattagcagctgatattgctggtttatgcgcaagaactgataacgtatctcagacttggatgtctccagctggttataatcgtggccagattcttaacgttattaaacttgctattgaaactcgccaagctcagcgcgaccgtttataccaagaagctattaatccagtaactggtacaggtggcgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccaatacttacagggaattaaagctctcggtggaatttatgaatatcgtgtagtttgcgatacaacaaataacactccgtcagtaattgatagaaatgagtttgttgcaacattctacattcaaccggctagaagcattaactacattaccttgaacttcgtagcaactgctactggtgcagatttcgatgagttaactggtcttgctggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagtcggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagagcgctattgttcgtcaatatgctcgtgatgctaaaacagtaacaaaagaaattgaaattaaaggtctgtggcctactaacgtgggtgaacttcaattagattgggattcaaacaatgaaatccaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtagataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggtgctgataatactggcaatatggaagatattcgttggtttagacaagctctttacatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccacttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtaccaatgcttgaatctcatgatggaaaagacttaggtttaaaaccgggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccacggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgaacacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgccgcaggtcagacttctggcgcagtaactcagattggaccagctgttatgggtatggtacgtcgtgctattcctaacctgattgctttcgatatttgtggtgttcagccaatgaacagcccgactggccaggtattcgcgctgcgcgcagtatatggtaaagatccaatcgcttccggcgctaaagaagcattccacccaatgtatggtccagatgcaatgttctctggtcagggtgctgctaagaaattcgctgctttgaaagcaagtgatactcttgaagtcggaactatttacactcacttcttccaggaaactggtacagtatatctgcaagctacagcagctaaacaaattgattcaggcgcatctgacgcagacaaattagatgctgaaattaagaaacaaatggaagctggtgtactggtagaaatcgctgaaggtatggctacttctatcgctgaacttcaggaaggtttcaacggttctaccgataacccatggaatgaaatgggcttccgtatcgataaacaagttatcgaagctaaatctcgtcagctgaaagctgcttactctattgaattagcacaagaccttcgcgctgttcacggtatggatgctgatgctgaactgtctggtattctggctaccgaaattatgctggaaatcaaccgcgaagttgttgattggattaactactccgctcaggttggtaaatctggtatgaccctgactccgggttctaaagctggtgtatttgacttccaggacccaatcgatattcgtggtgctcgctgggcaggtgaatcctttaaagctctgttgttccagattgacaaagaagcagttgaaattgctcgtcagactggtcgcggcgaaggtaacttcattatcgcttcccgtaacgtagttaacgttctggcttcagttgataccggcatttcttatgctgcacaaggtctggctactggctttaacactgatactaccaagtcagtatttgctggtgttctgggtggtaaataccgtgtatatatcgaccagtatgctaaacaggattatttcaccgtaggttataaaggtccgaacgaaatggatgctggtatttactatgctccatatgtagctctgactccgctgcgtggttctgatccgaagaacttccaaccggtaatgggattcaaaactcgttacggtatcggtatcaacccatttgcagaatccgctgctcaggctccggcttctcgcatccagagcggtatgccttctattctgaatagccttggtaaaaacgcttacttccgccgtgtatatgttaaaggtatctaatctttgacgatttaagggaccttcgggtccctttagttgtttttatggtataaataaatcatataaactgaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaattggtgctacttacgccggcgaagctggatatgtagaccgagaacaaatcacagaattaacagaagagtctaaattaactctcaataagggcgatttattcaaatataataatatcgtttataaagtattagaagatacaccatttgctgatattgaagaaagcgatttagaattagctcttcagattgcaattgttcttttaaaggttcgtctattttctgacgcagcgtcaacaagcaaatttgaaagctctgatagtgaaattgcggatgctagattccagattaataaatggcaaaccgcagttaaatctcgtaaacttaaaactggtatcacagttgaattagcacaagatttagaagcaaatggattcgatgctcctaatttcttggaagatttgcttgcaactgaaatggcagatgaaatcaataaagatattctgcagtctttgattacagtatcaaaacgttataaagttacaggaattactgatactggattcattgatttgagttatgcatctgcacctgaagctggtcgttcattataccgaatggtatgtgaaatggtttcgcatatccaaaaagaatcaacttatacggcaacgttctgtgttgcttcagctcgtgccgctgcgattcttgctgcatctggttggttaaaacataaaccagaagatgataagtatctttcacaaaatgcctacgggttcttagctaatggtttaccgctttattgcgatactaacagcccattagattatgtaatcgttggcgtagtagaaaatatcggtgaaaaagaaattgttggatcaattttctatgctccgtatacagaaggtctcgacttagatgaccctgaacatgtaggtgcatttaaagttgttgttgatccagaaagcttgcaaccgtctatcggtttattagttagatatgctttatctgcaaatccttacaccgtagcaaaagatgaaaaagaagcaagagtaattgatggtggagacatggataaaatggcgggccgttcagatttgtctgttttattaggtgttaaattaccaaaaattatcattgatgaataaaacaaagggaccgaaaggtccctttttatttagctcaccaactcaatccaagccggacgaagtacatcttgtaccattttaactaattcctttttaatcaaagaaggattatctgcttgagttaaagtaataccttcacgagaagtttcttccaaaatatcttgaacagttagccccattacctttccaaaatcttttggaccaatttcgccaattttggaaataacgttatttactcggttcaatgtaacataacaagctaaaattccaaccaatttattatcagcttctgacaattcaactttagctttaataggcttatcagactttttcttttcactaaatttagaattcttgcatttgatggctacacgatttccattatgaagccaagaaggataacaaggtttcaatacatatccttcagcggtaaatacttcgcctttggcttcagctttccaaacacatttgttagcgtcaattaaacctgcattatctacggtaaaattataagacggaacaacagaatccaaatcatttggaagtttaataagatcttcaaatttaccacgacccaaaagtggagcgattttaaacccaaatgaattacaaaacgattccatcatgtaatcatcaacataagttacatcaccactttcggtagtaacaataatatcaaacacgtaaaaatctttattaccataatcaacatttttctgaataccaggaccagcaaattcgccaaatacctgataagtcacaacagctgaagtttccataatatcttgtactgctttaatggaatcagcgtaattctttagaataatttcatacccaaagaaatcttcagcaggaagaatcggtccagtacgtttagcgcaagttactttatcacgctcaataatcaatgagaaatttgtgccgtgaatcttttcacgagctacccattcgccgccagtcaatcctaagctataaagtttttcaataaatttagagttgtaatgattttcaagactgctatactttttaaacataattaatcctcaaaatgtaatttctaaccaatcaccatcacgctgatcactattaactttaaagatgaatccttcttttctcagccaatcaccaatttcttcagtaatcaatttatcacgagcagtacaataataactaaaatatgttttaccttgttcagctgctttattagcaagttccgaaaaatctttaataaaacactctagtttaaactgtttgcttttaagtgctttttcgcgtaatcgattagcaaaagattcattttcataaagatcatactgttccatttttcacctttttattgatatgtctttttctatagacaactttttctcgagtttcaaatttattcttagcagtcatagctcgagcccataatacagccacttcttttgcctgtaagttcaattcacgagcaatttcaatgaatgactttccagactcatgaagagtaaacaccacaacctcagttctcataatcaatctcatgttatcgagttggtgccattatatacatcattttctgattgtgttttgtgtgctttcaaaatgaagaaaggggccgaagccccttatgattatggataggtatagatgataccagtttctaaagcagttttatgaatgatgtatccattacgtgattcttgaacatcaacttctggatagtctttcatcatcttctggagagtgtaacgatgcaagtagtacttactatctggatcgtcagttttccaatctttaccttcttcggtcattttttggatttcatccataacccaccaaccacaccagatgtaagctgaagtacgatgtggaagaggatgaacataaggtaattcaccttctggttctggagcaactttatcagttacctgaacttgaccttctgctgtaatagttttgctatcatagtcagtagcagtaacagttgcagtaacttcaatagtttgacttccaatagatgaggtatcaactgtatacacattagtcgatccttctacaggagaagagtctttcttccatgaataagtaatttgcgcttcttctggagcatcagtgacattagcagtaaatgtagccgaagcatcttgttgaacgttaatagaaggaggagtcaatgtaacctgtggattcattgtcttcttattaactgttaatgatacttcattcgaagtaacttccttttcattgtaattttcagcagttacttgggctacgcatttaattctttttactccacttgtagttggagtatagctaaatgtagagttagtttctccaccaacttgtgaatcatctacataccactgatacgtagcagatgctccatcaggttgagaaactaaggcagcagtaaattgaactggtgttccaattactccagctgaaggactatcgggagttactgccaaagtagttgtctgtgtctttttattaacagtcaatgacacttcattagaagtaacttcttttgcatcataatctgtcgcggttacttgagccacacacttaattctttttaccccgctttcggcaggagtgtaattgaacgtagcgttagttgcttcgcccacaggagaatcatctacataccattgataagtagcgtttgcgcccgatggctgcgaagctaaagcggcagtaaattcaatagctgttccgattactccagcgtcagggctattaggagttacagctaaggtagtcgtttgtgtcttattttgaactgtgatagttgtcgcttcagccgtttccgggcctccttcagaaagtgtatttgttgcaactactttaatagtcttttgaccggcaggtccttttagtacataactaaaagttgcttcagctccatcttgtggagcatcatctacagtccaagcataggtaatagttccgcctccagtttcaccactgggtgtagcagtaaactgctgagtctgatctataactccagtaggtgttttaggagttatatcaactgtaaaagccataagttatccttattttaatgttacgaaagaagagttgcgtgtttcacgaattaaaactgatccgtcacggttaatgtaataaattaagctaaataaagtttggtgtgctgacgcatgttcaaaactagttgggtgagatttccaatccggagtttcagcgatccattgataaatccaccaaggaacagtacagaatcctggattttttccaatcaactgaagattcgggctaaagttttccggaagagtaaatacagacggcttttcagattcaataatctcagctacagcctgttcgaatttttcttcaacaaaaggagtatcttcaatcaaaacatcggtattttcaggaattttatccgtttctactacttcaattttaatgtcagatttaactggagaatcaatcaaaagtgctgcttctggattgacttcttcatcgtcatattttaatccctctgcagcatcagcagcatcaattaagtctttaatagataacccatcagtctctggcataggttcactagcgagcttctggagggcttcttcaatatcaacaacgatattatcaaaagatttattctttttgacctttataccaaactgttcagcatattcagctaatttagctttagcttctttattatcatcaagagccttcagctctgcaatataatctttatctatcataatatttcctcagtataaatatagatatatttattactcggaaaatagtatgtaccactttgtatatgaaacaacaaatctaataaatggtaaaaagtatataggaaaacactctactgatgacttgaatgatggttaccttggttccggtaaggcaattcagcaggctataaagaaatatggtgaaaacaatttctctagaacaatactaaaagagtttaaaacttccgaagaagcgtacatgtatgaagaagaaattataactcctgaactaataaaaagcaaaaattattataatatgaaacctggtggaattggtggaattattatgactacagaggttatagcaaagatgaaagaatcttccgctaaaagatttgaaaactcaccaggcacggtattaggtaaaacttgttacactaatggaactaaaaatatttttattaaacctggagaacttgttccagaaggatttgtaaaagggatggttcatcctaatagaaagtccagaaaaggatgtaaagtcaaaccgactaccacaggaactttttgggtcaataatggcgcaataaataaattaatacaaccagacggtattattcccgacggatttattaaaggtcgtctcatgaaaagagattctaaaggcaaatttagtaaggcataattatggatattaaagtacattttcacgacttcagtcatgtacgcatcgattgtgaagagagcacgttccacgaattaagagatttcttttcgtttgaggccgatggatatagatttaaccctcgcttcagatatggcaactgggatggacgaattcgtcttttagattataatcgccttcttccattcggtttagtcgggcaaattaaaaagttctgcgataactttggctataaagcctggattgacccacagattaacgaaaaagaagaattatcaagaaaagattttgatgaatggctttctaaattagaaatctattcaggaaataaaagaattgaaccgcattggtatcaaaaagatgcagtgttcgaaggattagttaatcgtcgtagaattcttaatcttccaacatccgctggtaaatcgttaattcaagctttgcttgcgcgatattatttggaaaattatgaaggtaaaattcttatcattgttccaacaactgctctaacaactcagatggctgatgacttcgttgactatcgtttattcagtcatgcaatgataaagaaaattggtggcggagcatcaaaagatgataaatataaaaatgatgcaccagtcgttgttggtacatggcaaactgtagtaaaacaaccgaaagaatggttctcacagtttggaatgatgatgaatgatgaatgccatcttgctacaggaaaaagtatttcatctatcatatcaggtttaaataactgcatgttcaaatttggtctatctggttcattacgtgatggcaaagccaatatcatgcagtatgttggaatgtttggtgaaatatttaagccagtaacgacttctaagttaatggaagatggacaagtaactgagctaaaaattaatagtatttttcttcgctatcccgatgagttcactactaaattaaagggaaaaacttatcaagaagaaataaaaattattacggggcttagtaaaagaaataaatggatcgctaaattggctattaagcttgcacaaaaagatgaaaacgcttttgtcatgtttaaacatgtatcacatggtaaagctattttcgatttaattaaaaatgaatacgataaagtttattacgtatcaggggaagttgataccgaaacccgcaatataatgaaaaccttagctgaaaatggtaaaggaataattatagtagctagttatggtgtattttctactggtatttcagttaaaaatctgcatcacgttgttttagcgcacggtgttaaatcaaaaatcattgtattacaaacaatcggtcgtgtattacgtaagcatggttctaaaacaatcgcaacagtctgggacctcatagatgactgtggtgtcaagccaaaatctgctaatactaaaaagaaatatgttcacttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgcgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaaggacatcttcaccacacgggtgatcggccaggatacgaatatcctgacgcttgagattatactttttcattaagaattgaatttccgtttcaaattcttcttcataattaaaagcatcatcaatgctatatctcattattttccagcctcaaatgcccgcatgtcttgaatatgcttaatagcaaatccacgtgatttaatagcatcaagagctccgctacagaaatctaataaaatcccccaatactgcaacgaggtatcaacctttaaaacatccttatcagctgatagaactgtcttcatttctgatttctcgtaacgatccatactaaattcatcaccatctcctcgtcccgagtagtagtctaatttagctttaagagcaacttttttctgtgcatcaattctaagcatttcctttttaatacttgaatgcttattaagccatttactatataacatcacattattagctgcttcatactgtaatttagtcgaatctataaacacatctttcttcaattcttcttgaagatcttctaatctcatattgttctctattcaattgttattggatggacttagattcattataccacgtttatacgtgaagcattatactctattactggaagccagttgtagttttatctgctcaatatcatcagggttatcgatgactgaaaagcgtatttctactatcaaagtataatcatcataaaccggtattacattaactgctaatttatcaatacgtggctcatagtttcttactgcgctttcgatattacgctcaaccgtgtcagcagtaagaggagtcatattctcaaaaagttggtcagataaatcgcatccaaattcagggtcaaacggtcttgaaccttttcttgttgtaataattcctaaaagactatttttaattgaccttaatccaagtgatcttgaaacgtctttgttccaatccattttcatctctgggtcaatatcagaataaagcttattaatatttgccattacaatagctcaaagaattctttgagtcctcttattacatgagcgtgagtttttccacactctggacatttaattggaacagccaaataaacagtaggctttaaaagcatatcttttatagctacaatatctgactctgtgatgatagaatataaatcttccagttctttttcatttaagtcttcaactggaatgctttcaccgttagcatgaatcgtttctatacatgatactatcatgtgggctatatttttatcatcaaaaattttagggtaatggaatttaattttaatgtcacccagtgtataccagaggtcttctggtgcatccatttgtgtatgtaatagatttatatgggttggtatttcagttccacaggtgcacttccaggagttttcgtgattaacttctccaagagaatgcgcccataaatgaatcagtaatagttctgattcttggcggtttaaatcttttgcatttgtacagtctttgattagctttttaacaatctcttctactgaaccattctttttagcagtaataagttctagatattctttaagagtaaatgcgcgacagttgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagaacatcggtcaccacaagaacaaaaagaagtaattgctgatttaattgctgattattttggagactatccaaagacttggcaaccatttatatttttgcaggtatttgtaggttcaataggtaaaactaaagtaccggtcacatttgtatgtccaaaatgtaaaaaagaaaagacagttccatttgaaatatatcaaaaagaattaaaggaacctgtttttgatgtagctaatgttaaaattaaattaaagtttccttctgagttttatgaaaataaagcaaagatgattactgaaaatattcattctgttcaagtagatgaaatatggtatgattggaaggaaattagcgagtccagtcaaatagaactagttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgaacgcggattcgtattaaaactgattgagaaggataaacatcaatgagtatgttacaacgtcctggatatccaaatctcagcgttaaattatttgagagttatgacgcttggagtaataatagatttgttgaattagctgctactattaccacattaactatgcgtgactctctttatggtcgaaatgaaggaatgctacaattttatgattctaaaaacattcatacaaaaatggatggaaatgaaataattcaaatttctgtagctaatgcaaacgatattaataatgttaaaacacgaatttatggatgcaaacatttttccgtgtcagtagattcaaaaggcgataacatcattgctattgaattgggaactattcattctatagaaaatcttaaatttggtagaccatttttccctgatgcaggtgaatctataaaagaaatgcttggtgtcatttatcaagaccgcacattattaactccagcaataaatgctataaatgcttatgttcctgatattccatggactagtacatttgaaaattatttgtcctatgtaagagaagttgctctagcggtaggaagcgataagttcgtatttgtatggcaagacatcatgggagttaacatgatggactatgatatgatgataaatcaagaaccatatccaatgattgtaggtgagccaactttaataggtcaattcgtccaagaattgaaatatccattagcatatgattttgtttggttgactaaatcaaacccgcataaacgtgatccaatgaaaaatgctactatctatgctcattcgtttttagattcttcactgccaatgattactacaggaaagggtgaaaactctattgtagtgtcaaggtcaggtgcttattctgaaatgacttatagaaatggctatgaagaagctattcgtcttcaaactatggcgcaatatgatggctatgctaaatgttctactgtcggtaattttaacttgactcctggtgttaaaattatttttaatgatagtaaaaaaaaccaatttaaaacagaattttacgttgatgaagttatccatgaattatcaaataataattcagtaactcatctatatatgttcactaatgcgacgaaactggaaacaatagacccagttaaggttaaaaatgaatttaaatctgatactaccactgaagaaagtagttcttccaataagtaataaagaagtttctattcctaagatgggtcttaaacattataacattttaaaagatgttaaaggtcctgatgaaaatttaaaacttcttattgattctatttgtccgaatttatcaccggcagaagttgatttcgtttctattcatttattggaatttaatggaaagattaaatctcgtaaagaaatagatggttatacttatgatattaatgacgtttatgtatgtcaaagattggaatttcaataccaaggaaatacattttattttagacctcctggaaaatttgaacaatttttaactgtaagcgatatgttatccaaatgcttgcttaaggtcaatgatgaagttaaagaaattaattttcttgagatgccagcatttgttttaaaatgggcaaatgatatttctacaactttagcaattcctggccctaatggtccaataaccggaattggcaatattattggattatttgaatgaaaaagccacaagaaatgcaaacgatgcgtagaaaagttatttcagataataaaccaacacaggaagcggctaaatccgcttctaatactttatctggtcttaatgacatttctacaaaattagatgatgctcaagctgcctctgaattaatagctcagactgttgaagaaaaatcaaatgaaatagttggagcaattgataacgttgaaagcgcagtgagtgatactactgccggttctgagttaattgccgagactgttgaaattggcaataatatcaataaagaaataggcgaatcactcggaagcaaattagataaattaacgagtttattagaacaaaaaattcaaacagctggaattcaacagactggaacgagtttagcagtagtcgaaaatgctattcctgttaaagtcgtcgaggatgatacagctgaatctgtgggtcctttattaccggctcctgaagcagttaataatgatcctgatgctgattttttccctactcctcagccaattgaaccaaaacaagagtctccagaagagaagcaaaaaagagacgcatttaacttaaaattatctcaagctttagataaattaacaaagacagttgatttcggatttaagaaatctatttcaattactgataaaatatctagcatgctatttaagtataccgtcagtgctgctattgaagctgctaaaatggttgcattgataatggctgttgttattggaatagacctgctgatggttcattttaaatactggtcagataaattttcaaaagcctgggatttatttagcactgattttaaaactttctcaagcgaaacaggaacttggggccctttattacaaagcatctttgaatctattgatgaaattaaaaagttctgggaagctggagattggggcggattaacagtagctattgttgaagggcttggaagtgttctttataatttaggagagcttattcaattaggtatggctaaattatctgcagcaattcttcgagtcattcctggcatgaaggatactgctgatgaagtagaaggaagagcactagaaaatttccaaaatactacaaatgcttctcttagcaaagaagaccaagaaaaagttgcaaattatcaatataaaagaatgaatgacgatcttggtccaatagcaaaagggctagacaaaattgcgaactggaaaactcgtgcatctaactggattcgtggtgttgataataaagaagcactaacgactgatgaagagagagcagaggaagaagaaaaattaaagcaactttctccggaggaagctaaaattgctttaatgaaagctaatgaagctcgtgctgctatgaatcgttttgatgaatacgctaattcagctgatatgagtaaagactcaacggttaaatcagttgaagctgcctatgaagaccttaaaaaacgaatggatgacccggatttaaataattcaccggcagttaaaaaagaacttgctgctagattttctaaaattgatgctacttatcaagagctcaagaaaaatcagcctaatgccaaacctcaaacttctgctaaatcgccagaagcaaaacaagtccaggtaatagaaaagaacaaagcacagcaagctcctattcaacaagcatctccttcaatcaataatactaataatgttattaagaaaaatactgtcgttcataatatgacacccgtaacgagcacgactgctcctggtgtatttgatgcgactggagttaattaaggaataatatggcaattgttaaagaaataactgctgatttaattaaaaagtccggtgagaaaatttcagccggacagagtactaaatcagaagtagcaactaaaacatacactgcccagtttccaactgggcgtgctagtggtaatgacactacaggggacttccaggtaacagatctatataagaatggattattatttactgcatacaatatgtcatctagggattctggaagtcttagaacgatgagatctaactactcttcttcatcttcgagtattttacgtacagccagaaacactatcagtaatacagtatcaaaactatcaaatggactaatatcagataataattcaggaacaataagtaaagttcctgttgcaaatattcttttacctagatctaaatctgacgtcgatacgtcatcacatagatttaatgatgttcaagatagtcttattacaaaaggtggaggtactgctactggtgtgctaagcaatatggcttcaaccgcagtatttggagcgctggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatctagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgataaaacacctaatggtaactttaacggattagctattgctccaaatctccctagtacatttactctcgagattactatgagagaaattatcacgttaaaccgtgcttctttatatgcggggactttttaatgtattctttagaggaatttaataatcaagcaataaacgcagatttccaacgtaataatatgttcagctgtgtttttgctacaactccatcaactaaaagctcttcgttgataagttcaattagcaacttttcttataataacttgggcctaaattcagattggttaggattaactcaaggcgatattaatcagggaattactacgctaattacagctggcacacaaaaactgataagaaaatcaggggttagtaaatatcttattggtgccatgagtcaacgtacagttcaaagtttattaggctcatttacagttggtacatatttaattgacttctttaacatggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggcagatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtgatgcaggctggagcagttgatagacaagctgccattgaatggcttgaatctgctactataaatggtattcaaagcgttctcggaaatagtggaggtgttactggactatctaattcgctttcacgacttagtagattagggggaactgcaggaagcatttcaaatattaatactatgacaggaattgtcaattcgcagagtaaaatattaggagcaatataacaatggggacctttcggtccccatatttttatttacggaatgaaatgaaagcagcaactgaagcaactaaactgtcttcaatataaacttcaatttttaccggagcttctgactcaaatttacctgttactacaccctgaaaaatactttcagtctgttctggctttgaaaaattttcagaaggaaaaattccgaactttttatctgttccaaaaattttgataaattcatcgtaaactgcttcattaaaagcattatcagcaggaataatgccttcaactacaagttcttgacctaaaaagcgcaaagaagatttcattttgtgttcctcatgttatgtcagtaagactactataacacaacacgagggacttgtaaactacatcttgaactttttagacattccgttgatgttaaccaaagaagctaagatttgagaaacttcgttttcctcttcttttgattcttctacaaggaattgattaaatccagccattggacgaacttcaccagtttccatcaaatgatcgccatcatatactgattcttctaattgctcagaaggaggaacgattgtaccttcgattagatacttgttataagcagtttctttcataaagtaagtacttactttattaatcttcagtaaaattccacgcggtagaataacttcagcttctgatggaaatcctgataaatgacccggaacgataactttgattcgctcagctcctttaattaccatacccacgctagtttcagcatcttcattagcatatgtagaatgactacccatatgcatcaaatcttctgcatcaacggaaccttctccttcaccagaaaatactgcaccggaatcatctagagccatatagtttttaccatgctcgccgaagatatttggtttaagcgatgtagatacgaagttcttgaaatagaacattttgttttcaatgttatgacgcaaagttttaaaggtaacttcttgtccgcgataaagcgtagttcctggaggaagaactgaacctttagcgaatgcagaatccaacgtctcgatgtgcttaatagctcgttccatatattcttcacgggtagaatctggtttacccaaaaggaacgagttcatttcaacatatgaatctgcacaataatcttcaattacatcagattcggcctgagtcagtccttttggagttacttcagtgcttgcgtattcatatgcctgggcagcagattcattaatcaatttataaatgccattcatgacaaattgaataatagctgtcttttcatctggcgtagctttagaacctttaactaaatcattaataattttcttaataacatcaaagctattagaaatattaatgtcagcaagatcgcttaaaattttatcagttttataatcaaagaattctttattctttaaatattcttgagaaccttgatatgttatatcgctctgcaacttgatagatggatcacgtaaacgtgcatgggccaatgcaatatgatttcggaagttttctagttcataatcgctagatttaaaacgagaagcacttctcataccaccgatagctcctttgctgaagtttgaaccaatctggataacgccagagttcattggtccttctgctttatataccggaactttagattcaaactcttgatatttcttggcagcgaagctatcaccctgtagcgaagcatcgacagtagaatattgagcttgtgctgctaatcgacgactaattttagttttttgaataacagcttgatccgtgcgcttatcattttctaaagcaatagaagcagcaacagcgacagctttaggaacagcattacctgttttaacatctacataaacatcaccgaccttcgattcaacttttgtgaataactcagttgaaataggaggtacacctggaatgtcttctaaattggcatttttacggtaaaccataatatatgcatactttttatcatagtcccagatttcctttaaaagaacatatctacctgctcctttagtacgtactaaacggtcagcaataacttgcatttgacgagcagcgccatttgttttactctttagtacgcggaataagcatgcatcaattttatactgtttcattgtttgaagagcagtatcaaaaacagcgttaatgacgccaattggatttccacccaagtttctaagtttaaccagtgataatttctcgttgacacctatcattacgatatgcatcattttatcgcccggcttaacgtttttatttgtatcacctccagaggtgtatgtacaaaatctaaatccaggaagcacgctttcttcgccggcttgaatagcaaaaatttgaggtattttatgcttaggatttaagttaacaaccggcgccgaagcgccgtcaaataattctgtaataagttccatgatttatccttgaacgaacttgtaaggcatgtttgcaatatctatgcaagacgcaataattccaagagatgattctactttctgtttaacatttgatgaaacaaatgatgcaaagtcaactctatcttctatatcacctgtcattgtaaccaattcaccagtttccattaaatggtctccgtcatagattaccgattcggtgagttcttctgtggtcataacttcagcttgaataagcttgttgttagttttaactgttccatcattgtaagatgcatcggttattttattaactttgaccattaatccacgtggcaaaatgacttccatttcatttgaaggtgctaaacttccaccgggtaaaacaacattgaccttatcagccccagtaataacccatccaattccaactaaattatcgctagaatttactagtccttcatcagttttatcaatagaaacacttagacgcttttcgtctggtaaaacacctacagatgaatcagtcatccaagtaccaaaaatatttggatataatgatgttgacacaaagtttctaaaataaaaaactcgattttttaccattgcttcatatattgaaggtaacattcgttgtgaacgatacaaagtaataccttttggtaatcgttcaccatttttaaaggctgaatctaaattatcaatagctttttctatgtcagatgctgtcaaaatacttgtacgctcatctggattatataatcccaaaagagcattatttatatctacatatcctgaacctacgtattcacgaattccgcgtttttgcgccggtgtgtatttagatgaatctttattttcgactataggatgtaatgaccatccagctgtaagagcatatccacgtaattctcttcgaataatctttgtttttattgcattccaagaattttgtactaactcatttgcagcatcttggtttaaatgcgaatgtttgttaatatttctttcaaaccaagcacctttatatttttctaaagtatcatcgacgatagaagcaatagtttctaaagtttttattgaagtaatagattcttttcgtaatctttctaaagctttattttttatttctgtattaacatcagattctttatcttcaggaattatagaagcttctctgaatgccattccagctgtaacactattaagagcattctctaatgcaaatcctgaagtagaaataacagttaattcgttagcatcggaaattaaaggcgcatcagcgggtttatttaattctgctgctgaagcctcaaatttttgaaacatcggtgtttcaaatctagaagattccaatgactgactttgtgcaattgctctacgggaaattttaactttaacgattacagcttggtcagaacgtttatcattttcttgtgcaatagatgctgcaattgcctcatttttggttacttgagctccggtatctttattgatataaacatcaccgaccttcgattcaactttagtaaagagctcggtactaatttccggaactcctggaatgtcttctagtgatacatttttgcgatgtataagaatatatgcatactttttatcataatcccagagttccttaagaaggacgtatctgccacctgaacgactacggataagtctatcagcaataacttgaatttgtcgagcttgaccagcggttttagacttaagaatacgaagcatacaagcatcaattttatactgacgcattgtttgcattgcaacagtaaaaactgaattgatataattaattgggcttggaccaagaccttttaatttagcaattgaacctttagcggttaatgtaaaaggaacaatatgcatcattttatcgcccatttttaaatcgcgattagtatcacctccagatgtataggtacataaacgaaagcctggttgttcaattgcatcatcaacatgaactgaaaaaatttgcggtattttcttctttggatttaagtttgtaatcggaagagtagtatcttcgtcaaataattctgtaataagttccatcatagcctctctagtgtttattctatttataaaattaaaggcccgaaggcctttagtaatctagtggtaagagagtacgatatatttcaaactttggtcctttttcataggcatcaaatgtttctgtaaatttattataagcgtatgcatctacaaattcgagaatgacttgtgatacagaagtagaaacatctccaccttctttttgagcaatgacaattgtttctaagtaagctttcataaaccagttacctcatgaaaatcaccaaatacatcctcgaatgtattagctttagttttatcttcacgtaaacgaatcgcaatcggaagaaataatttaacgtaatcagtgcggccatcagattttaaccaaccgttgcattcgcactctagaatttttccaatataataattttggttttccataatgcgagtacggtcaagttcatgcgattttacaccggctttatcttttaagcctgaaccagcatttaccttaatttttccacactctgattcaagaataaatccacccgctttagtagggtctttacggtgaggataaattcctacaatttttaaatcaacatcaattacttctttaaatttatagagattttttgaacgagcattttcccacaatccatcggtatttttgagaataataccttcaagaccttggtcaatatactttttataaattaccttagcttcatctaggttatttactacctggttttcaattaaaattactttatcataacctgatgtcatttgttctagtttagaaaaacgtacatcatatttcaaacgaaatgcaggaagaccgtatatttctaccaacgggacataatcccagacctgaaacttcatgcattgagcttctttttcagaaatggttccctttaaagatttattggcgatgccattagatgcagtacgtgattcagctacttcggcgaattctttagctttactaatttcaggataagcatcaaaaagaaaatctaggccttctggctccttttcaacttgctcatggtataccaattcgccatcaattaacacaccttctggatgaatctggcgagcttctgcagtcattttgattaactcttccttaagaagatctaatcctagatattcattaccagctcgtgataaaagacgaacatcatctaattcatcgcctcggacttcagcaaaacaccgagctccatctgcttttaactgcgcaaaggctggaaacttgatattcttattaatgcctttttcatcataagaacttgcaagcatttgaggttgttcaggaattaaacctggccaaactttatttgcaatagatactgaagcaccgcattcaaggtctcgcatcatcacccgacgcaaaacttcaacatcatcttttttaccgtcagtaatatatccagttaattcctcaattgccgcatttccagtcaatttccgagtagctaacgtgaattcaatgaagtcaagcatatcggtaagagtcaacattccaaaactctgggtagcaatacccggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacgtaaatgaaaccttgctctacgcattttttaaaaattcgttcgtctttttgagctcggaattctggattgcatctaaaaaattgatttacgtgaccgtaatcacgtgtagtattaccttcattttcataaatagtgtgaacaacaaacattagaatgctccttggaaaatattatcaccacaagtaggtctattatacaaatactctataccgccgggtttaatatagttccatgtctgaaacggatgcgtctgatatggatgatatagatgattataaggattaaatccaggagttctccaggtagtgttccaaggaaaagaatcgtttttaatcatcttttcaattacatcttttatagctttttcactatcaaaactttctttattttcctttggtgaaaaaagcttattctctacatcgttccatatataaactcgctgagcagtttttggaatactgtcacgctcccctcgagccatccaataaacaggaacatttaatatttcactcgcatgatcgcagtggtgagcgagatcgtcaatataacaaattacgttatatttctcttttgcctttttgaacaactcttcttttgaagaatcatgaccacacatcagtacttctgagaaggcaccaggaaaaagagcattcaaattaaattgacgattcagcagagcgtcaatagaatcacccagtgctgtaacagctacaaaattataatcttcttttaatttgttaattacacacagggcatctttatatggcgacaagtaacgaataaaatctgaacgattgtatttttcaattagcttaacgccaagttcttcatcacaattaaaaagtttaccaggagaaataaatttctcatcctggatcatttttaaaatatgttctaacggaagattatatttctgagcaaaataaggaaggcctgattgccagcttaaacatactccatcaatatcagttaaaatagtaggcttcatagagagtctcttaataggtttaacacatcaataaattcagcttcggttagtattgtatcatcttttgttagaccactagccatgctgtgcttcaaaacttttcctttcgaggcttgtaatgcatcacggaagcccttgttttggatcgctgcttcaaaatatgcatttgtgtataattctttccacgccggggagtatcttgaaaatggaactccaagccagaagagggtcccacggtcctgagctcttgcataagaccttccagcttgttgggcggcaagcccggataacccaaatatacgacgttgttgttcaacatttttcactttgcatccttggaggaatccttcaagacctccaaattgaatgccatccataacgaaaggccaatgggcgaaattacttaatgcacatgatggccacctaaaattgcttctaatctctaactcagacattttcaatgcttataatttcaacatcagcccaatgaccatagcaaggaagacgaaattcaactggccagttagggtccttttctaatataatagactcaacttgcggttcttcatgttcatcagtatacggatttttatctgttactttatatgtgaccttaatgtactgaattccaaaaatcttattaattatattcatactatttcctttaatccgtagataggagataattcatcacccatacgaaggtcttcatttccatctacccaggaaacaatataagcctcttttatttgaataccactccatttaaatggaggtaaaaccttagaaattaatccaggtataccaactccctttaattcaacggtttgacctaaaaagaatttcattaaaacctcatctgaaaaccgtgcgatttaacattaccgccgccaatatcagaaatgttaatttcacgcgcaattgaagggtcaatgtcaatttcgcgattgagtttagtgatagctaaagtatcgcgcccatttacagtacggaactctaaagggcagactacattaacgtagtttttaatcgattcactggtaggttgcaaatgtgcaggaaggtctttaggcgcctttgagaaaactacttcgcagaagtttttacgggtatcaaaataagtagtcataaacataacattttcctcagtaaggggccaaagcccctcatttattttaaatatcaaattcgttaagaactacatcaaagattgcttcaagatgctcaggtttagctctgttactcagaatatgacgaatccaagttttaaccaaaagcttgcgattaacgccattccagcaaggatgagtccctaaatcgcgttcacggaaatcatcatccagagcgattttaaagttggaaccttccatcgtgattgaaaccgtgataccgttttcaaatcgcatataaacgtaattaggagtcatatactgctcaatttcgcatactgatccattttgatgtttccaaaggcaaatagtatcaatagaacctgcaataccattagaaacatatttacgttcaaagttgatgtagttcattttattctccaagatgtttaattgcggtacaggtatataatatcatatcctgtaccaaagtaaacaattattttactactttccaatgctgcatgtcaagtttaccaacttttttcatcttctcaattaagcgttcggcacgttggcgagctgtaacataataccattcacctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagttttaactgcagcgttcagattaatcgttttcattttattctcctttgtttgtgtaagataatactatcacaaaggaaccatactgtaaacaactttatgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcgacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggtttttggatatttaacgaccaggataaccataaacccgtcatcattcacattcaagaggtacaccgtaaaactgccggggtcttaaaactataatgattcgcaaatcattaatcagacagttcgacggctcctcgatttagctcacactaaggcagtgaatctccaataaattacttcaatgttaccacaaagtgacgaactgcttttcgcgcagcagaagccaaaggcttagcatatttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaggtaacgaatttttgtttaatttcttttggctgcttaagacccagagctacaaaaggatgcggaacatttcgaatttgaccaactggaagagaagtcaaatcgccaacttcgcagaaaccttcaggaacatcaggaccgacagagtgaactacacacagttcaggaacttcaccttgaacacgtttaccgataataagtcctgattctgtaacttcttcatcaccggcttgtgcaggttcagaaactaaaataacatattcaccgacagcacgaattggtagctgttgtacttcagacatcgtttttcctttttgttaacagatgaattaataataacaaataattcttaaagcatttatttaccaataaattgaagcaaatgctcaactttcataccattaacggaaatcaatttgtcaatagaaaaacctcgccatgcaccaagctcaacatcaaataccggaatcatgtcagtagattctttccgagtagattcagtcaatttgccagtttgcatggttggcataaagtccgcgtcgcgagtacctttcataacacgaatagtaccgtcagacttttcaaaaactacgtttgaaacacccatggacaatttagttttcaaaatttcacgaattgctactttctgctcagttgtcagtttcatttatttacctattacagttttaatatgagttgttccacgttctttaagggtggaaagtaatttttggcatttttctaaatcagatttccaactatgtggtctatcaatacaaacccagtttgacttataatactgcttccatttagagaaaaaatatttcttatactctacagcaaatgaaatgttctcgttggaataagaactaattgctgtgagctgtaccaaacgaaatttcattattcaccacagaattcgttgatattttcccagtttaacttatttaagtttttcttaggaacattaaacacttcaatacctgcatttcgcagaatatcatcccagccaggtttatttttatcgtatgtttcacaataaaccagctttttaattccagattgagctattgcttttgcacaatctgggcaaggagaaagtgttacatacatagtagcaccttcaattgaagaaccgtttcgtgcagcaaacaaaatcgcatttagttcagcatgaatttcatttttagacgaccattcagagtgcgcgctacgatgttctttcgccaatacaaaacgatcagttgaaccaaacgatacacattcaggcttatgaccttgaatgatagtatgtttaggcttattcagcaaccaaccttgctcagcagcataatcacagcagttcacaccacctgcaggtgaaccattatatccagtagaaataatacgtccattcttttcaattactgctcctactttccaggagcaacattttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcaccagtcatctttttgtgaagctcaaccggatacttcgtcacaataatagcatcatacacagaaggatgaatactattcaccagagtatcattcattaaagttattctaatgaactgtgctgtttcagaatcaagcgctctatgatcgccagtatcattttcaagacaattatcaattatatcagttaaattcatcatagtacgccatacaccctttgtgcttcaactaatccatcaaaatccagtttaagatgcgatatttgatcgccatcacctggattcacaattactaatactgaacgaggagtttcggtaataacacgaaccgacgtttcaggaaatcgttcagaaaccttatttaccaattcttgagcaaatagtttaactttttcttggaattctttaacagtaattggtttttcgcttagcatgttgatcctagctccttactttcaacatttttaactaatttgacagaaactaattcagcatcttgggtaatcattaccggaccttcttcatgctcttcaagatattctagagctttctttttagcttcttccttcgtatcagtttgagcatagatatagaacatacaaccagtaatacctactactttccacttaatttctttatcagttttaatttcaaatttacttacagaatcatctttttgaacttcttcgaaaaaagaatattctaacatataagcaattgaaaataacgggctaactttataggattcacccattacatcaacagctttataccaacaatcatcaatttcacgtttaatgctaataacatttttcgcaggatctatttttactttaaatgaattttccccaataaactgggcaattcgtttattagccccgcaagtttcattaaaaatatctttatatccagctttaaagcgataaaccttatcttcttcaaaccattcgctcatttcaatttcctcatttgttttggtagagctataatatcacaactctaccgtaaagtaaactattaaattgctttgaattctgatgtctgtgattcaaagcgaatgtcgcctttgataactagctcagcatcaagaccaaatacaacaatgatatgcgcggaacctggatacaacgtaatggcaatagaatccacctggtctggaagcaaagcgttcaatacatgagtcacttgagcgtggattcgaagttcagctgcattatcaagcttttcaaacatgttattagcgataatttggctaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccaactaaaccgctatttacaataacaaagcccaagtttcatggtgccaagccattaaaaatctcccgaagcgacttgccagcattcaacaccgatgcggcgccacatttcaactacttgagttcggtcatcaatagctaatttcacatcaaaatgtggtgcgatgtgtttccagaaaatttcttctttaactacatcatctttacgggtatcgccttgttcgcgttgacactgcatgactaatggaacaccagcaatgtcctcaacccatttacgggtcatacgataatatttcgttggatcttcttcggttccactttcacggcctgaaacgactacgatttgataacccataagagcatacatcttggatagttcaacgaccattggattaataatatcgatatcgcatttttcaaggtcataaggaccacgaccattcatttttgctaacgtgccatcaacatcaaaaataactgcttttggtttaccaggagtccctttatataccggaagaccgagatactctcgcatgcttttatacattgagcgtaaaacatcaattggtactgctttagttccgcgttttgagttacgtttaaccaattcagtccaaggaacatcaaacactttatattcaatttgatgcccaagctctttggcaaactcttcccaaaccttacgtcgttcaggattcagattagtatctgaaacaattacacccttcgttgcgtcttggcagagaatcatgttagcaacatcatgctgcatgtaagttacgataccttctttatttttggtatacttgtactcatcgcgttcttcatgtgccataatagattggcgatagtcatcacgattgatattataaaaccctggatttttagcaataaattcacgagcccaagtactcttaccagaaccaggacagccaatagtcaaaataatctttttcatcatttaattcctaagaaaacttcaagaatacgaatattatgctcacgccgccctttatataattcagctgttgattgattcaccgatttgctctgaacattagatgaaataaattttatcatgtgatttttaagctgatacatatcaaacccacgagcttttgcttcttttcgtagggctttaccagcatcatctaaagctttagcatgttcaatgtcttcgctaatgcttgatgcactttcatggcatacatcaatgtaacggtccgagcattcaatataacgttctagcagagttttcatttatttttctcaactaatgattgaatataatcatgcaagtctttagatgctttaccccacttattttgatattcatttttgagattagcacgtgattgagctaataaaacatcattagttggaggtaaagattctaatcgttgaatctgtcgtccataaatcattgcagccatctcggattcataaattaatccttttagatgttcaaattgataccatgaaatcatttacatttatcctcttttagctcttgacgataataacatatcatagttttctggtcatgtacatatcgttttacatcattaagccaaatacgaaattcctgagaatcttcaaatggcatacctacccaagctttaccatcaataactttaacttgccaagatagtttagcttcgtcatatgactttatttgcacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttatgagccaccacatccgccttctttgcgtctttgcgcagcttttcattttcacgctcaattgcagcaattgattcacgatttttattattcattgcatcaatataattatattgattttttaaatcatttaatgctaaggcgttttcattggccgtttttgtaatttctacaacagacgtttctaatctttcaattttattttttaaaattaaagaagttccgcccaatgcaattacaattaataacaatccagctgtaaaattacttacatgcataaagttttaataacctctataatatcgtcttgagaaagaccgttaattaaaatatgatgttcagctggagatttagaaattttaaagcatgcctcaacatcttctgccatatccgatgcactacgatttggattactaattccaagacgatgctttccagtcaaaggattaacgatgatatagcatttacaactattgatatgaacattaggttgagtctgattaataaatacatcacaatcatatttcgcaagctgattttctaaaaagactttcatctcttcaaccgcatcaggaagcatatcacgggcttgctcaagacgacgatttcgatattctttaatggtcgttttccgcttgacttgcttagctaaatctttcttaagatcggtgatatatccaactcgacggtttcctttaaatacagaaatcccatctgtagtatcaccgtatgcttcaacgaccatttcagtagtaatgagctgcaaatccatcataaagtcctcatgttatgtcagtaagactactgtaacacaacacgagggacttgtaaacagcttagtatccttctgggataaattttttataatttttcaaaaaattctgttcgatttcacacataaccttctcttgactatcatacccctggtataagctcatgatgataccgaacaagtgatccattccagcacctttagcaacaccttgcgcttccatcgcataagtctttctatccttaccacaatgcttattatgacagtcaagaactaaaaacagagctcggtctaagtacttcagataagtcgtttcaaatgcttcaatttttctgtatgaatattcatcgtcagcatacattgctttaagatcatctgatgcaccatcaataatagtcttaaacaatttttctggattatctaatgaactttttgtgctatgaagagacacataccagtcagacttaattttaaaatgagaaccatctttcatcacagcaacatagccttcgatgttttccgcatttttagcttcttctacccatttagggctatcgatttcgtatcgttcaactagatatggacgaagagcagcatctttataaatatcatcatatgaaatgtattcacccgtttcgttttcacgaacattcagtaaaataattttcatttcttggtaagcaagaacgattctattcgtcggagcaacgaattcgaagttagcagtaaatccatcttcagctaattctttaagtctatcacgcaaccgatggtgattaatattcatcaaaataccattagccattaaagcctgttcggatttgattgaaccctttgatttgaacagaatttcatcaccgtctaaataagttgataccaaagacccatcttcttttgttagaatgtaatcaacatcatttaaatcgatattcatcgtgaatggattttcattcaagttaaaaaacttttccataggacgagaagcaattcttactggtttttctccatccatttcaaacatgattccacgacattccaatgcgtctggaagtaaccaatcagaataagatgcataattatatgagaaaattctgtaagttcttccagacgcacttacatcatccgagtaaaaaaacttacgctgtgaatccttgcatagttccattaaattgttaaaaagttcttgcattgtgtatcctcttttgtgttttgaatatagtaccacactccatgtggaagcatcattttttcttatgttgaatattccaaggcgggttaaacagcttaatgaatagtggttcctctaggtcaatcgtcgcgattgtcattgtacctaactcatttgtcatagaaagattaaaacattggcgggcgtaaaattcaactttgcttccttcctttagcgcagcatgaattaatgcagatttagtagaatcagacgttttgtctttacggttaatagcagttctataatagtttattcttttgcgtaaatttttagtttttccaatataaacaagttcatcatttatagcaatagcataaattacgttatacttgtttggaatagataattgttttatacttccgttgtagtctaattctagctcagtatatttaataaatgaatattctgttgcaatttctttcataataaaatgggccttgcggcccactccttaaaagtattttttaaaactcatcataactttatcatcaacatcattatcaatctgtgcaacaaggtaagatgacaattctacttcttgtggcgcagattgaacattatcagaattaagatattcacgaatccaaggatatggatgtttaaccggagcatcggtaattgggcatggaagaccacactgcttcatacgagatacagttaagtaatcaataaagctccacatgctatttgtatttaatccaggaacatcaccatctttaaataaatgaactgcccaatctttttcttggcggttaacttccatgaaaatatcaactgcttcttgttcacactcttgagcaattttaacccattcatcgccatcagtgccaagttgaagttgacgaataatatattgggtgcctttaaggtgaagctgctcatcacgtgcaatgaacttcataatcttggcattaccttccatgatttccatgttcttatggaagttaaaggtacatgcaaaagatacataaaaacgaatagcttccaatgcgttgattacatgcaaacagaggtaaagagatttcattagctcacgcttccaatatgtctcatgctcaatagcatcttcaataacgtcttcgtctgcattaatttctttttggtattcgatatcagctttagcgttttcccaataacgagttttaatcagaacatcatcataataacgtccaatagattcagcacgtttcataatagcttcatctaatacaatttcatcaaataccttcgatggatcagtataaagatttcgcatgatatgagtatatgaacgactgtgaatagtttcactaaaagtccatgtagcaacccatgtatcaaggcttgggtctgaaatcaatgacataagtacagcagacggtgcacgaccctgaatgctatctagaagtgattgatacttcagattattagtaaaaatattctgctgatattgaggaagcttattaaactgtgcagcatccatcattaagtttacttcttcaggacgccagaaaaatgataattgcttttcggtcaaatcttcaaaaactttatggcgttgaatatcataacgcgcaataccaagacctgaaccaaaaaacataggttcttttaaaacatcaactggatttgtattaaaaactgtgctcataaattttccgcttagttaatagttggtgactcgtccgtgagtcaaattatatcataatttacaggatgaacaatcttcagcttttggagtttctatttcataatcatcagtaccagaaccatcacgggtattatgataatagaaattttttccgccaaaataccaaaaatacaaaaggtcatcaatcattattgacattggaacctttccttttggaaaaatctgcgggtcatagtatgtattcgctgaagctgattgacatacccatttcagcataatagctacttgcgtaagataaggtttattacctttcttagctaatttccatgtataatcatataggtctatgttatgttcaatattgggcacgacttgattaaaggaaccctcttttgattctttaacagagactggtccacgtggaggctcgataccgtttgtactgttagaaacttgggaagatgactcacatggcataagtgctgatagtgtgctattacggatgccaaagagcttaaggtcttcccgcagcgacgaccagtcacaaacgtattttggagctgcgatttggtcaatctttttattgtaccagtcgataggtaattcgcctcgagaccaacgagtgtctgaataatattcgcaaggtcctttttctttggcgagcttaatggatgctttaatgagtccatactgtaatctctcaaatagttcatgtgttaaatcgttagcatcttcataagaagcaaagttacttgccagccaagctgcatagttggtaacacctacaccgaggttacgacgctttttagctttttctgcttcaggaactggatatccttggtaatccaaaagattatcaagagcacgaacttgaacttctgccaattcattaattttatcttggtcttgccagtcaaaattatctagtacgaatgcagagagagtacacaatccaatttcagcatcaggactattcacatcatttgttggaatagcaatttcacagcacaagttactctgacgaataggtgccttttcacgaataaacggagtatagttattcgtattatcaatgaactgtacataaattcttgctgttcctgaacgttcagtcatgagcaattcaaatagttcacgggctttaatacgctttttacgaatattagggtctttttctgctgcttcgtataattcacggaaacggtcttggtctttaaaataagaataataaagctctccacccatttcatgcggactgaacaaagtaatgtaatcgttctttccgaatcgttccatcatcaaatcattcagttgaacaccataatccatatgacgaatgcggttttcttctacgcctttgttatttttcaaaacgagaagattttcaacttccaaatgccaaataggataataagcagtagcagcgccgccacgaattccaccctgtgaacatgatttaactgcagtctgaaaatgtttccaaaaaggaataacaccagtatggcgtacttcacccatgccaatcttagaaccttcggcacgaatcataccaacgttaataccaattccagcgcgtttagagatatattcaacaatcgaagcggaagccttattgatagacttcagcgaatcacctgcctcaataacaacacatgaactaaactgtcgagtcggagtacgacaaccagccataataggagttggtaatgaaatctgtcgagtagatactgcttcataaaaacgaataacatgttttaatctatcaacaggttcatcttgatgcaatgccattccaatagtcataaatgcaaactgcggagtttcataaatttgaccagtggttttatctttaacgagatatttttcttttaattgcatcgccccggaataagtaaattccatatcccgctcgtgcttaatttttgattctaaaaatgtaatttcttctgctgaatattttgacaacaattcagggtcatatttaccttcatttacacagtaagaaatatggtcaataaatgaacgcggttcatactgcccataaacatgcttacgaagagcgaacattagacaacgtgcagctacatattgataatcaggctcttcaaccgaaatagaattcgcagcggccttaatgacaatagtctgaatatcatcagttgtcattccatcacggagataagatttaatattttcatataattcataaggatctactgatgttccctcagctgcccaagataaaactttaataattttttgtgggtcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccgacatagacggcccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctagctcacttggattaggaagtgtaaaaagaactacaccagaagtatctttaaatcgtaaaatcatattgccattttccctttaattgctggatgcgattcataattttcaaggataaaatctttcggtttcatgtattcagttaaccagtaaagctgtgtttcggtgtcacaatttccaaactctataggccaatcaattttaagttcacatagttctttaggctcacgacgtaaaatttctttacattgctcagtatgattcatatagatgtgagtattaccaccagaaaatatcaaatctcctgggataagattacacatcttagccacaatatgcgtcaaggcagcgtacgaggcaatgttgaatggcaatcccaagaaaacatctacacttctttggtaccattgtaaatcaagataaccattacgcacattaaactgatagaacatatgacagggcggtaatgccatttgattgatttcagctggattccatgctgaaacgatttgacgtcgatcagttggtaattttttaatacgatcaatagtttcaactaattgatccacgccgccgaaatcacgccattgtttaccgtatataggaccaagttcaccactatgatatcctaggtctttagcctggttttcatagttatcgtcccaaatagttttaccttgaataagactaccatgtgtgcgaagacgtaaatcattaacattggtagaaccggaaataaaccatagaagctcagcaatgcatgcattccatgcaagcttcttagttgttaccgcaggaaaacctttagttaaatcccaacgtaatttagtaccgaacaaagcaattgttcctgtgcctgttcggtcatcggtttcatagccattttcaaaaatgtctttaattaaatcttggtattgtttcatttagtaccttatataaattataatacattttatgaagctaaataatcaatacggtttagcatcaaattttctctcaatttcaggcgtgaaatataattctttaccgcgtttggaaaagcgaccaataatatgataattattctcatcaaacgtgatattaccaatatccatagctttcaaccaaatatcgatatttctatccagctttatgtcaaaattccaatacagagaactattaccgaaaatactgcaagcggattcagtgaaacaactgctataaatcttgtctttaggaactactaattgatagacacctttaataaactgaggaccctgccactttggctgtttcgtgtctttttctaatagaatagggtaataattaaaattcatattttccgccacgtgttatttcatttatatactgattctgtaagggttgttacttcatctattttataccaatgcgtttcaaccatttcacgcttgcttatatcatcaagaaaacttgcatctaattgaaccgttgaattaacacgatgccttttaacgatgcgagaaacaactacttcatccgcataaggtaatgcagcatataacagagcgggtccgccaattacactgatgcgattttcgctggaatcgataaacgtttcaaaagttgtattaggactagataattggatacgtccaccggctactaaggtaacatactcatcccaggtaatataaaaatgagccaaatcaccgtctttagttacaggataatcacgcgcaaggtcacacactacaatatgactacgacctggaagtaatgtaggcaatgactggaacgttttagcacccataatcataattgtaccttcggtacgagctttaaaattctggaggtcctttttaactcgtccccatggtaaaccatcacctaaaccgaatgctaattcattaaagccttcgactgttttagttggagaataagcgaatactaatttaatcattacgcaaaacccctttcaataaaccattcagtggctttatcagcatcaaagaataattcttcgtaagtcttttctttgttttcaaagactgtcacacaaacacgttgacagtctccgcagtattcttctgacatactcaaagcgtcagaaaacatttcattaaactcatttaaatcaggattatgcaatgcgttaaaaattgcataatcgaattcgtcattcataaattcaaaaacaaaaatcatattattttccttaaacagactttttcacaattttccaatcagctttaaactgatcgacgtcagagtgataaatccaaaatcctgcgctttcaccgtcttcataaagcggacacccatcacattcatcttcccatcccatgccacgtaaaaggtgttcagctttttcaacaagttcagaatctttaccgatgatattaaaataccatttacctctaacttctgaatctttgatgctctggcgttgtaatctcattttattctccttagcaagctttaatcaaaagatataaacagaccaacataactgctgccataatataaggtgcgaacattttcttttctccattagttttgatagggtaatagtatcacactactacccttctgtaaactactttttgaaagtttttcgcaaaagttcaatgatttcatctacattgttttcgtcaacaatgcagtgaatttttgttacgccagaaactttgtctttgacttcatcttcttcagaagtcggttctttatactcacgaaaacaatgaaattcgtcttcacaaacgttaaagtaaaaatgctttccatttgcgcattcaatgtgttttattactctaaatccatcaacaaagaaagcttctttaacttcaaaccatccgccattttcttgaataattttaactattgctgaattagaacgtgggcgataattaataaatgtatcaataagtcttggaacaagttcatactttttaccgatatacattatgttttcctcattttaacggggctgtaatagccccttgataattattgttcaatcaatcccatgtaaaattctgcgtcttcagaatccataccatcacaatattcattagccataaagcgggtgaggtcttcaagaggaccttcaataacgatttgaatactccaaaacttagaatcttgcacgcttgtgatactaagttcaggataacgattacgaataatttcttcgatatattcaaaatcaacgatgtcaatatcaactttagccatattattttcctctttaatcatcagcagtattgccgatagttgtatagtaccatggaaggacaaggatgtaaaccgttttgtgaaaaaatttttgaaataaaaaaaggggaccctagaggtccccaattaattagtaatataatctattaaaggtcattcaaaaggtcatctaggtccgtgtcatcagcactagatgaactgccagagcttgagctcataaaatcatcttcagtttttgtattgaagtcatcaacattgaatgcatccaaatcatcagcaactttatcagctttcttagcagcagttgcagcggcaccgcccatcacagcagttcccataacttgaccgaatttagtgctcagttcttcaaacgatttgaatttatctttagaagtcatttcagaaaggtcaaccatttgttcgaacagttctttctggaaagattcatcgtcaatgtttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttacaacaagaatattagcccagtaagaagttttacgtttaacaagaccatactctttattgtcagtgttgtacagatcatttttactgatgtattgacatactgggcaagaatcgtaatcaccgtgggtagatgaacagttttcaatataccatttaccatttttcttgaaaccgtgatttacaagaattgcgaatggtgcttgttcatcatttttagacggaagaaaacgaattactgcttgaccgttacccgcattatcgagtttcagtttccactcgcctttatcttcagaagaaaaaccacctttatttccagccagtttagccatttgtgcagcgagttcagcagtagatttacgtttaaacattttatttcctttttaatttaattaacagttggtgctatgacgatgtatgacctcatagctggtcagtgagataattataatctatttataataagcaattaatacttgcaggatttcacagtttcaataaaaacttttttagcttcctgtgaatcaatatttaaaatttttctataagcctttaactttatagaataattattccagactaaattatcagtctgttcatcatgtttatcaattatatttaaaaacgaatcaagcaagataaacgtttcaaacgaaattatgttcgactgaagcagtttaaaaatataacttgattgaacttttggattatattcaaagatttctttaaaagcagaaacttcaacttttttactaaaataataaatgttgcgaatatcttcttcaaacttaaatttaatttgctttaagcgtccgatatattcacgataaaacacaagtgcatcagcgtcagagatgtcgccaatccaagcatcttggttagcaaccaaattacttataaagattaaagcaagttcctttaatttatatttttctgataacttctggaaaaaatacttatcccttcgcttttgataagcggcatcagacacccgcatgcaccaattatacttaataacatcatactttccattcatatgttgttttatcattaagtataatttataaactgatttaccatcaatgtatctttcaccaccagcaggcatgcggagtttaatcatagcagaaaatctaatgtattagttttttcacaacgaacaacagaaggacgtaaaagattttcgtcaatggcttctgactgaattttttcaattatacccgaaggaataaatttagcaaattgagtttcaggaatagagttttcttccaagaatgctgtcgtagcttcaagataactcattccaaattcttctaccattttttcaataataaatccattttcttggcggtcaagaagctttgcaatttcatccttttctttcttaattgaaagttctttttctgaaagaccggtctcatcgaccgggcgaatatcatttagagaaaactgtgtcataaagttcaactacctcttcagtttcagcttcaaacacatcacggttatctttatgatacaaagctaatagacgattaaacatcttaccatcaacgccaagttcatctttagcacgaattcgaatatctttaatcagttcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacgattgaagttttcattgaaggggttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttatgcatcggtgaccattgcttaacatttggatatttgtgaagctgtgtaaagtcaccgtccgatgaaatgattaaaatcttatgtccttctaaagagaactttttaacaagaacagcaatgtggtcatctgcttcatacttatcaatatccataacaatgtatggcatataagctttcaattcatctataactttatgactggattcaaaataaccttcccagtcccaagtagattcttctcgtgcttttccacggtttttcttgtaatagtaagcaaaatcacgacgccagtatccagatttcgcgttatcaatacacagcacaattttagtgtatccaagcgtttttgcttttttgacattaaacttaattgagttcaatatcaaatgacgaaccatcgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttgggcagcaacggataatattccaaaacctgctggaaattttaatagaattcgttggaaagcattacgtactgatgctgtatatacaactgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaagtacgttcagttttaatgactcatccaaagtcacagatgatattcatttttaataatcgtttgtggcaaatgtatgttgctgattatagcagagaagctgcgattgttactccatcgactgcgtatcaagcacaatctaatgattttatcgtacgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaaggccgtacatcgattgacggtttcttgatgtttgacgataatgagaaattgtggagattgtttgacggggatagtaaagcacgtttacgcattataacaactaattcaaatattcgtccaaatgaagaagtcatggtatttggcgcgaataatggaacaacccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaacggtgaaactaattatgttccagttttacaacttgcttatatagaagattctgatggaaaatactgggttgtacagcaaaacgttccaactgtagaaagagtagactctttaaatgcttctactagagcaagattaggcgtaattgctttagctacacaagctcaagcaaatgctgatttagaaaattctccgcaaaaagaattggcaattactccagaaacgttagctaatcgtactgctactgaaactcgcagaggtattgcaagaatagcaactactgctcaagtaaatcagaacaccacattctcttttgcagatgaccttatcatcactcctaaaaagctgaatgaaagaactgctacagaaactcgtagaggtgtcgctgaaattgctacgcagcaggaaactaatacaggtactgatgatactacaatcatcactcctaaaaagcttcaagctcgtcaaggttctgaatcattatctggtattgtaacttttgtatctaccgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacaccagaaacgttacataaaaagacatcaactgatggaagaattggtttaattgaaattgctacgcaaagcgaagttaatacaggaactgattatactcgcgcagtcactcctaaaactttaaatgaccgtagagcaactgaaagtttaagtggtatagctgaaattgctacgcaagttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttaataactcctaaaaagcttttaggtactaaatctaccgaatcgcaagaaggtgttattaaagttgcaactcagtctgaaactgtgactggaacgtcagcaaatactgctgtatctccaaaaaatttaaaatggattgtgcagagtgaaccaacttgggcagcaactactctgataagagggtttgttaaaacttcttctggttcattaacgtttgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgggtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattaacggaaattatggtttcattgttcgcaatgatggatcagtaacgaattttatgcttactgcatcgggtgatcagactggtggatttaatggattacgtcctttagctattaataatgcatctggccaagtaacgattggtgaaagcttaatcattgccaaaggtgctactataaattcaggcggtttgactgttaactcgagaattcgttctcagggcactaaaacatctgatttatacacccgcgctccaacatctgatactgtaggattctggtcaattgatattaacgattcagccacttataaccagttcccgggttattttaaaatggttgaaaaaactaatgaagtgactgggcttccatacttagaacgtggcgaagaagttaaatctcctggtacattgactcagtttggtaacacacttgattcgctttaccaagattggattacttatccaacgaccccagaagcacgtaccactcgctggacgcgtacatggcagaaaactaaaaattcttggtcaagttttgttcaggtatttgatggaggtaaccctcctcaaccttcggatataggagcaatcccatctgataatggaataataggtaatcttactattcgtgatttcttacgaattggtaatgttcgcattattcctgacccagtgaataaaactgttaaatttgaatgggttgaataagaggtattatggaaaaatttatggcagagtttggacaaggatacgtccaaacgccatttttatcggaaagtaattcagtaagatacaaaataagcatagcgggttcttgcccgctttctactgcggggccatatgttaaatttcaggataatcccgttggaaatcaaacatttagtgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtatcatatgctgctttttatacttcttctaaaagagctattgcattagagcatgttaaactaagtaatagaaaaagcacagatgattatcaaactattttagatgttgtatttgatagtttagaagacgtcggagcgacaggatttccaaaaagaacttatgaaagtgtagagcaattcatgtcagcagttggtggaactaataacgaaattgcgcgattgccaacttcagctgctataagtaaactttctgactataatttaattcccggtgatgttctttatcttaaagcacagttatatgctgatgctgatttacttgatcttggaactacaaacatatccattcgtttttatgatgcatcaaatggatatatttcctcgacccaagctgagtttactgggcaagctgggtcttgggaattaaaagaagactatgtagttgttccagaaaacgccgtaggatttacgatatatgcacaaagaactgctcaagcaggtcaaggcggcatgagaaatttaagtttttctgaagtatcaagaaatggcggcatttcaaaacctgccgaatttggcgtcaacggtattcgcgttaattatgtctgtgaatcggcttcacctccagatataatggtacttcctacacaagcctcttctaaaactggcaaagtgtttggacaggaatttagagaagtttaaactgagggagccttcgggttccctttttctttataaataatattaaaataaaggggcatataatggctgatttaaaagtaggttcaactgtgggtggatctgtcatttggcatcaaggaaattttccattgaattcagccggtgacgatgtactctacaaatcatttaaaatatattcagaatataataaaccgcaggcagctgataacgatttcgtttctaaagctaatggtggtacttacgccggtccaattactattaattacggggtaaatagttatcttcaattaagtaataatgaaacccctatccgaattcgttctggtggcggcactggtaatactcttgtagttggcggctcttccggtggtattagttttagacctgcaggtagtgaaatcactactggacaaattactattacgccagaaggtttgacaacatttaccagggctgtaacggctccatcggtaactgttacatctactccttccgcagcatctgatgttactcgcaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaactgcaggtcaacgtcctgctgcttcagtattagccgaaggtgaattggctataaacttaaaagataaaacaattttcacaaaagatgactcaggtagtgttatagaattaggtttaaaatatggaggaactataaatgggtctttagaggttacagaaaatataactggaactttaattggaaattctagcacagctactaaattgcaaacacctaggaaaattaatggtatatcttttgatgggtcaaaggacattaccttaactccatctgacataaatgtcaatagcacaacatttataaaaaataatggcgaattacctactgatgctaatttagatacgtatgggcccattgaagaatatcttggcgtttggtcgaaatctacttcaacaaatgcgcaaccagcaaataaattcccagaagaaaatgccgtaggtgtactagaagtgtttgtggccggccaatttgctggcactcagcgttatactgtaagatctggtaacgtctatattcgttccttatctgctaaatggaatggcgtcgatggtccatggggtgtgtggcgtaatgttcaagcgtcaactcgtccactttcacaaacgattgaccttgatagcttgggagaattagaacattgtggcttatggcgaaacagttcaagcgcaatcgcatcatttgatcgccattatccagaagaaggatcagccgcacaaggatttttagaaatatttgaaggtggtttatacacgagaactcagcgttatactacccgcatgggtatggtttatactcgttgtctcgctgctgcatgggatgctagtgcacctaagtgggaggaatggaagcaggttggtcatggcacaccagcgactttctatgatggagatctgaatgattttaaaactcccgggttatataatattttaggcactgatgccgttattaactgtcctacaggtgaaggtttgccgactgttattgttggtttgctggaagttaaacagcgtgcttctggcggtgctattttccaacgtttcactaccgcaggaacgggtgcaactactcgcgatcgtatttttgagcgtgcatatactggtggtgcgtggggtgcatggaacgaagtatatacatcttattctctgccaattactttgggtatgggtggtattaaagctcaattagcggagttagattggcaaacctttgattttgtccctggtagtatgtttagtgttcctttgaacaaaataaagaatatgccagcaaatatggattggggcacgattgatggaaacctggttatgttttctgtcggtcctagcgaacataccggaacgggtcgaactgttcaagtgtggcgcggtactgtatctcaggcgaactatcgttatttcgttgttcgtatcgctggtaatccaggaagtaggactaatacttgtcgtcgtgttgttcttgaagacggatcacacacttggactgctcaacaaaactttaggggattgctgaatatcactgctgctgttaatcttggtgctaatcagaaaatttcacttgctccaggagcatatattcaagcccctgctagcggttctggttctaatacttacgcaaatcagaatactaccattgcgccattatatcaggctattgacgattcaaataaaaaccagtttgcgccaattgttaaacagaaaaacactgtaacaaatattactatggcttctggtatggatattgctagttcagaatatcgtatcgttgctcagggtgatttatccgctactggaactacagccactaaattagctacatggcgtttcttgccgtctggccgattcatgtcacaaagccgagtttatgctggcgcagcattcttgaacactgatggtaacattgctggttcaatctggaagaaatacaacgatgcaaccaatttagatgctgccttgaatactcgcctaggtaaaggcggtgatacgatgacaggtcggttaacaatcaatgcacctaatgattctattgtattatcaacaactgctagtaattctttgcatattcgcggtgacatagacgggactggtaactggtatattggcaagggtggtgctgataattcgctagcattttatagctatgcttctcaggcggcagtacatatcacaaacactggtgagattgcgttaaacccgcaaaataccgcaatggttaacgttaaccgtgaccgtgtacacattaacggttctggatggattgctagacaaccgggtgattggggcaaccaatggcgagtagaagctccattattcgttgatcatggttatgttggtcaagatagttattatcctattcttaaagcaagaagcgttataaccaatcaaggatatagcaccgctgttgactttggtatgcgtcgtattccatcacagtgggggcaagcaatcattcgtgtcggatccacggaggcttctcctgatgctggacacccacaagctgtgtttgaattccatcatgatggattcttttatacaccaggaaatggtagctttagcgatgtgtatattcgttctgactcccgtctcaagattaataaagaagaattagaatatggagcagtcgaaaaagtttgccgactgaaagtttatatttacgataaagttaagtctattaaagaccgtagtgttattaaacgtgaagttggtattattgctcaggaccttgaaaaggaattaccggaagctgtatctaaagttgaagttgatggatctgatgttctgacaatttctaactctgctgtgaatgctcttttaattaaggctattcaggaaatgagtgaagaaattaaagaattgaaaacgcctctctttactaaaattgctcgcaaaattagtaaatattttaaattctaacaacaagggggaaatgccccctttggagtataaattatggcagtagttggtgttcctggttggattggaagttcagccgcaaatgaaacaggacagcgctggatgagtcaagcggctggtcaattaagattgggtgttccttgctggatgagtcaatttgcaggtcgctcacgagaaattattcatactgtaggagcaaaccacaattttaatggtcagtggttccgtgatagatgctttgaagctggcggtgcacctattgtattcaatattgttggtgatatcgtttcttattctaaagatgttcctttattcttcatgtacggagatacaccaaatgaatatgttcagttaaatatacatggcgtaacgatgtatggtcgtggaggtaatggcggtagcaatagtcctggctcagctggaggtcattgtattcaaaacgatattggtgggagactaagaattaataatggcggagctattgcaggcggtggcggcggtggcggcggcggatattattctcctttttcacaaatgagattgacctttggtggtggtggcggtcgtccttttggtgcgccaggaggatctattgatatgcaatcaggcgcgactggcggtactatttctgcacctggctcaggatccgtgaatggtatctataatggtggaaacggtggtgaagtaggttccgcgggaggtagatgcaatattcgcggtcaaggatctgaatataatggcggcgctgctggttatgctgtcatagggtccgctccaacatggcaaaatgttggagcaatatatggtccaagagtataatgtgaataaatacccttaaaaggagggtctatggcagcacctagaatatcattttcgccctctgatattctgtttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacaataaccatgtactggtatagaaatgatcatataagtaatgaccgccttgaatcaatatgtgctcaggcggccagaatattaggaagggctaaataattatttgttcgtatacatctctagatatcgatatacaccctcaaaaccctcgttgaattcgtcgatgagggttttcttatcttcttgagttaattcagaaacaattttacggaatgaattctgatttaactttctaccttcatgcgttactccaatctcattcagaaatgcaataaaattagcgcgattctcaacaatatcttctctggaaaatttaatcaaaatagacgcaacagtaataatttcacgaactgtatcaatatttttattcattaactataccactcaattagttgactttgttataatatcatcagacgtttgatttgtaaactggtctgtgttattttcttcaaaaattttttctacgaattccttgaacgactcacgttcctgagctacattatgctcgattaccatttcaagattataactcattcgaaataatcttcaatttcataatcatggacataaatcattatagtttttaatacatcatcaatactttttcctggagctggaattacgtaaaaatatcctgcttttgagaggtctttataagttccaatcaagaaatcattattctcaagatgtagttcttcaactaattcattaacaattgagtggtataaatttggtagaaacttatatagcttttctagaatatcaattttgattgtatattgaaccacagattgagaatcaataatcatagaccttccccttatgtttctgtttgcgattagattctttaaacgctttcttcttatctttatggacagaagctttattaaaattatgttttgcgactaaattgttcataatgctgaattacctctcttaaacatttgcatgtgaatgaaaactttttagctacaccacattcaaatatatgttctcttaaatcacgtgtatcagtatatcccatctcaacaataaaatgccgtattagatttttatctttatcattgagagaattaaaataatcagattttgaattaatttccctggccaaattgaatcaccttcagttgacgttttaattcttttatcatttcttcgttcatcgcaatataaagatcgcgtaaagcaggttttagcattccatttaccggaaaactaaatgggcatacataatcttttcctacgagctttttagtgaattccatatcacagaactgaaatgccggttcatttgtataaattccccaattagttgacatcattttattggcatattccaacgcctggatttgattcttaattccatcaatttgaaactttttaatattcattagtaaaggtcctcagagtaaagttctttttcactaccaccacgttcaatacgcacttgtccagcgtaagttgcaataatcattgcttcttcacgtgtccagtaattgctatactggtcaataaatccttggtcttcaccacaaacatggtctgatacaagtttatcacttacctggtcaagaacttcagccatatctttagaataatgacgagcaccaggaataaccagagtcccaccatcttttaacttaaagcggttggctgcacacacaattcgacgttgatatttttcattattgttccaatgagctacttgccaacagatttcaggaacctcttctaaaacatcctcttccgtatattcggtgtagtcgccataggcctgtaatttagctgctagactttctggagtttcacgtaataaagccaggtctaataattcaagacgctctttgaaggttttcatttggtttcctcaacacttttaatttttatagcttgtttagaactttcaaagcattgacaatatactcttaccgcatcaaactggttggccgctttaagatggactacaccttcgccgttataaaattctacgacaattttaaatgttttcatttaaaccatcctttaatacgttgccataaagttttctgttgagctttgttaacaccaattgagcgaataactggttgagattcatggaattctttataatcagcaaggtaaatttcgtaagctgaatccataaaggaacttatagctgccatgaaattattgcgaatacctactggagcatctttactttcacgaataatcatgtatttgccagtcttaatctttacgatagttccaagataagctccatggtaccagatgtcccaaccctcttgagtaggttctacacaacgacgaagttcattgacaatttctaacttgttcattatttattcctcacagttcagatgctacagtgattacagcttcaatgttttctgccgaacgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactgcggtaagtttcaacctttttaagaacaaatccattttcatctaaaagttttaacatgaagtctttatcttcttccatatcagaagtaatttcgcgagctttacgagttgctcgttttttcagcagttccggagcgttttcctgtgcgtataaagttgctgcatttgaaataatatcctgagcttcaccagtaatgattaatccatcaccagatttctccaccaggccttttttaatcaataccccaatattactattaactactgcattgcctaaatctggatgcacctcacgaacttctgcagctgtaatgaaatctttcttagcaatggtaattaaaatcgcagcagttttttcattcagaatatcgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcattttttgtatctccgggttgtttgtttcagttcatttatttgatagttgtatagtaccacagtatgctttggttgtaaaccgttttgtgaaaaaatttttgaaataaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagcttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatggcgttcttcttcattatcgctcaaagagtattcttttcggaatttaactttgaagccaaagccatgctcaccacaagcatcatcccatgtaatgaagcctttatcttcaagcgggtctaagattttactcacataagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgcagtacagctttcttgacagaagaaacactatgaggaagaatgtaagttgcataaccagttgcaataccggaaacgccattaagaagaacagtaggaataataggcaaatagaaagcaggcggaatgtgttctttatcttgatgtactggagcatattcagtatctttatatacgttatagaaatttttacttacacgagcaaaaatataacgacttgctgctgccttttggacagtacgagaaccaaagtttccttgaccgtctaacagaggaaagttattattccaagtgttagccatcaaagcacctgcgtcttgcgcagagttttcaccatgatgatatccaaggtccgctacaccgcctgcgatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcacgattattcagttgcataaatttaccatactagtgaatgtagtgccataataacatcagaaatgaaaagcacgacttgaattaatccgaacattattccgtaatataatgctatcaataaaatagcaagggctaatgaatagcccaagattttcttaatcattagtagataacaacacaaatgttaaatatgcacacataccctgagctaaagcttgcgaaaacacactgctgacatcaatacagatagttaaaacacatgctactatccaacaaataaatgaaataactcctaataattttgcaatattcatattttcctcactggcgtccgaagacgcctttagttttaaaattattacgatagaactgcatcacatgttcgttgtggaaattactcattaatatgcctgcaaaacgaatttaaagttatcagccaacatacggttcatttcttcaagtgtttgatactcagaatgatgattacgaataaacgccaaagctaactgaccttttccaaatcccgtagtcagaggtttcatcttagaagcaggcagataaaatactgtgtatggaacattgttatttgcaatagtacgcgcaagctgagaccgacgttgacgaatatgacttagaaccgcactaaatccttgcttagaacgctgattacctacataaaatcgtgcagacacacatggattactaaatggacgaccatctaatttacttactaaaaagtaaaatccaggtttagataaaatatctttatgtggaactcccaaaaaccattcaccgttcttgattgtaccaataacggtagcgcctgcattattcagatcagtaacagtcatgtatttcatattaatttcctctaaattattttctactccaaggccgcatgaatacacacggccattaaattaatcgtcgcagtcgacgctcaattcccaaaactcttctacggtataagtttcagtatcattttcaatacagaaacgttcattactattgtttgctaaagtagcgttaactgtcggtttctcgctagtgctcttaagaggtgaaatacgaattaactgatcaccgttatctaaacagaaaatttcaccaacttttacatctttaaagattttcataattcacctcaaggagtataaaatccaaacgcagttgttgaccatcccatccaatatggaaaatttgcgccaatgtaaaacataagaatataaaaccaaccgctcagcaaattcatcattttacaccgttccaaattgtttcaactacggattttaaaccattttgatgaatatcaattccgactactgtcatcaaatagattccaactacaactgaacctaaagcaaaaatcagcatgaaaatgaataaagccggaaaaatattatcgaaaaaccattcaataaatgtaaaagcactgcgtttacgcttcatattttcctcacataaatccaaagtaagcgtttaatacatcaatcattaaaacgattgggaatatactcaaaactattagtattataactacattccatatagctttaacaatctttttcattttctgttcctccgtagttgatagggtaataataccacggaagaacagtcttgtaaacaacttttttaaaaatattcgtaataaatgtgaataccaactactactgctgaaacttgcgcaacccaccacgcacaagcaataagcacagaattcaaaattttcataataacctcatcacaaaagtaaatgttaaacaaattaatggaatactaattaaccaaacgaaacaccaccataatgaactcatagttcaatctcaacgatttccaagtgtttttgttttattgcctttttaacacaatcatggactaaatatgaccatgaatcattatattctccattaactaatcgttggagatcttcacgtgatgataagtaaggttgatctgattcccattttgataaaaatactgcagtaaaaatatctccttcatctgtagttgaagtcgtaaatgcaataaattcaccggtaattttatgtttagcgtaataaaatttaaatttcatttttactcctccgtagctgatagttgtatagtaccacagtccttgtggtatgtaaaccgttttgtgaaaatttttaaatggaaagataccatccattgtagttgctttttcttacaaccttacgaaggtcttctctgtcaccgatgaacttcggagtgtactggatgacacctggatgaatttctttagtgttgaatataattatacagtcagcaacttgatgatttagaatgggccctagatttattccagaaccatatggatactctccgctgcatcctgttgttaccgaaatccaacgtgagtcagtttgatgtgtcttaacttctacacgaagcccgcagtattttggatgcgccagtacatcccatgcgtatgtatacgggtcattaacatcctcttggcctttgttaacataccctcttagccaatctgccacaaaaaactctgcgtacacagcgatacgacatctttcgataacttctgctttatcctggttcgggttttgttttaaagagtatcttgcagtatcagcaattttgaccttcatttcactagtcaagtcactgttcgatagggtaaatgacggaatctgaaatagtctctgcaaacccggattcgttttctgcatttaaactttcctttatgtcggaatcataatttcccttaaaacaaaagggccgaagcccttattttatttgaattgtgcaattcttttttctaaacaatctgcgtaagatttcattgagataaactgcgaaagtagcaattcttgctcaactgcactaaccgttagaaactttgtgctttctaaaaaattgctaagtgcattaattttgagcattaattgatcgtattcttcttttactcgtgcttgataacctaacataattttccttagttaagggccgaagcccttatttaaattgttcagtaacgtcttcaactacttcgtattggcaggtacgcattttagcatcgttgtaatcaatcggaattgatactacatcacgcggatgtactttaacttttacgactcggctggttgaactgccaaagtgacgaatataagatttagaacatacatgcaaaccgcgggaacaagtttgcgtatcatcgtcattcacacgagtacgcggcattttaactactttaccaggactgttatcaaaagtgtttgagtgacaatcaaagtaattgctacgaactactttccaagcatagaagtaaccatcttctgtaatttcaatatcgtttgctaccaagaaatcaaagagtcgagataccgctttctggcttgggttttccagcagattttccaagaacggaaaataaaattcaaagttttcgcctttttccatcgaatcaagaatacgatcaaccaaaccagaccgcaattcaatattttgatagaataagcttccaccttcaattcgaacatcgccggaaatatatttttcaacagcgcgacgaacattaattttttgtgccgcttcttccaacttatccgctacaagcagattaagaatttcctggaagtttgaatgagtattaggagttgcgttataagttacaccgtcaacagtaattgaaatgaattttttagatgcattccaaataatgccagatttagcaactggagcaataactgcatcgctattaactttaactgtaatgtcaccgctaatagtaactttagagcgttctgcttcttcagcatttttcaaaacacgacggattgtgtcaaccgatacaccttgccaatcagccaattcctgctgggtgtaattaccacttgaatacagtttaacaatttcagcttgttcgtttttggtcaggcatttaatattgtacat

SEQ ID NO: 6 - DNA, 170903 bp, synthetic construct
  misc_feature 1..170903: note = K1_kvarM
  source 1..170903: mol_type = other DNA
tcacacataaaacacatcatatcgaccacgggtagtaccaacatataataactgctgtgcgagagaagcatctgccatgtgaatgcatggagtataaatgaagcttctgtcaattgagatgccctgggccttatggaaagtcgaagccggtaatgctttcactttatgaaacttacgcttagcgtcccagaactcagaccaaggagctttacctcctttattccaattcttatatgtatctgcagtttttgccaagaagaattgaaatttattcatttcttcttcggatgagatgacacagattttctctctagcgtactcttcatcgtcgccataggtttcaatatctaatacccaatgacgaaccagatattcacctggaacacctctggcacccaaaaatgtggtggtttcaactgcatccaatatgcgaacaaactgaccattattgaaaagaatttcgctgaatttcttcccttcaaatttaagttccttggtaagaggttcttgcataacaacaatctcgcctactacgaatggtcgttcagtttcgtatattcttcgtctgattatttcattcaatttgtctacagatttattcgtgaatgcaagcattcggttttcaaataaatcttctggtgttttaactaaattaaaataatttagcataaaatctttaagggcagttcctttcgtaaacccacggacaccatgaccatcaactacacagtcacgaatccatccaccatttctgatttcagtagcaacttcaatgattggagcattacttcgcatcacctcggtcaaatgaagctgtaagaaatctttatgagtgaagaatggactcagtgcaggttcattacttccaggttctaccggacgtatctgagccttatcaccaatggcaatgacaatacaccaggcaggaatagttgccatcaaaatcttaaacagcttacggtcatacattgaagcttcatcgcaaatgagaactcgaatagatgccatatccggaactttcttttgttcaaacagaacgttttcttcatatgtcgtcgggttaattttcagaagactatgaatagtactggcctgcattccgctgagcttagataaaacctttttggccccatgtgtaggtgctgccaacgcaatgccagagataccctgagaaatcaaagcatcaatgataaatttggttaaagttgttttacctgtaccggcaggtccattaatcgtaatatgttgacctttagctccttgtttgaccatttcaatgactttattaaaaatcgctttttgactttcttttaattggtcaaacgtaatcatgccacttttaccctcactacatgtagatttttaatttttgcttcgagtttttcacgctcaacatcgctaagtggttcatacactagctcagttgttttccaccaaagcattcctttggttttgctttttccagtaaaattcccttttgctaatttgtctgttaaaaccgacattgtacgaatccgtgctttattagccgattcttcattagtgaagaccacacatcgttctccatcgtacatatcagttgtgactggatggtcaaatccgtctttatccttatacgctactacatatccatagtgttgcattacattttacctctcaaaagttggaagaaggacgcagtcaatggaagaccttttttcaattttaacttatctagcattgagcatttttctaaccgacgaagtgagctaacaattagccgtattgattgtacacggatttcagcatctgatggacgattcggaactgatgctaaaatagcagataacttacgctcaactttagctaattcagacttaccaccgctgatacgagttctcaatgcattaataagttctaaatctgccgaggttgcagttccattcttttctttttgcacaaattgagaaagatgattttcgcgattacgtaagttagttttaattgatgttatagttttttcatactcacgaatcttttccaaacgagaagcttctttatcacttgttggcttaacagaatcagaagagcgaactatgcgtgccgcaatttcattcgcttttcgttcaaggccttcaatcgtattatttccacgcaaagtattatacttttgcttgacaggaataacattccctactacatatcccaagtcattattccaacgctcgagcgtcatgctatcaggatgatttcctttaacagttccaaacttttcgcctgagtatgcgcaatgtgtctgctgcatgatgttaaacagatattctggggtgagattgaactccttgtgccgacgttgagcagaacctaaagttgtaattaaacgagtataaactttagcggtttcagcagtaaatttcatcatgttttcctcaaaaatgctttcgtcttacggacggtataatgggtctaggtccctagttctagataatcactagttgactaagctatagtaacactaaagtagtccataagtaaaccagatttttcaactttgttatgaccaaccactttgaacttagttcccatcggtagcatcctttcttgttctttatcaatcatctcgatgtcagcgcttctgcgctgagcaatgttatcaatcacatcatttggtcgcatgaattcagaatctggtgcagtaattaaaagcgatttcatgttggtatgataatcaaatgattgctgacaattattgacttcaatgactacaaaggtcgagtaatgccatttgcctgcaaactctcgggcgatcgtttcatctgttgtgaatgatgctacctttccaaagtcaaatttctctcctttaataagagcgtcataaaaggctttagcctcacgacacgatagacctctatagagaatttctctgttatcgatttgatgacgtctaacgatagagtcaagtttcttatgaaattcttcgccaatcttattgttcatgcactgccacagaattgactgttctttgcagtcaaaacgattggctaatgcttcccatacgcttaaatcatataaaggtaatcctttgctttctcgcgcgaagttaagaacatcaatggagcgaatgggttcttcgataggaataacctttgataattttactgaaatagatgggtttaatgaaatagccatgatattctccattttggttacgagaggtatcttatcatggctttttggaagagtaaactactttgtgaaattattttgcccagggagaccagggcggcgggtcagaccagattgaagctagttcatctagaagagcttctggggctttaataccatacttctgtataattatacggtattcgtctttgatgtccttagaaatcactggatgaacttgaacctcttcctgaggctcttccatcatttcaaacaaatccatcacatgaaccactcagtattgcgatacagacaactactgctgttatatccatcagctgctttttgcaacagcgggcttggagcaagtttgataaaatctgcgcccatatataaccaaactaacttagtaaattctattagagaatctgtgctatcaatgataatctttttgcctcttgaaattatgtcattttcgtattcatataagctagtttcatgacatacattggtgtatcctttcaagtggagagcatgcagtatagaaacaggacttcctggaactgtatctacgtcaaagacatgagcagtcttaataatgccataatcttcagaaggacaccaaccaaatgcctcgaatttattaattaaatctttgaaatctttgtcgaacgtactgtatagagcaacagtaaaaattctatcttggtctagacgcaaagctccttttgcatcatttcttgattgaactgcgcgctgtaagcttactttatagatttttgcgtttgccacacatagctccttcagtcatgttgttgtcttcaaaccacttatcatttgctttaattaaagcaggcgcagcttttagtaataacgctgcagctcttacacctctgtaccaacaatcaaaatgagacttctttaatggcgattgataccagggcttagtataacatatcattttcttctcctcagttagtaggaataatatactattcccagtatagcataaaaggactcccgaaggagtccttaattttatacttcgccatcagccggaacagcttcaaacattttcgcgttggtggttgcccaagtagcagcatcatcaactactgttgaataagcagctttttcagatgggaaaatctgatactgcgcattagcaatacgatgcgaatcagaatacaccttaaaagctacagatacttctgtgcctttaacttcaccatcagcagttgcatggtcaaaagttttgatgtttacgtaagccattttaatctcctatttagtttacagaagtatttatacagctgctgtaaacatctttaatatttctttatcaatttctcgagtgatttcttctcgaagggccaatactaaggccctttctttttgttttctgataatttttaaacgacgcttagatattcttttagccatcaataaccactgtcttgacgagcaaagttctctgcgtttttcagataatacagcttaaagatttcttcagaatccagaccaagcgccataaacatattcagaacaaagtgcaggatatcaatcatttcaaatttgatttcaagctggtctttatcagacaggtctttgatataagtttcctgcatcttgacgtggtcagctttccatggtttccatacggcagatgctgccttttcaccgttactcataccgccaagagacgtcagcaattcgcggaattcgtcatcaatgtaatctttttggttacgcagccactgcacgatatcaccggcttgggccaattcatcaggatgcatgttagtaccaggcttatcgtttgctagacgaacctgaagagatttttgcatatcaagcattacttgcagagggtcaccaccaactttgcgtacgatacctgcgtatcgagcttcagctttatctgcaccagcgatcagttgactacattcgttgaaatgtggcatattatttttcctttcaattaaattagataaatattatatcacttaacataaatagcaggaggattcatgtctgaagtgaaacgagaatgtaaagacaaaggaggatttggaagatatctttacgtcggaatcgccactgctgctttagctgcatggaattatgtggtagttccattagctagcacacacgggctagttcttcctccaatgccgttagaaaaagttgtgtcgtttattatgactggaggattgctttaatttaaggggctttggcccctatatcttcgcatatttgtcaagacgtaatttagccattaaaccttgcgatatattttgattaatataatccgttatttcagaagcagttgccccctctttcataatcatatcatttatatctttgcttttccaaggcgacttatcccagaaaactaccttttcaccagcatctactaaacgtttcatacgcttaattgtatcaggatgacgaggttcatggtccataatccatgctcggttatcatgacatggaacttgagctaaatctaaagacccgccagtgattgcaatagcattatcaatgaacaacgaatctattggtccttccatgacgaatacgagttttgactcatcaatggtgtcgagaccataaattttggttgcatgttcatgggctttgattgtgatgtatttttgtggagcattctttcgtagtgctcgtccttgaaacgactcaatctctcctttcttgttgaagataggaataaccaaacgtggttcgttcgtctcattcttataggttcctggattaacagagttaacaagagaaggccattggttagtaaaccataaccttttccaagaagtgcttggaatacatctggcagtcacatatttaactatcggatgttccttcggaagtctatctaatcgctcgcagaaattaagtttttctattacggggagttttgcattaattttctcagacggttctacagcctttggcttatcaaagacttgttcctttcttttctcaagaagatactctcgatagaggtcaggctcattatctttaagatactgtgatagccacttgttatactcacagttgaagcaatggcagcgtaatccttgacctgcatcaaaaatccagaatcgggctttattgatatctttctgtgagtcaccacaaattgggcaacgacagtttaacttgaatgttgaagatgtagtaacgtgtctaaatttaggtaggtgagatattgcgcgaattgcatactcgttatcaacccaagacataatatttcctctggccttaaactaataaggccattttatcactttttcttggcagcgtctttatccgcttttcgtttctttggaagagtttcgggtcctttattgacgatgtccccggaagttgtacctgatgcaatattctgtggattgccgcccgcatcacctgcgaccatctcagtaacaaactctttgtatgttttcatagagcctcctactatttattcatgcgtaatacgtaagcatttatatgtaggatacagcgtcggagacattgattttggattgtctttgataagcataaactgcttgcctgtatcttcacacttttgcttaatcattgcttcatctttaccagtgaatgccatcttttcagtagacattccgcctgaacctgtagatagcgccattattaaaacgtatgtaatcatcctaaaatccacttaacaatgttgaagttatcaaactgggcatcacagtaaagaacataattcaacttaagtgctgcgccgtcgtctttaagttctgcttgcacttctgtttgtttgctcgggtctacgttttccacaatatgaccaacatctgcacgaatctgctgagctacttcagactcatcagcagtcattgaccactcgcataagtctttgtcatagttggccatggcaggaactgcagagcaacttgatactgcgaacactaaagcaagtacaatctttttcattttggtttcctcaagcagcttgtacgttaagagcagaaatcaggcgataatcaccgtttgcgtatactaacattgacacattgccatcagtgtttttgaatggctcaacaactactaaaactgtatcgccttcatctaatgcttttcgtactacgccatcacaacgcagattagcatgtggagatttaactactttgcttccaactaccataccacaatgcggtacggtttccgctgattcatctttactcttaaagactacgtctaatgctttttcaattgtccacatgatgttttcctctactcgttttgtttcagtaaggccatagtatcatggcctttggagaaagtaaactaccttttgaacaattttttcaacaaaatgtcagaggtcagattcttggtaggtaggtatgtagcagagttaacccagatgccatcgctgtcatacaccttgacctctccatagtcgcatacagataggtctgctttgttatatgcctcgatgcctcggtgaatggtatctgtggctgttacgacaaaagagtgacctgattggtcacggaccgcgctaaacacaaaaatcataaaatttacctagaattttaactcttctgccagagcatcaagcttagaacgtgatactcgttcttgacgattagattcggctacacggttctgtgcaccggcaccttctcggacggtattgcttggattaggcttagttgggtcgttttgctgctcaatttctacccagcgttgattagccttatgcacacccataaagaacttattgttgatgttcttatcgccataacgtgatttaatctgcttaattaactgttgcttcatctgagcaagttcaggagtttcaatcacagctaacataaagtctgccgtagcaggtagacccgcagattctgcaatatcactcatgtccatatcagaagcatcccaagctgaacgaccgacctgagccgcggtccaaagaacagtttcagattctacagccaatgcacgaagttcttctgcaatagctttaactaatgtgtaactgttttcagtatattgacgaatacggcaagaagcacaaataccaagatagtcaatgatgataacagtcggtttaaagttcttcttgagtttcaactcattcagaagagctcggaatgtattagcgttagcaccgccagtcggatactgtttaatgattaaacgaccaagagtactagaactacgccatttttccattttgcctttatattcggcgtatgatacacaaccatcatcaatatcgtcaagtgatacatcaagcaaattagcatcaatacgtttagcacaaacttcttctgccatttccatactgatgtaaagaacgttatgccccatctgaagatagtctgcagccaatgaacacaatcctaacgatttaccaacgttgacgcctgccatcaatacgttcagtgtaccagtctcggcaccacctttagtaattttgttcagaatgctaagtttaaacggaactttacgagctttattctggtatgataaccaacgagcttcataatcttccatccaatcatgaccaatatagctatcaaacgatactgataacgcttcacgcatgatatcaggaatagcccccatatcaggaagacgcttatctcgcttatttggctcaagctgggcattagcctgaatttcaataattcgagacgtagcgttatacatagccttttcttgaacgtacttttcagtttccttaactaaccaattcaaatcttcgggagcatcagataacttatcaataagtttctttgcgccttcatgttccgtttcagttatagacgaattatccagtgctacacacaacgcagtctttgaaggaattgctgtatattcattaacgtgtttcttaattatgttaaacaccgtctgagcaggtccttgctcgaagtactctttgtccatatatggccaaaccttcgtaaagaaagcctggttgtaaatcagattagctaagattgtttctaccactttaacctcttaaaagattttccataatgattttttcttggtctttaatgcactctggatttgttgtttaacacaagcttccacatgaggataaagttcatccttatgagcttcagatggagtactaaactcaatagttacttcccccgaaggagaaatatttaatttatgaacataaaccaagtgtgattgaccatttaattttatcacaatttcttggataacagtcttcatagcttcttggattatttcatggcttttcttgaacactcgttcttgacgctcgaagtctccctcttccgagggagattcttgttcaaatttctcgagttcagattctaaatcaaactcagtcttcattcatgaagttctctaattcatcttcaacttcagcagctgatactgaaccactctcagggagtttaacaccatcaaccttagttgaaacttttgagttaatcatttctgctaccgcttcatcaaccgcagcgtttgaatcaatagcacccaactgatagcgagctttgatagcgtcacggaatggctcatgcttaaacagaggaccccaaaattccgtactgctcgtatcttttgcccgccaggatttttcttcacgaatcatctcaccggtttcaacgtccaggaattctcgtgcgtaccatccatttttcggtttaacaacaaatccgatatccagagccatatcaagcagaccactgtacggatctataccaccatcgaatttaacatcgatgaagaacttacttttctctttgacagtacgtgatttctcggcgttcaggacaaactgatatccctcaagctcagtaccatctttaatttggcgtttaccgatgatgaacacagtatccgcagaatacataggacctgtaccaccggtcattaccgtcttactgaacatctcgatggtctcgattgtgtggttaaccgcgacacaaggaatgttcttaatagagaagtaaggagttacgatacggaagagagacttcagacttttcgcacgagtcatatctgcgacagatttctcgttcagtgcatcttcggtttcctttttagacgccatgttaccaatagagtcgataaacacgatgactttttcaccacgctcaatagcttcaagctggttaaccatatcgatttttaattgttcaaccgactgaaccggtgtatgaattacacggtcagggtcaacacccatagatttcagataagctggagtgataccaaattctgaatcatagaacaagcagactgcatcaggatacttattaagataagcactaaccattgtcagagacatgttagatttgaagtgtttagatggacctgcgaagatagtcaacccggactgcataccaccatccaacgctccgctgatcgcaatattgagcatcggaattttagttctaactacatctttctcgttaaagaattttgatttagtcagttctgctgtcattttagaagtggatgctttaatcaggcgagattttaagtcagacattcattatattccataagtctccattatatttttctcacaggttaaaggatagggtaattatattaccttgttcttgaagctattaacagaagttccatttcttcttggtgttataaaccactgtttccgtatctatttcataatgcattttacatccaacacacatgccatgccaccagcaatgcattccatctgagccagtagttccttcatgaacaaactcatcagatttacatacgaagcatctgaattcttcagccttgaatatgttaccagctacatcagatttattatagatgttcataagaggtcctttgagggctttcgccctcacagatatggttctaccttaccaaactcgtggaaggcctgagatttcactcgagtgttaatacacatacgaattgatttcagaggttcgttatcaccgaataacccacgtctttcgccgtctttagatttccaacgggcttgatttgggaaagcagcatgtagttgttcaagggctctattctgtcgagcagtatcacgctgtgtagaacaaccaccaggagactgcaccttaccagatttaacgaggtacttaaacagagccaggtgaggatgacccatgttaattaattttagaaaagcataagcatcttcgttaaggtcaataattccgtaaccaatatcttctgctgtaagtttagtcaaatcatagaaagtattggtgaacccaaaactattctcgcgataatgaccccagcttgatgtaattttgaaaatcggcaagcgagcatggccatgataataaccacaatccatagcagtctctacgtatttgaccatatcatcaaatacctcttgactcattgcctcgccgacaccaagtggaacacggcgatcgtcgcgttcacgaatttcagtcagatgaatggtagtatcatcatcaagcatccaaattcgctgccctgcatacatttcagtaatcagacggcgagtaccagcgattccatcaacatcatcggggacagtaacgattttagcagcatgaccgtgccaagtttcgtatgcttctttttctgattcacgcactacaagatgcggaacataaccttcaggaaacatagtcagggcagtaactgccccggcacgcttataacttggaattacaaactgaatcatttccactcacctttatagtctttctttgcaatatgagtttcaccagtataagcatagttatctacaagatagaaatgacgctcatacacgtgcaaagacccgacgttccaaataatgtcgccaactgaataatttttacctgatgcattcagaagtttggttaactgttccagaacatagagctgccatgcatagtcattacgatatccaaatactacatcatttgaacgcatgtttacaacagcatgaactttattatcacgaatcagatactgaacattgttagtacacatgaaatcactcatgccatcgcgctcaaaatcatactgcatttgaggccgtgtataaatcataattccgcggcgagaatcaggattactgataagttcttttgcacagttagcaaactgcgaatagttttgtgatgaccaaactgcccagccatagttagaattaatctcaccatgtttggatgcaattgctttccaaatagctggggtttcacctggaatatctttaacgaataaactttgagatttataccactcaagttcccgagcaatatatccatcattaactgcgccaaaaattaggttttcatctgcaataaatgatgcacctacgatttcaatagtcttcacacccgtcttatcaatcacaaattctttgttgagcaaagcatcagcgaattcttgacggatatcttgtactgtcattggagttacaatcatgagacctcttatttaacttgctggataataattgtattctgctgtgcgttagaagcagaccaaatcagcgcaattaaccaaccgataatggaccaaccgaatactagatttgtgataaagattccaccccgtgatttatgcttacgactgcaagctacaaaggtcggcaaaaaatagatgaagaaaagaatgattaaaccaaatactgcttccatgttaatctcctcagttagacatgcatttgttgtagatgtgattttggagagattttaactgctccatacgttgtttatgctcattataactcaatccgccgttagcaaaatcagttaaacgaatctggtcattcactgctgccgcttgagcagtacatgtacgttctttttgagttttacgcagacgcttaatttcttccagctcatgcttattctgctcaatcatgtctagttccatcgcagatagctgacgattaggattagctttttctttcgccaaccgacgctcaaccgcgagcgattcagcagagacctggttgctagcacgatagtatcctacagtaccgccaattgctcgcacctgtccaacagaagaagccgggacgatatcaccttgtggcatttgacaaccagtcagcgtgagagcaacgataacagcaagtaacgatttcattgtaatctcctcagtatgttatttcgaaaaccatggtaccacatccttgtggcaaagtaaacaacttttttaaaaatcgaacatgtcaagaagagacgatttctcttcatagtctaaccctgctgcttcagacatacccgtcagaggtttaacgaacgatttttggaacagaacactgtggtcaagccacactagaacttcctgtcggatttcttgtggcagctcagtgcccgatggccatgccatgcatttctcaccgtacgggttaccttcacgcagcgggatgaccatcaccttctcgccttccatgattggtgttataccttcaaagcccgcggtagctcggttatacgctaaagcacctttgacgtgatacggagtacctttatctggatatcccgcaccatcatcatacttaccgatgttgttggcggtcttaacttctgctattactttatagtcaagttcacgatactcagactcaaactgcttataatattgctgtaaagattcttcaccttcctgcagcatacgccgaatagattcttccaacgcattctgaacagcagttggtgtagaactttgctgagtttccatacccatgattttcaggtgcggttctgcataacgagtaccttccatatcatacacgttcagagcatatcgtttcttcgctttccaaaatccaccaatgccgtttgaacctaacggaggacaagaaatagcttcacggtccatgaacattaaatgttctttgttgttcatgtattcacacatctcacgatatgattggtcaatccaaggttccattttcttcttaccgaattggttcaggaattctaccaaatcgttagtttctttgaaacgctcaagacctactttctcaataaccttatcaacacaaacgtaaattgagtcagtatcaccggctactacaaacgaatgtccttcagtaccgcataccttgttgagatattcattaactttacgttcaatccattggattgccatttgaccaaacaaggtgattgctgatgcgttacgtaaatcataataacggaagtaaatgttacccaatgcaccataaagggagttgatcagaatcttacggtttaactggttagtgttacccaagatttcagcgtgtttacattcaaacatcagtttgtcaagacactcttcggtatatgtcagcagttctgctttcatgtcatcagagaaatcttcatagacattaacttctgcgaatttatcgatagttccaaacttcttatcattcagaacctttttaatcagttcttgatttcgtttggcacccatcattttatttttccactctttacgctgataaaataccttcgcgatttcaactggaatgacaccatctacatctttacgatacatccaaccattgggtgaacatgaatattcatcagacggacgaggagcagtcttgttaatgtactcacccagcggatgaagtttaaattgtccaacgatagtttctggtgaaatattaacttgtcggattattgacggatacagagatgtcaagtcaaacgacatgatataacgatatgcagcaggaactggttccttaacatacgcaccaggatatgactgtttaacgtgagaacgactttgcggaataactttgtcttgctctttcagactgttaaagatgattgcgtcccaggttttaatcgggctcattacaccttgatatggcatcttcgcataataagacattgagattgccaggtcaataaatccacgaacagcatcaattgcttgtaccgattcaacgtcgatgatgttatatgaaatatatcgttggtgattagtttcacgcaatttattgatcggaccatcatatgctaatttacctttcttggtttcataataagcaatgaaatccaacttatatgtcggttggttcgtgaaactaaatttcttatacaaatccatgtaatcaagaatagtcacacccatgatagaataaatttctttatcaccatacatgtttgtgataatcttagatgaaaccttgttcagaggagagaaccgtttcatcgtacgctcaccaagaatctgtttcacacgattcatgatgtacggaatatcaaatccttcaatgttccagccagtaaaaattgctgggcatttctgttcccaaagattgatgtactcaagcatcatttctttttctgaattgaacggcatatatactacgcggtcaagaatatgttgtggaacttcatcaccgccttcggaatctaaacgagcagcgagtttcttgtcccactcggaaacggagccataaagcgaatgcagtaaatcaaacacatagaacttatcatcaaccgaatcataatgagtgatagcatcaatttcatattctgctttcatcgggtctgggaattgagatgcagtaacctcaatgtcacagtttgcgattcggatgaattttttattatagacgatttctgaaccgtaagtatcactgatatacgcgagtttgaaatcatccatacccattgcttccattcccatatcttccatacgacgcatccaatcgcgtgcatctttcatggttgggaatgtattcttcttgcaatacttgccatagatgtctttgtactttgtttcttccatgcaatgactaaacataacaggagaatacggaacacgacgcatgcgttcctcaccagtagaatcgatataacgttctacaatgtcattgcctagagtttcaacgctgatataaaattctttcatgggtttcctttgtttatagaccgagttattagtctttagatgggacaattatactccaatttttataaagtaaaaggcccgaaggccttttcttatgcaccaatcgtatatttagattttaaggtccattcatgtttctgcttgaacgtaatgacccggaagttattctgcatctgagcaagagtttgaccacgattaatactcagtagaccccagtcagcaagtagttgtgcgattgagtctcgacgaatttcatcttccaaatcaatagtaacagggcgaccatcaagcttcagcatttctttaaaatgaacaatatagtaacgaccttgtttctgaagaatgtggcagctttgatatagtaccttatctttgttattagcaattcccatacgggttagagtttctttaactttcaggaagtcttcaggctgtttcagtgtaatttcaatcatctttaccattccaatgctgttttcttaagagttttctgttctttcacgtttttcgtgattgtcttgaccaattcatcagtcacaagacctttcattttcttgagagcaggtttaagcttgtttttagcttccagggtctctctatacatcctagcatcaatcgcattgaccttgtaatatgtcattataacttgaagaatcaatgcatcctggatgttttctgttaacttagcccatttaccataccgacgacctctaggaacagaggccatcatatagttatagtgtgcttggtcagataacccttgaccaacaaggttcataacataaaccgaaggcatacagtcagggtgttgagaaagagcgttttcaaccatgaattttgaataatccatcgtcgagatattcaaatgctcttgcttttcgttaatagacccgataattgtgaagaattgattttctgctttttctttatatgaatcagataattcctggactttcgtccagtctttacctaaccacgctatttgatgctcgttatactgatcatcatcttcaaataaactcatcatttccactgcatctctacaacaagttgaataagcatataaaccaagtgtaattcaatcgaagctgctatgccatgatactggttattttcaccgatgatttcatacattcggataatgcttgggccagtaaccattgtatacagctcagaagaaagtttatctacaaaccaagtatagtctgctgcatatttcggagcaagagcacggagttctttgatgttcttagttttaatagcttcaatgacatcttcaattgaaccacggtcattcagaacgatagacaagatacctgcatcaatcacacccttagaagaataatgatcaagcatgttaatggtcttacggaattctgggaaattctttttgaccaaagcagctacaactttcttatcttcaactaccacgccttcattttcacaaattgcgagacaacgcttgagcatctcgatttgcattggcttaacatcagatggagatggtttaccaaaattaattacacggcaacgagactgaagaggtttaatgatgccatcaaggttgtttgcagtaatgataatagtacagtttgtgctatacgcttccatgaatgaacgcagatgtcgttgagattctgcaagacctgcacgatcaaattcgtcaatcacgataattttctgcttgcctgcaatagaagcagaacttgcaaatgcagttaacggtccacgaacgaaatcaattttacagtcagaaccattcacgaacatcatttcagcattaatgtcattacacaatgctttagctactgtggtcttaccggtgccaggagaagtgctatggagaattaaatgaggaatttttcctttagctactaaagctgaaaaaatttctttatcttcagcaggcaatacacactcagaaatagtacctggacgatatttctgttcccacatgaagtctgcttcgtttactgtcaatttcatttatatttcctcattcagattaaagatggggccgaagccccgaaattattactcaaaatcaaaggtactgtctgcttccattgctactacataagaggctgatgcaccttcaaatttcgctgcagtctgtttcttggagccattcatttttgcccacagcatcagtttataatcgccgatagtcattttcatattgctcatgttgatgataaagttgaagttaccgtcaccttcataatcaccgagtgtcagggaatacttcggacgggtcagtgcagcgtcttctactttattataaccgcgcagaacaattttaccatcaacattggtgatagcaattgtgtcaatctgcatgccacgagatactcgcatcagctgttgcaggtcttcacctttaaaatcgataattacgtttgccaccgggaatgggattggtttagtcgggaacacgattgtgctcgggtcagctgctggccagaagatagttgagcgagcatctttaattgccagattaccatcttcctgcatgataatatctgcatcatcaccaaccagagacagaatgctcagaaaactgttcaggtcataaattgctacatcagtatcgatggtatcagaaattgttgcttcagcataagtcgtaccattaacagcacgagtcatgataaaattgccaggtttcagcatgataccggagttgatggtggagaagtttttcagaatgttcagagtttctttagagaatttcatttcaataccttttaattaagttcaggataattatatcaagctgcgaatgtagcagttaattcttctgcaacaatctgacctgccgcaacgagttgctcatcagcatctacgcagtaatcattttctagacgttcgccaccatgacggtcagtaacaattttagcaccagccttgattgattcgttgtaatgcttacgcatcagttcaatccatttttctgcgacttcatcatcgatagatttatagaaagcaaagcgagcttcggaatctttaatcttatctttgatagcctgtttagtttcttcggtcagagccagaacccaagacttacgaatacgattttggttattcgggttggaatctgcacgtacgtttttaacctggatatctttcacatcaacaaaattaatcattatatttaccttaatcgtaataatcttcaaccatccaaccgggattcctgctggacatgactctattatattcatttcctgtaaaagcgtttcgtaacatttcttcagttacgagatgttgctcattagaaaacaaattaattaacacatagcgctttaattcaggaaaggccaacagatgttggcccgtagtaaactcattcattccatcaccgtgaatcgtccgaccttcttcatttgaaggtgttggccatatgcctgcgggtcgtggtcacggtgagaaataataaacacattagcatctaccatcttattcagaatagcagttattgccttaacaccttctgcgtcggtagccgagtcatagacttcgtcaaggaacaaacagtttattttaacaccagaaaccttttcagcaatatcacgccacgtgaatagtaatgctatatcaattcgagctttttcaccttgactaaacgaggcataactaaattcttctcgtccacgtgatttaatcgtttcagagaactcttcgttcagtgtgaacgaataatcagcttccataatttttaggtagctgttaatttgcttattgaacatcgggatgtacttcttgatgatagctcctttaataccggagtctttcagcatttcagttaaaataccacgacgatatttttccataaccaaattagttttgacgaggataattttatctaattcttcttgtagcagtttaatcttgtctgagttatcaataaactcctgagatgctttatcaatagctgctttaatgcgacgtgccttttccacagcagtgatagtcatttgctttaaactagacatttgagttttgatatctctggcacgtgaccggacagtgttatactcgcgagctagttcatccagttcactctggcgcgtctttaactcaccaagaatggtattacattcttcaacatgatgattaatcttagtgattagagtgtcattagaatgcaaatcctgcaagcacgttgggcaatgaccacctttatcatacagtccaagaacctttgaatatgattcaattttagaccgaattttaaatgttttaccttgaacttcttggattgactctgctgggtcgtctccaattactaactcaagcagttctctctggagagtttctaattctgctttatatcctcgtgcctctttcacctgctcatcatacatcgcctgcaggcgagctacgttatcaccagaaagtttcttctgcttttctgcatactcatgatgagttttaatttcattagtcaatgcttcacgctgaacatcattaacctggatttgctgattgatttctcttatctgtgtcttgttcagtttgtccatatcagctaaaagagacacttcaagcaaatcttcaacgagctttcgtctattagcagttgataaccccatgaacggagtatatcctgccgttcctaatacgacaatctgcttaaacgatgtgtatgacatgccgatgagactttcaaagtaagattgaaaatcctttgaacttgcggcttcatcaagcttattgccatctcgtaaaatctcaaagacattcggtttttgtccacgtttaatgtagaaactatgaccgtcatactccatccacagttctactacagagtccttcttattgaaggagttaattaattgacctttcttaatatcacggaacggtttaccaaataaggcaaaagtaatagcttcgagcatagtacttttgccaccaccattcttacctgtgattaaggtcttttggcatttatcaagttgaatgtcaatggccgcttggccaactgacattatattcttatacttgacacgatttagtttaaaagtcttcactgattttgtgcctcaatgtataactgtttagacataacctttaaggctttgatatcatctgcggacaggtcttcaagtgcttggatatattcttccattaaatccaataagcttttaacttctacttcttcgccatcttcagactcaaccgagttgtcaactttagaaacagttcttaattcatgtactaccttttcaagttctgattcaaacttaggaaggtcttcatcgaccgcagtgataataatgcgtactgcgagattacgaaactcttcaaagtcaatttttccagtaacaggataaatcagttttctatgccaagtgatttcattagggacgaaatcaaaggttgataattcagtgtcttgaacccagaagccacgtgggtcgttctcgtcacccgctgtaagcgtccaaggcgttccgatgtacttaacgtttgctgcgcttgatatggtgtggaagtgcccagaccatacttgtttgtactttttgaggaaatctggttccagcccatgagacttcattcctttataaaaataaaagccattaagctcccagtgaccaatacagtattcagcagacgattctttgatatgcttcatgatttctgacgtgttctcttcacacatccatggacacaagtcaatcaaagtcccatcaaaatccatagtcacgggcttttcaataacagtaatatgcttatacttaccaagaacttctgttgatgcattaggcgtcaacgtattcttgtagtgcatatcatgatttccgacgatcgtaattaagttaattccttctttctcaagagactccgcaatttcacgagcgaattccattgtcttatgagtgatagctttacgaacgtcaaaaatatcaccgtattgaatgatagttttaattccatgctttttggcataatcaatatgctgcttaattccgtgtcgttgtacatcctgtacccacgggtcatctgcgcggacacctaaatgccaatcgcctgagtgaataattttcatataacctctctagtagagtttaattttatattattccatgaatagcaaaaagggcccgaaggcccattacttattttgtcattaactcaaattgttctttaaagcaatgctcagaatcttggtgttctaccaggaattcaaatgctttatttcgctctttatcatagagcttctggtcagatgacagatgtttcattcgttcaaagacttcatttttattttcatcattcaaccacagaatgccagaatcatgagaagtcaacggctttccatcaacccggaatttcaaagcatcaccagtagctttatggaacacaggaatagttccacaagcgcctagttctaaatgcgtgtattccagcgaacgctcaaggaatttatctggaagacgtgacagctgataaccaaatccagactgagacatacgctcaagcatttcagagttaacatatcggtcaagaacttgaggattcagacctggtccagttttaacctgatgataatgacggcaataatcaatttcatagcgttctttgatgttaataaatgcaggactgcgttctaacccttccaagatagtcgttttgcctgcggggcgcagatgactttcatgaaagtcaaacatcaagaaatagcctttccacgtagtagtacgaccaatccaacgatgaatatcaaaatcaatagcagagaagtctttccaatacttatcacgaattgctttgatgttcatagcaggttgaaagttataaaccggaggagctgagtcagaatcatcaaagaaactcaacccgccgcttggaaaatattcttccattagcacggtattaaaatcgccgtttgagctatgactaaacagtacatcagcacgcttaacggtttcttcaagaccagcatttctacgaagtgacaatgctctatggtcatgttgatatacgactaccctaacttcaggtttaatgttctctatgagcttcttatagttatcaatcgctgcttctggagcattgatagcaggtactgagttaatgataagaatgtcacatgcgttaagcagagataaagtcttatcatagtcatctgcaagagacacaggaatagttacatctttatagctatgtgctctattacgagtaaacgctttatctttagcgtaaatgatatttacttcatggccatgttttactaaccactcacggtgctcgagactgaacttggttacgccgcatccctcaagtccgcgagccattaaaatattaatcttcatatgttgacctttgttgttaattttgaatattttaccattcccgtaataaagcaaaagggccgaagccctttaaattttcttgtatacaacataacccgctgcttcacatatacgcttagcttcttcaaagcgtctaagcatatctaccttagcattatgaatcgcttcataatcgggagcaggtgcttctctccgagcagtatcacatttataacagaagtaactacgctttggtcctgtataacgttctgaacaattactgcaccggcatgtataatttccttccggccaatcatgtccaggattagaacccatcaaattcgtcatacatcccaattctcttcactagtaataaaatcagggtgttcatctaaatcaatgaatccccagttctcttcatttaccattcataccaccgtttaacttggaaggtgtcaacccagacaagagagttcttatctattagcttacatccttcggtagagcctaacacgcgatattgattatctgctacctttactgccatcgtaccagtcgcagtgtttaaagtaaatcctgcgtctttacgaacacgtttaaattttacttgtaccagcatttagaatgtcccaaacagatttacgagaggtattccaacaagtcagaataatctcatcattaaaaggttgttttaaaatagtacgcagtttttcaatagcatacttgtaagcagggaaattattgtctaataccgcgtctccagcatgagctcgtaatcgctcaagttcacgacggtttttacgaacaactttgttggctcgagcaatagcttgttcttctgccgcttccattagtttctgttgcagctcgtcgcgctcttcctgggtaatattgttcatgttattcctttggatggtaatttatttcaaatgtgaattcagtatcagtccaattataactgtgttcaattatagcagaatctgacctgaaatcagcgtcatgtggatttttcgggtcaatgtgaatatcaagatcaagcacctcccttaaatacatctttagcaaataagggatagcgtctaggtcttgcacatcttctaaaaacccgtcgaggttaatcttcagcctcatataaaaattccagattaggtccatcgcttgtaggttcgctctttttagcagaccctggcgccttataagcggtggattcatactgcgtcattttatcgtagatgtcctgaataaaggtttcatctgctaacgcaaccatatcatcgtcccgtgaatcatacacgttgtggacaaaatagctgtatttctttgccatttctttgcgttcttttttgatacgctgaacgaatgcattgaaacaagcttgggttatatacgcatgcgggttatcatacttagtttcatcgaagttgattaagcctttaattgcggcttcaatcccgtctgaaatcatttcttgcttccaggattgggtgtatcctgaaaagttgaaacgcttactcagaccttctgcgatcagcataatagcaaggccgatcgtatcgttctgttttactactcgaggaccgccagcagcttcagactcccgacacttctctttccatgcacagattgatttatacagttccttgttatttacataattactcatattgcctcttcgcttcaattaataatatctattataacaaatttgggaagcgagaggattaaagcattacttaatcaattcagcgcatgcaattaatttcatcatgatacgataaaaatcgttatacgtgaaatctaatggaacatcaatgacggcttcaaaatcttcaaatacacgctccattccataaccagcgatatcatctgattcagcataccagtacgttccatcttgtgcaaaagttatttggctattttcaagacagaacacacctttaatattttcatgtgtaagagtcaattgaattttcatagttcacccttcataatacgatagcattggaacagctgttccatgatacgtttgaactcaaccaaactaagttcaaaccaatcagattcatctacttcatgcatcatttccatgaatgaagagtataaactttcataatgggtttcatttaacatagaggcatgcgtttcccaatacatgccctcttcattgtcaaaccaaacacccatataagaatctatagtaaatccgccaatgccttctactacaatcataatttggtttactttagccatgctttcaccgagtcaatagcatcttcaaatttagagaaagcatccacggatgtgtattcattctcaccagagcgttcataaatccaaaacgcgtcaaaatcttcttcaatgatgaattctccgttaggagtttcaatcgtgtttctgccatcaggcgttttagatataaaccatccaagaaaaccaacttctacaatttgttcttcagtcatttagaatttccaccaattgattatagtttaatgcctttccagaagaaatcataacattacaaaatctgtataatgcttcttttgatactttatacacataatcagaagttgttataatgtatgaaatacgtacaaatgttggggatttttctgccaattcatacgccagttttctagctctgccaatatcatcggcaaacttggtatcagcaagcaaaatactatcaaatacccaacggttagtaaaaatttctgtgtatagaataaccttacgcatcaagatactctcgcagttcctgctcgtttaacccttcttgccacatctctgacggagatggaagttggctgtctagagtggatgaatcaattggaaatactctgataattacgctagtatcttcatcccattgatttgcgagtatccgtttagcttgactaatgtcaggctcagaatgagcccggatatacttaatccttctatgccatacaccggtaggaatagatgcgcacacgatatatgaaatcatttagccgccttaaccgctttaacatcgcggaagcctttcttacgttgattcttcatcttacgaatagtgctttcagaaatttcaccgatacccggagtgattggttctacaccgaaggctttgatgccaaattcagacagaagataagcaaccactaattcacggatgcgggctttaccaattttttggccttcttctttcatcgtaccgtgaagctcaacttcccactgatcaagcaaagacggagttacacaacgtccttcttccagcattgcagatactttatcataagcaaaagagttcagtacgtttttgattgcttgggacatattaatttcctcagtaacgattgttttgacagaggagattttaaatcaaatctcctgtagcaaatcaatctttgagagattttaactcttcgagcatatcgtagtattctttactagcaaccggagctacagtacagtggtagctattgaattcatggtatttcacgaagcgttcaagttgccactcaatcaggttgttaattcggtgaagcagaaccccctctgaaccgacgtagacaactacttcaaattgaagcccatcccaaattctggtacggacgatatcacctacattaaatgttttcatgcgatgtaccaatgttcgttttgccaagactcacccttgtaccagcgagtcatatcatatccattttcatcacagatgaccttgttcttcatcaagaagtattcgtcatcagtaaaatgcacatgctttactttacagcctttactcatagcttctagagcttcttgccaatttaaccagttcatattttcctctcgagttaaacggtatgctgttatccgttgatagagctatagtatcactcatcaactagcttgtaaacaactttgtgaaaggagtttaaaaataaaagagaggtcccataggaacctctaaatgaagggtatagaaatatacagaaggtggtcaagatgaccttagaaaggaactggttaatcttctatgatatctgggtcatgcccagcagcaataagattggttttgaatgttggaatgtcatactgcttaacgttatccataaaaatgacaggataccgaatagcaagcgatggatagcacccgatgcgtttagcaagtgactcaatcaacggacggtcataaaccggttgaccgtcaacctcgttgattacgttataaaactcatacggaagttgtagcttatcgagcaagtcacgaactgctttacatccagggcatctccaaacttcttccgggatgccatagatttctatcatagttcagccttaatctcagaaatcaatctttcaattaattcaagtttatccgctgtagtcataggataaattttgtcaacagtggcttcttcgagatagcaacggtcagcatcattgagtatacaccactgatcaaaatcatcagcatctatgctaacaccgttgaaggtcttaactcgttcaacagacccgtcctgtgtcagagctgttaccaaaaatggcttaaatttaagcatgttgtagaattcaacatcctttgacgatgcgttatttagccatttatcaacagagtcttctttaaacttgtaccacttatcgcaacaaaataattctatcatttcatgacctgttgaagtttagcagtcagagtattaacacgcttctgaaattcttcattagacagtttttcatctttcttagtaggattaatccagtcagaaataatgatgagaacaataaatggaatagctacgaaagcacctgcggttaatgcaaccagtgcaataacattagaaataaatttacgaatagcattaatgaatttcataattttccttaaatagttaagatgaatgctgtcatagccagaaattctggtccaaacagttcagtagccatgtggttcagagtaaacataattttgtaagtcagcatataaatttcctcaatcatgtgtccaggtagaaccgtttcttacccagagtctttggttgtcagaaccacgccagtttttagtagttggcagtgatttctcatatttcccatcaattataacatcgatgtgttgtagcaaatctaaatctttgatatcttcaaacttatatcctgtccacatccagatatctttctccggaaatcttgctttaacccaagaaactaaatttgaaatctcttctcggttctgtggataaagtgggtcaccgccagttaaggtaagaccttggatatacgatttgcttaagtgagatgcaatttctttaacggtattcatagtgaatagctgtccgttacgagcattccaagtagatttattataacacccttcacatttatgcaaacaccctgtgacaaaaagaacgaccctgcatccagggccgttcacaaagcaacatggatatattctatcatagttcatttatatatttccaattatagccttcaacacttttgcgttctccatttaaacattttaaaatatttcctttactagaaatgttaaaatatttcgcagcatccggtatatagttaaatgtttttaaaagaacaccgtttttatatgcaccaaatacattgagagtatatttttctcgaagacgctggtgctttcttttcataatttcaggattttcatacgccagctttaatgaatttttgtgccgctcttttacttcaggcttttgcattgctagcttagttaatctagaaattttgcttctaactttatcgtctttcattgtatttgataaatttaataaagttttatttctaacttcaggattttgcattgctagcttagttagttctgcatgtctttttctaaaatcatcattcttccacatggtcttagacaattttgacatagaatgatgaagcagttctctttcttttgaatataatttaagaatttcatccaattcgtcagtattaaatctattaacgtttgagtttatcattctatgaaaggcataacacattttaccgtttccagtttttgccaaataatagtgagctaacgcatggtcatagtatgataagttaacgatattccatttatctgatttatgctcaggaaatatagatttaggaagcacatggtgtgcttccgtctttccttttattttagaattattgtaatttctttgtattaaagctgtatacgatagtaaatcgttgtcatcttcgaatattgaagatagcttatcattcacaaaatcagaagggtagattctgtcgaaattcattgaaccttacctcattacgtgcttctacttctgcatcatatttccagggctcatcagtttgaatagccccagccgataatccactttcggggtcacgggttatagcaattccaagcgggtgcagaacctctttgttgattttccaaatcaatccccattcgctaagttggttccaatcaacttgcttcattggtttctctaacatgttttaccctatgcataatttctttgttcttaccaagattgaacccacgctcagaaggattaccaagatagccacaggttctgcggatggtattcattttctttggatcagtttcaccgcaaatcgagcaagtgaatccattttcagtaggtgtcatctcatgagtagaaccacaagaaagacatttatctactggcatattaacaccaaaataatccaacttctcgatagcatagtcccataccgcttcaagaccttcaaggttgcgcttcatgtcaggaagttcaacataagaaatatgaccacctttagcaatagaatgatatggtgcttcgcggtcaattttttcaaaaggcgacaggttttcttctactgacacatgaaaactattagtgtaccagcctttatcagttacgcccttaacatcaccaaacttggcttggtcaatcttacagaaacgatagcacagactttcagccggagttgagtacagactaaaggcatagccggtttcttccgtccacttgtttagcttagtgttgatgtacttcaggacgagtttaccgcttcctttaaaagtaagcatatcaaattcgtggatgccaatatatcctaatgaaattgaactacgtccatttttgaatagctcaagaatttcatcatcaggtttcatacgcacaccaaaagcaccttcctggtaaagaataggagcaactgacgcagtaacaccttcaagtgatttaattctagttaaaagagcttctttacaaatatcaaggcgttcatccagtagtttaaacagtttattactgtcatctgaacttttataatttgcatccagagctatcctagggaggttcagtgttactacccctaggttattacggccatcaagaacgggtttgccagaagagtctctccaagcaccaaggaaacttctacagcccattggagatacaggagtttctgaacctgtaattgctctattatttcgagcactgatgatatcaggatacatacgtttagctgcgcattctaatgcaagctgcttaatatcatagttcgggtcttctttacgtagattaatgccttcttctacaaacatcacaagctttggaaagattggagtaattccatcgcgacctaatccacgaatacgattatcaagaatagctcgttgaattaatttttcttcccatgacgttcccataccaaatgtgatagtcacaaacggagtttggccatttgagctgaacaaagtattcacttcatattcatatgcctggaaagcatcaaatacatctttctcggttttagaaatagcgtaatcttttactagagctacttgatatttgcgtgcatcacgtacatgtttagcgaatgtcttctccacataaggagccaatactaaatcgacgttagcaaacgtagttccaccatactggtgagatgctacttgtgcagtgatttgcgccatgatagcagtagctactccaatactcttaggagtttcaatttgagcgttaccaagtttaaagccattctgcaacatacctttcaaatctactaagcagcagttagtgaaaggcaaagctggactatagtccatatcatgaaaatggataacaccttctttgtgtgcttccattacagagaaaggaatgacctgattggcgatatgtttagatacgataccggccatcaggtcacgttgggtaggaaaaacacgagaatctttgttggcattctcgtttaaaaggtccttgttggttttattaataagtccctggatttctaattcgatattcattttaaactcttacgaagctgcttcttgtattttgaagcaagttgtgattttccatcactttcctcgtatgtaaacccatgcaattccatttcagcaatcatctcaggcttaccaagacgtgaaaagcgtttagccatatcggcaacatattgcgggtgaatattactgtctttacgattctggcggagatagaccagcaaattctctaaccattcgaggtagtcaatatcttgaccttttaaaccagagcggttgaacttatgcttcatttggccttctgccgcattacacaggttacagagcaagcctctgacctttcctgcattgtcaccttctaacgcatggtcatggtcgaggtgattcttttgaatatcctcatctaaaggacgtttgcagcaaggacataatccgttctgtgcctgatatagtttttctttttcttctttatataacttaccggttaataacatactcttacctcagcgattagataagagtatttatagttaaattaacgagtaactactatagatgttatgattagactcttttatgcagaaagaagtacagaaagcatagatgccttcataatcatccgcattgaactcaatatatgaattagtttcttcatgaagaagactcattttagtccaagccattccattgatgtcatcgtcgtaatagcctccactaaattctactacatcgccaacttcataccaatgactgcgtaaaatttctcttgtaacacgatgaatatcagcgaaatcgagaatttttactgtaatagttttagtaatgcacgatttagacatggcgaactccaagacgggtttccaatgcgacgatgtaatccgcggctttttgcattaaagcatactcttctgaatcacaattttcctgtccagcaaatgcgtaaagagctctggtaattggaacgattgcgccttggaaatggttaagtttaatttcagaaatcagaggaacatcttcaccttgaccgatttctttaatttggtgcatcgtatcttcactgtagaagcaccagaaccaagattctccgtgtggagttgggtcgttaatagtaatgattttgtttgtcagcaaatcaattacggcagtaattccacacatttcaaggtcatcttcattaactacagaaatgacttggaacttaaatcccggaataaacacaggaaattgctctgttaattcgtcatcattaataatgacttcaaactgcttaccaataagtcccattcactttgtcctcataatcaagtaattcatttatagtgggttcagaagtattataatcttcttcaggaatagcatcttcctctggctcgacagtttcccagcgagccgcataccagggttttagacctttgctactttgcatggtgttggttcagaatcattagcagaatcatgttcaatacgccattcaacttcagtgcgagtaaccactttttcatgacgtgtaacgatatctacttcaggaggactataataccaatcagtatgatatgagcctgaacgagattctgataccatgaaatgaacgccacgcgctggataataccaaatttgagtgcggtcttgatacttgtgctcttgcgtccaatctccatcttctactaaaacaaagatttcttctgcatcatcgtctggtgcattaggcggatattcgaaatcgtagttgtcgtcccaaccgccagtgacgccagcgatatgtttgatttcttttactaattcagcgttagtcattttaacctcgcagcttctgtaaatcttcatcatcaatccagctttctaaaccggatggaagcgcacattcaatttcccacagcaattcttcaattgcttgcaagcgttcaagctcttctgctgaaatagttaccatgcgtggagcttttaaatcgccaatatcataactcatagttcttcctcatgttaatcataatttcaccatacactcgccgtatttccatttagacataaccttaactccattagagtaagttacctctacctttgctcgatgatttttgatttgtttaatctcaccggtttctaatccgccatagccataataaagggctacaatatcaccctcccgaaggagggttccacgataatcatgcattgaacttgaatttacggagttcatcaaaaccgccgatatgtgtaccgtcaggagcaaaaatctgaggcatagttaatccaacctgtgattcacgacctaaacggcgaagcaaatcactgataaccacttcatcaaatacacctttttctggcattacattgatgaatgcatattcttgcttcttaacgtcgagcagacgttttgcgttatcgcaaaatacacacttatgaatgctgctgtcgtaaccaaaaaccgtgaacatcttcttctatttccttaaatacttgagcttgaactgttttccaatctgggtggcgtactgctttaacgtaatttgtcataccaagacgcttcattacttcgccatcaatagctgcttgagcaaaatttcttccgcgggtcatagctcctttgagtttagaactatcaactatttgaccagtctcattataataaaccgaatacatgagtagcattactcgttcggcttcttccatatatcgtttacgagccattttcagccttagtagttataactaatgttttaccatctaacgcatcgagaatatctttgatgcaattatctggcattggttgaacgctagctaattgcttggcaatatcatcaggaattcccatacgtggtatatttaatttgctaaaatcaattttatccattagcagttaccgggaagtgttctgccaatttagcagcaatggcagcgttaatttgatcagcgaaatttttattcattgcattaacaatgatttcttgaattcggagattagctctttcaatagacatcttaatacgaccttcagcttgcttaacagcgtcatcaatagtttgacgaaccatatcatcaatagcatttttagcgcatgattgggcagcgttacgcatcatctgcgacatttcttctgtagcagacatatcattccaaccgcgagtatggaacatctgctgaacttgcttcttaacttctgctcggacatctggaatagtcacagcagcaatattaacttcagattgtactgcttgcttcagcttattctgtgaatcttttaacaccatttctttaacgatgttattgattactgactgttgcagttgagcacgggctgctgtaccttctgggaataactggcgtactgcataagtatcaagtttaatatcaatcattttacctttttcactccaggaatattagagatagtttcaaatacttcgtcaaagttatctttatcaacagtgactaccatagtgcgagcggtctgtttctttttccaacgtttaaagaaagttgcaagactcaaatcatgggaagtgaagaaatcatcggttttgtaaacatatccgctttcaatttttactacagcatcaggtgaagggtcttcatattcttctacttcaacatcatcaaagagaattaaagtatcatcatgataatagccttcccagaaggcttcatcgttataaaattctttccaaagcgcgccagttgttttcatttaatcaccttcttccaagcttcgtgagcagcgcatgctaatacttcatcatcagtcaaattaaacttgccttcattacgacgagcaatcatttcattgaattcagtatcagttctaagcatcatgttaagaactgtaaaatccattgtcgctcgaagatattctttaagctgcatagggtcgatgccactttcgtatgcgtcaagaatcatatctgcaatgatgttatcaaagtttttgtcttttatgaggttattagcatactcgacaaaaaacttagtattagcaccagtaatagttttagtaatcattttaattttctctcaaatttatgcttacaagtccggcatttcattttcagaatatcggttgtccaatcgacaagctgtacttgaatactaccacatttttcgcaaggcacaacttgtttagctgcagcttctcgacggtctaccatttcaagacaggcatcccagtcaattttaaattcaggtacaggcggatactcaaactcaatttcaaggtcgttatcatcaacgaccatgtcttcttttaattgatttttcacagtaagctccgggcatactcgagagattcataacgctctttgtattcgttaagcgatttaaccaaatctgccatcatcaattcatgtttagccaattcagcttctttagtatcaatgaaccgcttaacagattccatttcaattgcaatagaattcttagcaatttcaatatgatttactgctgtcatctgtaaaggcttaacttgagctaggtacatatgagctacatcggtatcaatgacatgttttgtcattggaggaaaaatcttaaatgggtccaaatgcacttcaagagtagatgaactttcaagaagcattttgcattggacttcttttactatatccatatgatttaatgcattacgaacctgagccaaaagagcacgtgatggataatttccactagtccaatggctattaatatgaatacgtactgttacgttgtcaagttcttctgcgcgaatactgtgaatccctcttggatttttcggattagtagatacttggtatttcacacgatcagtatctttaagcaaagaaattgagcgattaagaatacggcgcagattgctattgaactcagtacagaaaatccgcgaagcagaatgaccaaattcttcatcagttttaaatgatttagacgcaaaattataacgataagatggaattttagtgtctccaacaatgaattgcttcagttgttcagcagcagacattgcacctaaccaacgagagcgacgaatattttctacaaagaaactaactacattggattcgctagtcgccatattatctagagttcgtttggcaaccttacccgcaattgctacatcataagcccttggatttaaatcatgtaaagctgataacaccttaacatgtttctcacgcttcgtgagagttttatctttcaacttattaaattcagcttctacaaacatctttaattcattcttattcattatcttttcctctattttggactgggctcaaagagtatctcaaaatctccctgaacccattatacaacaactattcatcaagcataataactttgcttggacgcttatagaaagcatgagttttatcatctttcgctaattcaaatgtagcagtaaactgtactttgcctctgtattcaaacggaatactttttggaagggagccgtaaaccgtagctccattctcaagcacaaccatcatcttacattgtacgccgtaatagtcttcataaacttttactgacgttactgtaccagagacggtcactcgtccttccggtgcatcccctttattcttattcagctcattgaatatattatcaaagacctcttttgaatgttcctggatagcctctaagatgctcttatgagctctaacttctgccataacaacatctgtgccatcttgcaatttccactctttatatggaatgcgtacttcaagaggataaccatactcccgaagttctttgtactcttcttgagttaagcggattttccaccaaccgtggtcaccggtatactcaggcttatccagtgaatccaattctgtaacatacggcaagtaactgcctgcgtgataagcttcaacttcacctaattcattttcccaaagataaccatcaaagggagcatgaggacgatcatctttgccccaagtaggagctaccactttatcaaagtattcacgaccgaagcgggtcttcgcccatccagcattcaactcctcggcgcgtttttcaactttcgctcggtgtgcttggcgggctacacgattttcttcaacaagtgcagagataatctcggttaaagttttcattttattctccagtttggttgacgagaccatcttatcaacagcctcgccgaaagtaaactactttgtgaaaaattttctccaaagcagaactgcgtctctacgagatacttctactgctcctagagcaactgcttgcttgcgacgaacatcacacaaatcatagtgtggaactcgcttatcctggaaccaagaacgtttcattccgatggcttctgccatagcatgcaactcatcaagattgtcgctaaacatgtggcagttctttacttgatgacctctcattttccaaccatgattcatcaagacatctacgtatactgtcatttatgattctctatgtaagtttcaatgatgaactgtgctaaacacagaagattatcttctgaaggagaatctactaaattctcaaccatttcagaaatagttccaaaagcttcttcagtattgaacatttcttgaagttcgttccaagtaggtgctttcatttcaatctcctcattagttaacggaagctatcttatcatggcttttctaagatgtaaacaacaaaagggcccgaaggcccttaaaaagatcggaaatcactgttaaaccatggcgactggtgttgtcgccgtttaagcaatttcagttggtgtttcctattgtcttctataatcatcttagaggcttttagctcttcagccaatgagacctgtttacggtccatcaagatgaggttctgggtcttctgggcaaatgtctgaatatctttaaggcattccacagattcctccattcctcgcttatacttggttcgggcagcatttaactgcccttcgtaatacgcatgtatagacactatagtattaaacatgggttaccctttagcataattgacgatttgttcacgatcagcgggccaatttaaatcagaacgtttcttgtttgaccaagcaatattttcttcagcccaatgaagtttagccgatacgctcttttgtacgtctctgatggcttcttcaagataaatgcctaaatctctcgggttagttccttgagttttaaatgcattgagcaaaatatttcttacgacttctttaaattgattttcaacttccgggtgaataaattcacgataaccgttgcacggatatccaaaagcatctaccatacgagtagtactaaattctttgttcataatccgagcgcctcgcgttcatcaggatttaatttagccaaagcggattctttaattttttccaaccgtttacgcttagcttcaggtgtttcttcctgaacactaatagcagcgcttttaggaaaagtccacgattcaccattttcatcggtgaatgtaattagttccgttggcttacgattaactgtaccatctgagccccaccaagactgccccttaactgcttcttcggcaacgcaatatgaaccataataaccaaacaactcactacgacgatcgtctggtgaaacatacgctgcataggcttcactttccgtcattacccagtttttcattttagcacctcataacgaataagttcaatacgatttttaagctcttggtatgatttacgccaaggcttataataggcatttaaatcttggtgttgtttatgcatttcgtctaaatgctttactgcatcctgcacatttgcaaggaaagtatcaaatactttattagcgtattctttcctgagctcaatgaatggaggagcacgaaatacgtttaccattacacgtaattcatgataagaagaatggacttcagctaatacatttttcttatcgccaaaattaaacttataaagtttttcacagattgcttcacaagctttctctgctttacccttaggtttacctgcaaagatgtgtcccggtggatatactttaatatcgtttaaccaacattcaatatctttaatagctgctaaactcattgtacccacgctccgttttcatcaatgtaattaatccactcgttaatagtccaggaagaggtattacctttaggagtatcaacgatatacattccgcctttaaacaaaacacgttttacatcattagaaattaaagtagccattatattttcctcagttagggaggagaaatcctcccgtttaaattatttcagcattgttacttcagcaatttcacgccagtttttacggtcagtcgcgacgaaatcaccgatataaagagcagtacggagagatacgttacgcagacgatttacgttatctttcataaattccaaaacttcaataacttcagaatttcttaacccacggttctgtaacatagaagtggtcattattacatcttgaacacgaaccataatctcttcattagtgtgaacaccaaggtcaagataaaccgaacgtgataccagagcttgaagatgcggagcaagtttagaaccacgctctaattcacggtcaatatcaacgttagtgataaagaccacagtaccttcaaactcaaactcattaggaattcctttatcttccaagaaagaagatgcagtgctccagcatactttacgtttctcccctgaatccaaagcagctttcagaaggttaagaatgtccatatcagagaatacatccacatcatcaatgagcagaactgaatttgcttcacgtgattcccaaagacggcagtataaaccaattcctgagattttaccgttcactgatttgtaatcaatagcgttagtatcatgagcatgttgtaatgctttatccaaagagtaagtcttaccgatacctgctgctccggagataatcagagaacgaatattcccatgaattaaaccgttagtcattaatcccatgacgttaaagcgtttcttgatacgctctttcatttcatcaacggattcaacaacttcaatcttagcagctactccgtcaattacgatatcatctttgaatacccaaacaccgcgctttttaccattcagttcaacaaagactttaccatcaccctgacgagagtcttcagcacttaagctatccgggaaccactcaccgagtaactcataagtacctgaaatctctttgccgaagtaaatccctttcttgatggtgatagttgacattttattctccgttactctgttttgttttgatggagctatagtatcattctacagctccaaagtaaactactttttaattatttttctaaaatttcattgatgtagtaaggacggacctttgaaccaagatagaagtcatctacaaaatcaatcaagttgtcagtttcaccacggatgatagcaagcttagagaacacttctcccaccatcattggttcaaattctacaccgtgagcttcagcagctttaaaggctttatcaatgttgtttacgacgatttctaaagttttcattttattctccattgtatctgtttgggtggtacaggtctatagtatcactagctcgcgagcttgtatactactttatgcattcttttgaaacaaaaagaggagcccgaaggctcctcagttatgcgtgcttgttgatagcgttttctgcgatacgctttggaagtttacctgcccagcggaagaacatgataatcgctccggcaataaacgcagggaaccaaaagatgagataaaaccaatactctcctgctttctcgatggttccatttttgattagatgcttacagacagaccaacccacgataaagtaaattattgcaacaacgattggcactactacgctccaaagtaaaatcatatttcagcccagtaaagtgagaaccggagctcttctccggcccatgacataaattggtggatttgttttcgagttggtcgagcagagaatttagcattttctctacgaccagtctctctgcaaactgcttccaaataccaccgtctacctttatgaggtcttccataattcaagaagaccttcattgtatcatttgtagtaagaattgtggttttcaagataaaccttctcgacgaaatcgtcccagaacttcatgtctactttcttaggcattccattcttttcggcttgatgagctagaatttctacttcatctactacagactcgagaagctcctgtacttctttgaacggtaactcacctgctttgaccatcttgaccattttagcatgggtcagagggaattgaaggtcaccagtcatatagatttcctgaagctgcagacctgcacgaagagcatgactcagtgctttccaatctacaccttcgttagcttctgccttacgagcacgttcaccatattcagcatcaagcttctcaagggagtacttcatctctttgatagtgatagtcgtctggaatttacgacccagaacgttataaaacttctgctcgcctgatttgtggtcaacgaaggtggtccattcgaggaattcaccgagaggaagtttctctgcgatatcctgtactttccaacgctcattgatacccttctgctgaggacgatcgtcatatttccattcaggaacatctctgataacatccaggactttatgcaggtcagctaaacgagaacccttaacaccatacttacctgcttgcttacggacatatccaagataagccttcatgtcagtagtataaaaacgagctcggttgtcttgaatgaatttccatacttcaggaaggtcagatgcaactaccaattccggtggagtatgcagcatatccaacgcgacagtttcaccgtcagcagcgagcttgaagaaatactttaagctgaacagctcatggtcgacgtcgtctttcgtatttttggttgcgctgttattagtattacgattagtatgattcatcgcttgacacaacagaacatcacgcggatgaggtacaaagatttctttaaaatccacatctgactcgggagttgaagtaccatacagatgtgaaccaaaataagattttacgattgttttcataagtaaatatgattccctttagcgaatttaatcaaatcatttgaagatttagcacaggcttcaacatgttctttatcagtactcttcttagaattgcgatgaacattcccgattttctgcatagtatggtagtatactacgtcatggaaatgatattcttgaccgtctggatgcggttcgcggcgggcggttttaataacatgtgtatcatacataggaactaatgcccaatcattcccggtattaatgattgctacttggatatccattttgttccatttaaaggcattaacatatccaagaacacgatgaactcggtcaaacattgcgaatttgatttcagaagagcttgccattttcatctgcttaagcaagctcatagagagtttctttttggttgttacgatttcaatttccataacccaccctcataatatatgtctaaatcaatgttatctttgccgctgtacttgccagtcaaaggaataaatttaaccgtaatcttttcgccgtcatcaaaagtaaattcagcaataggatatgtagaaattataccacgttcggttttagcacgaaagacggcccgaaggccgttcacgatataaacttgatcattcttcactagttttaccttctacataatcaatcattgggcagactttccgcttacgggcttttaaatactggacaaataccgatggttcggcttctgcaggaagacccgcttttactcgagcaagttttttggtatactgtttcttattgcgatagcgtttaaatttttctaaaccaaaaataaatccaaacgctatagctgcaaataaaagcacaaatgctgctataaccactgcgccaactggtactgctacaacatttagccaaaaggcggataaactaacacctatccaagcgagaattcctgtctctgccacaatcggccaaccgaacatccatgcaatagaaccaatgaatatagcaattgctgaagagaacagaatatgaagtactgtggtccaaaagtatccacatagagtttttggcattttccatatattgccagatttaaaccataggttcattttgaaatgccaagaatttttattgatattcattataagttatcctgtttcatagttggaatcattgcggtaagatatttgaccagttcaatagcgtcgcttttatcaatagctacacaatctccgtcacgttcaatttcgatgatagtattatgttcatacgtgtgaaataccgtaagatacaaatcaataatatgcgggctttcatcttcaattactgcatcgcctttacgggattttccgtcccatactaatttactcgccatcttttgcctctatcaagaattgaattaatgaatcaatttgtttagtgtcaagatgaattatatcattgccttgttttagcacgatacgactcaactttttagtgaaatacgaattcacaacctttacatgcacatcgctgtacggattatctaaattggtactatcaagaatactttccataattacctcaattgtgaatcttttgaaccgcggcgattataggcagaagtcattactgtatcccactttccttgacattctacacaccgttgacagcctttaaccaacagacgacgagctactgggatttcctcatcacaatcaacacaaaactcttcggattcccgctgttcttggagttgtttctgaagacgggcccattcaatcccgtctgctattgtagcttcacgagttgcaaatccgtcatctgatgggccccatccattcatttcaaactctccagaatcatttgcaccaaattatatgtaaacatcggatactggtattgtaccacaatgtagatgataagtaaaacgtttctcattcttcgccatcatcaaagtcgtagtaatcataatcacaactgtcaagataagaatccataaattcttgttgacggcggaaatcttcagaaggggtcagtctgtctgcatatgcttgatcatctggatcgctgaacttatcttcttgcaattctttaatgaactgttcagcttcttcacgtgtccaaaacccacgattaagattatgaacagaacgcttttcacctggcttgaatacacccatatcatgggcagaccgttcagttgaataactttcagtttggccagcatagttttcatattcacaaatcacttggaagaaaggagatttacgtgaatatacaccacgaagaccaagttctacatcatatgtgcctgaagcaacaatgtaacgcgttatttcgccggttttagtttctgtgcgattaacaccacacacgtgataaaagatttttcctggttgaagctcggtagttaacttaatcataatgtttttctcgtttggttgttgatatgtctatagtatcatgtaatgaagggaagtaaacaactttttgaaaagaaaatgcctcccgaaggaggcggagggtattactgcaatgataacaaatacttagtcttgtagcatagacctgtaatgtcatccagaacactttggagggcggcaggaactgacttgtagataccatcggccttagctagaatgaggtctagcatttcaatggtgtcctttggcagctctttctgcgatggtaaagccggtgtataactcttacctgagaatcctaaccactgctcaccaaaagcatctatcaaatctggaatctcgttaaagaaaacttcatacgctttatgtctggcatacgatttggtatcaaaatgcgctgaatgaaaatacgcctgagacgccataagtaaaccgatgaattcatcttgtggagtaagtttaccgtcctttacaaaatcattgaatttcattatcgagttgtatcctcatgcggttagcatattcttcacctgctgaacgtcctaaagaatcgcaatctttagaacaagactcactcttccatttactttgtataaaagaatagaactgttcagactcttgcttactaggctccttaaatttagcataaacttgtagagctccctcaacatacgagttataatccgaaatgtcgttgtgtgatgcagctgggagtgaaatcccgcagcccaacaccagggctaagcaaatgtgattaaaggccatacggcctcctattatttttgtccagtattacgtttgtgctgaagtacagccttaacttctttgaggtatttgtccagcttacgtttacgggtataatctgcttttgaactgtgctgacgaatttcttcctgaaggtgcgaaataccatgcccaatctcacgacgaagttcgtccagttgttctacagtaagattacgaagttgcttttcacttaaatgctgcatatacacctcatcagttagtaatagtatttatataagtatgtgttacttaatcccaaagccattcgcagatgccttgctcaatagttctagcacctgcttcgtcccagttatattcttcgtcatacttcaatgcgcgtttaatttcggctttatgaaatagacgtgggatcggcatagcataacgggtccaacgtaaagttttccagaatccatcgcgctttgatttagcaattaatttcttggcctctagcggtctttcccgattttcagaaatacgcagttcaacatatttctgttgggtttctttatctttctgagttttaacgtattcgttatagcttttaatataagcaaattcgttattattctgatcgttccatttggaagattttactacatgccagcctttgcggcgaattgttctagacattattacctcgttaagttaaattacctcaacgatagtaaaatcctgatttgaaaaatttaatattcatgaatagatgaccttgcatttacattttggacattcaggttctttggttttaagacgcttggtagcagtctttggagcagtgttgttaatcatatacatgaagacaacgatagcacatcacatattttttcatattaaaccaataacgaaagcaatattacgtatagtaagaatccaactacgaatcctagtactataccaccgactataacaaataagctactcatgtttaatataacacccatttgtattagcaataaagtctttaccttgagctaatactttgcattcggaatcaagacgattttgaagttcttctcgtctatcgctttgaatagatgctgctacacccatccaaatgaatagcatacttaaaactagcatcaggatagtgttatacgttcttggcttcattataaacacctaccagttcgcaccagtgtttacgacaaagagaaacgtatttgtcttcaccaccaagttctactacttcaccatcggtaatagcatttccgttttcgtcaatacgagctaccattgtagccttacgtccacagtggcaaacgcccttgagctcaacaagtttatcggctacagaaagaagagctttagaaccttcgaataactcgccgcgaaaatcagtgcgaagcccatatgccattactggaacatcatacaagtcaacgattttacatagctgaagaacatgttcagcagtcaagaattgtgcttcatctacaaatacacaatgaatatcacgttgtgtttgtgcccacttgaaaaactcaaggatatcaatagattcgtctactgtattagcttcatgacgaagaccaatacgtgatgttacctcggtggcagaatctcgagtatcaatagcaggtttaagaatgagagttcccattcctcgttctttgtagttatgcgccgcggtaagaagattagctgatttgcctgcattcatgctcgcgtagttgaaataaagctgtgccattaaagggtctccataaaatcagaaatagcattcttagaacgaatgagttcatcgtattcttcgggtagaccatttccgtaaatggcactaatagctactacttgctcggcacctgcataatcgtcaatcaactgccacagtttatttttttgctctttagtaatcatctatttacctctaacaagatggatttagcttttagcctcttcatattctaccactgtaatgtcaatatcaggggttgctaaattaataagtttctcaattagttcccaatcaccgccagcaataccagcaccaatctttggaatgtatagaggacgattataaacaatacgaccagaatttagttcatggaatgcattaaaaattgcgccgtaatcaacatttggacctggagcatactgagtatacaaattatagcaatatgcagtgccattcttgtgaatggctcgagtatgagttccaagcttggctaaattattgtcataataacggtcttcatcgatgtcaatatcgagaattggaggatatgctttagcaagctgtcctgctacaccggcacccattgtagtaaagcaattacacccatgagcgatatcgcattcatgcttcatgaataactctacaatattgcccttaatatatccagtaatcatttattcacctatggaattttataagttgcgtattcattaagattattgtatactcttaaaaatatagcattgttacaattaaggatagggtttagcactccttgttctttaggatgcattactccatcaacagaaacaccgtcactctgcattccacatccgcgagcattatattcgacgtgtggaactattacctggtcatctttatctagataattataaaatgacattagcaattttctactgctaggaacaaatgctatttcaatattgttcttgaatggaccgttgctttctattttagtcccctgtgctgcaagtatagtttcaggatagcctgggagcttttcccaggcattaactgaaaatgcgcagcataataaaatagctgcttttttcattttgatgatagtcctgacatataacgagccattaattggtcacgatacattaaacatatattttcgttaggagcattgacacacaaatctttcatgctcttagccttacgatttattagtgttgtccactgggccgggctacgtgaatcttttactccatcgctgaatgctgaatctaattcaagcgctaatatatcaacgcattcagagttcgtattgcaaaatgttttagcgatacgaagtgaatctgtcattgaattttcagcattagcagagaatgccaatactaatccaagaagcgcggcgtactttaccattattccacctttatatgtagcattttatgtttctttaagaaatgagctttctctaggacatctgacgcataagagtttcctcttttgacattccatcctgcattataactagcaagagcttttcgcatattgccgttatgtatatttaaccaatatgaaagctcaatatatgcccactccgcagaattacgtctggatttaagcatttttcttatttcagaatcactaaggtttttaccttccagtttagctctggccttaacggtgggtaagtaattttgaaaaaccccataagaatgatggcctttacctgcctttaaattggctcctgccgaagactctttccatgatatagcagccattatatatcctaagccattattatcatatcggttttgtggaggtttttcctttccggatttttgatattgttcaccaaaattatatgcgtaatgcaagttgtcaagttggacattactgaaagttggctcagacccaaaggccgttgaacacaaggccattagaccgacaagcgcttttttcatgtttacctcaattaatgtgtataacttttgtgctgattttacctttcaaacgtttatcattaacgaatgccatacgacactttatactaggtccttttcccggtcttggaatatccatagtaaaccctagccacagatttccatccgtaatttctaaccgcatgggtttatactcgatattttcatcaatgtcttttgggtcaattggaagccaaggcattgctaaaaattcattaatttctttaaggtgattaggaattttggaaagaacagagaatacatactcttcatcaatttcacgttggatagcacggtccaacaaatgatcagagtacttagtgaagaaaggctctttaccctcggctttcgcccgggcacgaacagataaattcaaagagcgaaatgcttcctcaaacttacgacgcagtttagttctgcgaatgaatacttctgggttagttgacatagttcattctcctttgtttatagggccatagtatcatggcccgcaaggaaagtaaactactttttaatatttttcttctggttgaaacactgaacgacacgcccacattgaggcttccttcaggtgctgaatagcattgcgaatttgagtaatacgctcatgtgctaaatcaaattctttgtcgctcattgtgctaacatctaaattcatgtatttttcaacatgctcttcttctaatgctttaaaaattaatccaagacgaatttccgcgtctttgatagcatttactttaccaatcttttcatcggtatgtggcttatatcctttgatatcttcaattgccattatagtgcctctgtgaaagtacgagcgataacgtcgcgctgctgttccggagtcagggagttgaagcgtaccgcatagccggaaacacgaatggtcagctgcggatatttttccggatgctcaaccgcgtccagcagagtttcacgacgcagcacgttcacgttcaggtgctgaccgccttcaatttttaccgctggctggtattcaatttctacttcacgtgccttgtagccataaaaagtttcagcatccgtaatagtatcttctttaagaacttttgaaacgattactcgtgcgtcatcaccatcttcgatgtaaatggtgcctttaagttcaccttcaagaatttgatatgctttcatatttcctcttaattagattctttattccaaccacgcatgtatgcggtaattacactcattttattccattcgtctgaatgaaactttgcagctgcttctagataagttattttatcttcatgataagtaacttcttcatcagtttctttatcgtattccacaatttcaataggctcgttaactccatatccgcgagtgcctatatacgttgtagcttcttcccactgtttggttgtttcattccaagttccattctgatgggcttcatagaaatgctgctcgccagaattactgaaccaagcacagaagctttcaactaaatgtggaggacaccttataacaatttcagccattgcattgttttctcttgaatgcgttggtcatatgtgattaaacttgaactaatcacgcctttgagcttaccggatataaactcaattctaaaattaggatagcgattcatccacttcgtgttgggagcattagaaatgaattctgcgcctttgaatgggccagacagaaacttgtagcgcttgtactcaagcaggttgccagccgtaaccattgttattaattgcttcatatcggcaaatcctgtattttccatcactgtaatcatatcaacaatttctgtctgtgtcatcattgcattcctatcacgaaaaataaaggtaaggtatcattaggcatagaccatctgatagcttcctggtacatatcatagaacttcatcatatcgggaactttcattggttcttcaatgataattaatgctcttccaaactttcttcctctgaacttataagaggaatcattggatagaaattccctgattgtcatcggaacaattgatttagctatctcgttagccggtaatttattaattaaatgcgatgaattatattctcgtagaataccttccatcagttcagatgattgtgtgtatcgagtagataagattataaccgaaccatcttcaagcaaccaatcggtagcgaattggcataaggctgcggtctttccggtttgtcttccaccatctagacgaagggtaccgtactctcgcataaggcaagacggttcataaaaactgtagttgggattatttaatcgtctgtctgcagcgtctttgaaagcatgcatcagggtcaaataaattggtgttaagtatttcataagctctcttttaatggggccattccttggcgcatggagtgagtccattccgataccttatgtaactggcattgccacacttgggctcgaccttattacaggtaggcgggaatccctcatagaatcatgaggtccaggttattccaatgttgtttaaatgtaaatatgaatatactatcacaattctaggagaaagtaaactgttatttacctttaattactttagctgcttcgatagccgcttgctgaaggtcatccatagacataccgaatttagaagcaaagttatcaattttcttttcgacagcattcaaaggcttggcctgtttaccttcattagcgccaggaagagcgagaatacgctctttgtcaatataaaggcttacaagtttcttacggtctttatctgacaaatcatgaaatgaatgggcctttttatttatagcggcttctaatttacctgcactcactcgcgcttcagtgataaattctttataagttttcatttttaaatccagaaaggtaaaagttttaaattaaatggggccattccttggcacatgtttaatccatcgacacactatgtaaaccccttaccgcacttgcgctcgaccttattacaggtaggaaaagctacttcactcagaggactcgacgttcatgaggagaggtcgtgttcggctttattaggaaattgcttacttaattgatttagcgtaacgaatagcgccgcgatcgtttacgaatgcaattttaccattacgcatgtacatggtaaccgtacgctggtaaccgttagaagttttaccagactgataacctactaatgcaaagttatcttcaccaggtttgttctgcttagacttaatacgcatatgtccatgggccattaaagagcgtgcatcgccagatgctactgctttgcgagaagattcatcttcaaccgaagagacaaaatcatcgaatgaatcaaacttagcatggctcttattatataacttgccgtctactacgtagttatatccaacaacgtccatttcaatttctgtgccatcttctagtgtggcggtcatcttctggccttttttaaatttcagaagattacttccaacagattcagtcattacgccaactgttgctaaacgggattcatttaaaaattcttgataggttttcatttattttccttgataagcagaccaagttccggtccgcattgtttcaattacacgacgagcacgattaggtgtctgacgataccaacgtgaatttgcaagttccttggcagcagcatcccattttttagtgagtaataacttcattgaagctgggaacccggctacaccagacacacccatttggaataccatgttaatcagagcagctctacgaacatcatctaatacattatataccgggtttaatgtagcattagcaacaatacctttaattgccttctcaacatctttggcaaaaattacttctgcctcagcctgagtaatttgaccaccagtagaacgacctaccagtttgtccagattagaaatagccaaagattttgacgggtctttagtcagtaagtgaccaataccgatagtccaatacccttcgctatctttataaattttgctgtcgtatccttcatcaatacgcagcatgccaaaaatatccataaggacctcctattaattataggagtatttatttggccctgcacttggctatgaataactcaaggctgcacttctcgtatggtgtccatttatctttccaccacacataatctcttctatcgtcctctggaatttcattaaatccgggatacagcttttctgctatgtaatatgttgattttgtatactcgccgtcaccgaagacgtatcgtgatttcaatagtatacgcgacattttatctctaggatgaaatatgctaacccattttccatcgtgaataaatcgtagctcatgcttataaatgtgtggaatgcctaattcaacggcttcttccataataacctcactgagctgtgctatacatttgtgtcatgattttatacaaacttggtcccatcacatatttccactggcttggtttaattaaagcaaatgcatcgatttcaggaaaattaattccattttcatctttatggtaagctgtacaacggcaatttctgaacatttctgggctcacagggagcatatatccaaacagatggatatccttgttgcttgcataatcatgtcgtccaaggtcatataagaggtcttggtcaaactcggtaaatccagtctcttccttgcattcgcgaatagcagcctcttttggtgtttcaccaggctcaacatgtccttttggaatatcccatctagagcctctgccctggatatatgtatttgtcatacgacccatgaaaagccgtttgtcatcggtaaagaataaaattcctgcactgagctctttcattggcattcgttccagctttcttcaagaatatcttccatggcagtatagaccatagactctaatacaccatcacagttatatgaaccctctaccgagaaatcacagataggtccattaataccaagcagttcttctttaagtgaaatctcgataccgctcagtgattcattatcgctgtaacacagaaggcgagtatcaccattttcaaattttacatgcactgcaacagccattatttcatctccttaatccaggataaagtttcattgcgagagtcatctttagatttttctttctttactttgggcttatcaaatacaccccgctgtcgttgggaaacgaattgcaaccaacgagcaagcattgcaaaccaagttccaacacctgacatccaacctagatagtacaatgtatcaccaaatactggtgaaaagaagtagaatccccagaatatcccaacaccaacaaatgttgagaaggaaaacaggataagcagaaataggaagaaatacaagaaatcatcgtctttaatcattccacgataacaagttttaatcattttctgcagctcctaatccaggtgttgaaatcttctttttctttccacttcttgtatttcatacggtaagctaaaaatgtgcagcaattaatcaacgcgataattagcatccacatgaggctgaatacgaaaacacctaaaaataaaagcataatcataaactctgagacgttcaatccaaagaatgtccctccaacaattacaaaagcacaatataaaatccatgtcacgattccaaaagctggcgccagcccatcttggttccaaaacccgtcaggtttacattcattcattttcttctcacctctttaataaactcaaacgactttttgcggttccattcaagagttaaattcttgcactgttctttccattcagcctttcgttcacagttatgcttaacatactttacccaacgaaatagctcaattaatcctagaccaagtaaacctattaatccccatgtaagtaatagtacattcactaatgatgtactgctaatttcagccaaattcattacgtcgattatgataagcgttatcatagttccagcagcacagaccatccccggaattagaacataatcagtttggtcaaatttatagacataattataaacgggaggttcacttggcagatataaattactcatttctgcaccctctcgcggcagtatttgataaattcatcaatgattaattgtttgcctaccatgttgttagagtcaaacatacccatgacttttggtggtaattcattaacgcagtaatttaaataattgctataatcatcctgagatgtcacgtatttaaccagattaataccgagacgataactagttttattatagataatctcgataactactgtatatgttgtggagctagaagtaaaatattcatcggcattagtacgggctgattttaaatttgatggagaatcgttgaaagaataaattccgtaccgaagtgcaaaaatatccacaagcttaactccgtcggaaatagacgaaatactggaaattaagtttttcagcttgtagtagtctttaagaacgatagcccgcggcaaaactgtggtgttatacccgttatagcgagttttccaattttcaggccgagtatcaggatgagcaaatttttcgagaacatcagtgatttctgttgggaatcctgctgcaattaattctttaatttgaggtgttgccattggaatatctccagcgcattcatataacattttattatccaagttaggggcccgaaggccccggtaaaattacttcagactttccagatattcctggacatcagcagtggtggtttcaataccaggctgagtaccgctgaaggtttcaactttcatcatgatgtcttgtacatctactttagcgagttccgcgatttcaatcacgtcatcagcagaggtaatacccagagcagaagcattacgggtctcacggatgtattcgagtttcactgccaaatcaagacgctggtcatcaagcttaactacagtttcttcaatttgggcccgcatttctttatattcggcagctttatcacgtaaagccttagcagtacgacgatacagaagacccagtttagcatgggtttctacattcataccttctgccatcaagcgacgaatttcacgctctttggaagcacctgcctggtctttttcgtcagcaagtttcagcagacgcttttcttcatttaccgatttaacatgcgtggtacgcagtttagtgatttcatcaataatacgatttgctgcagtggtgtactggtcttcaacagaagtgttctgtgcaacaaaggtaccgaatttagaacggatgaattcaacaagttttttcagaatagacattttatttcctttcaatagttatggtggttttattcgtacggattaatccaatcataaacatatggtttaatgattagaccctgttcatttttgctgcgctcgaatatctcgatataatcagtaacgtatgattctaatccgagaataagtacagactctttgccttcttctactgttgctttaattaaacgctcgatggctattttagcttcaagacgaatatcagcaagagtttttggaacttcatttgtatgcattaatgagttcctccattttgtccaaaactgcgatatcaacaagacgattaacctccgggtcatcggcaaattcattgtaagttgaaatcaccaggttctcgatagttttcagtgcagccattcgttcttcaccggatggaaaatttggagtttcaccaaacagcctagcaaaagatttaaaataagtttgcgctactaatttcaacttatcttgatacataccaatttcctcagtaggtggggagttcattataactccccaaaattattagcagttaattaccgcttcaattcgtttaaccaaagcaggaacagttttagcaaacttgatagccatttgaaccgtagcagcttcttcatggtaaactcgaacatagtactcttcaacagcaggccaatctttgcgaacgtgtttaatcaaatctttcagttcacgggtttctgctacgctgaacactgcattctcatgttcgcctttaatccaaaccgcgcgataacgatcaggagtaccgtattgattataaccacgttcaatttggataaagttgaatttagacattttattctccgttactctgttttgttttgatggagctatagtaaccgagttaactggcgttgtaaacaactttgtgcacaaattttcaaataattttagggaatctggaaggactttctggagagtagaatggatttatacagcttgggatatagaaatgccctagatgatttctagggcaataggatttcattatacggtataggataacccagtttggcgacttagttcaacaagatgatgacgcagctgagacagcagaacttttacttcgccaatgtgttgtgtctcatgggcagatggcttagatccttgtgacgcgcgatatttgtatagattatcgagataaacctcaattgatttgtagagggctccattgtcacgtactagcggaatcatctggtcgattgcgctgaacagttcgccagaaccaataatgctaccatattttccacgaacttttagacctggaacatctttcggagcttctttaacaactggcttaacaggttctgctttaggtgcttgtggcgcaggagttgcttttgtggttggcgcagatttttgcccagtcagagatttgaatgcattctgtactttatagtagtcaccaggattgttagtgctgatgccataaagcttttctacggacgcagcaaatttcataaaatctccacgctcaccttttggtaccatgtccatagctgactgccatttaccctttgtcatccgtacggatgcttcgtttaaaaattctttaaaattcattataaattcctaagtattagtgttgatttactatatactatttatactaaaaagccccgtccgaagacagggctctgagaatcgacagcatcacctactggcagatgacctgcgaaattcatttctttggactcggaggcatcagtctcatccaaagaagtatagcgtcaggaggttatgcttgcgacagggaacaaccggctagcggtaatggacgaaccattctcttctatctgacgactcaacgagggcatacgcaagtttcccttcgaattacattacatcgtattcttcaactagatactgataataggaatcgtttgcttcaagttcttccgcatatgatgttgcttcggatttagtgtgaaaaatcttaagaggcaaagaatattcttcatagccatattcacagttccagttattttttactacagcatatactttcatattttcctcattaatttttggtatgggtaggaatcgaacctacaagccattcagcaccagggcctcacgctctacctatttgagctatcacataccagaatttggtgccgattgcaggagtcgaacccgcggcatcttcattacaagtgaagcgctctaccaactgagctaaatcggcgtggtatccccacctggactcgaaccagggactagggtttagaagacccttgttatatcctcttaactatagggacatttggtgcgtcgaacgagactcgaactcgtacgggtttaatcccgggagattttaagtctcctttgtctaccaattccaacatcgacgcaaatatttgttcaggcaggactcgaacctgcacgactgattccgtcggcgatttaccaccatcgccagcatatgatgcaatatgcgagctcaaaaggtgtccgtcaccatgtctaccgatttcaacactgaacaagataattatattactgattatttatagcatttctcaaacgataaagttgattacagaattcgcgttcagtcaaaatcgtttcagaaattttatttttacccatactgtgagtgagcgtagcattccgggtagcagccaaagcttttctgaatccttcatttttactaagtgcatcatatgctcctgttagtaaattctgatatgcttctgaagctcgatgaataggaacacctttccaataaagcgtttgtgttggccaccaacgtttcttcttacctttaaacttagcggactttccgactagtgtacatacatgtgcttgcatttcaggcgaagaaaatttgagggactgcaagaatccctccattgatgcgcattctacgccatcatagataaatttatgaggagcgaaattactcaaagcacatgatggatatgaactacctgaaccgatatccattacttttccttcacgtatttcaaccaatcaacttttaatgggctttctttctgcttatacgtaattccaacatggaatgcaatcggtgcgtcaggaatacgaatttcttcttcaatgttgaagatttctactttctcaaatactcgcatgaaatcatagtcatattcaattggattacccagccaagcctgaatagcatacataacttcatttgagcaagaataatggttatctaaataagcatcaaactcttcatctgtgcaatcatatgcaggaacatcaacaccaaagaatttcttggaaaattcaggagttacatacttctgttcagtatgaagcttttcaagaattgcttcatggttgtaatcattatttccaaggcattcaccacgccgaccattagaagagaaccattcaagaacatgaattacttgattaatctcttccttttctaagccataaaccatttgggtagaataccggtcagcatcattttcccaagtggtaattgccattgctaagcctttaggaataacttgtccaaatttaatatgcatttcaatttccttagttgataatttggtgaccctggcaaagactcgaacatgcaaccaatcccttatgaggggaacgctctaccaattgagctacagggcctttatagaaatcttatgacttttataaaagccctccgaagagggcgccttgtcgggcttatccacctgctaggcagaattactcacacataaaatcagctacttcccagaagtcatttttaactgctactttaaccaccggataaatttcagatgttttaatagaaacaattacatcacctgcgacagtttctaccagaccaacgattttctcgctgcgagcaacaaatttactcaccggatgaaatttaccggtagcagcgaacatagcttcttggtcaacaatcagtgcgatacgtttcattctttttccttgtttgttttgatgtagtaataataacaggttattcttgtagcattaaatctcgaaaatcgttccgttttcccacattgttgtgaacataggagaaaccttaacgaatgatttgcttcgcattgcaacgtagtcgttatctactttagccaatcctgaagcaatatcagtaatgcggccacacttcatagaaccgcgaccacctttattgtatgtgcgttctccgtagaaaacgatatcaccaacttgtacttctcggcctttagaatctttcatcatattttgcctgctgaattcgtttaaaatcgttaacaagttcttttgggtccaacgcattgttaaatggaagaacttgacgtagtttacttactttacaaccagagtgataagcaataacctcttgaatatcacgctcactgaagtattcatatttaatcagtgaatcatatcggcatttaatccatacccacatacctttgcgttcatcaaatgcatatgcaaagtcagcgttaatcattaaatcccgtttagcaaaagatgaaagccctaatgctaaattaaccggtccatccaaagacagcttcaccgtaatagcatttactttatttgcaacaccaataaaaatattcattctatttccttcgcttgttttggccttcttgtcgtgcacgagaacgtcctgctttatgcagtgattcgtaatatgctcggcgtctatcaatgttttctgtacgatatgctttcccgaaatgggatgttttgaagccgtaatatttcataatataattctcaatggcaagtgattggacggtatgcccggcctcgaaccgagtcacatggactttgcagaatccgtgtgtttaatatatcacccatactcgatagcatatctgaacgagactgcaatcccgctactcagcttacaccatcttgtattgtgtcataccgataatttggtctccatagaatgactcgaacattcgacctctccatcccaaatggagcgctctaccagactgagctatacggagtaattttgatttaaaattcttcttgcttgagtgtgacttacaccaatatgtttagcatatttagataattcgcctcgtttagaaaaatcatataatttagaaatttccattctgtaagctctttcatctgtactaactctagctaagtttaattcggatatctttttcttgaattcagccgaatggtgttttcctgcaaatccgcttggcttaccagccatattatctttccatgtaggtaaatccaaggatttcactgattttgaaatctttttcttatgctcatctgataaaggtttattagcacaagattttccaacttttgacatattagttcttcgttgttcggacaagatttcattattacatatgtggtcccatccgccttcaccaccaagctttaagttatatgtatcaggccttttaataaattcttcatttactaggtgtctttccgcatcatacatatctttagcattatcaaaagtttcgagaatttctttttcaaaattttctttgccgtactttttaatagcacgctttaaattcttaccagaacccatgtatccatcttccaacttagaagtagaatgaactccaatataaaacttttgatttattttatttgtaattttataaagatagtaatgcatatcagttcctattaaaagaaccgagcgtctctcgacgagtcacaatttggagcatccaaagggaatcgaacccttatcaagtgagtggaagtcacctataatagccgttatacgatggatgcaaatttggcaggccctgaaggaatcgaaccctcatcactgggtttggagcccagcataatagccgttatactaagaacctgttatttggtgggagtaactggactcgaaccagtcaccgctcgattatcggtcgagagctctaccaaatgagctatactcccatggaaagctaatcatctaattgttgatgtaccactgctatgggcagcgtttaactttcataaatttggcggagagtaaaggagttgaaccctcaccgtttccgatggcccggatttcaagtccggtttgctaccactagcgctactctccaatatttggtgaaggaagtgccatatagacacaattcgcttagcgacaacccagcatgactgtgggtcgtgtatttttccaccattccttcattgttggggtgaccggcggaatttgaatccgcgactacgagaatcacaatctcgagttctaccaactgaactacggccacatcaatattcactccatccatcatgaggacttcatacgaaattaagagaagaatgatcagttcaacccctgtagacgcgttgaatgaatattaatttggctggactatctggattcgaaccagagataccggagtcaaaggccggtgacttaaccgcttgtctatagtccaattatttggaggcggaggcaggactcgaacctgcgcgtgtcgggatatgagcccaacattctaccaactgaagttactccgcatttatccgggttcttgaagtactaacaagtagcttgatgtagaacacgctaaagatataatcttacgaatatagagcttattccgtgggaacaaacagcttcgtcctcggcattatctcacaggactcaaactcatcttcaagaactgccacgttcttatttggcggacctaacggaattcgaatccgtgactctcgcgtgacaggcgagtattttaaccgctgaaactataggtccataattcgctttcagagatactctggcacgatgccgaagcaaaggggaacaggactctcatcaccttggtaccagatgaatcttgtttagcactctgttctaagatgtatccctgaaagcgaactttcaacgccgtaagaaattataacatgaacaagcattaagcaggatgaaatcatactccttaatacaaacgccatgccagggatttctgtgccgacgattttatcagaacgtcttctgacttcttcatttggcgggccgtgcaggtatcgaacctgcctagtcatttctgacacggattaacagtccgtcgcttaccctctcagccaacgacccgaatttggtgggacaccgaagactcgaacttcggacacccggattaaaagtccggtgctctaaccaactgagctagtatccctaaatttggtggggagtaatggagtcgaaccactcgagccttttgagcaacagatttacagtctgtcccgctacccctacggtctaactccccaatgggtaattttatttatactgctctaaaattaatcagagcagttgatagattaataataacaaagaaaacctaaagcatattacacaatcggtgagctctttgatttaaccaggaatacccgatgtggtgaatccatatgagagagcaatacccggtgctcaggaattggacttgtatggaaaggaaccacacgataacctttaggagtaaatcctagcaaaataccaacgcttgctgcagaaagtgacccaccacagtagtatgataccaaatcaccaggctggatttcattgtcaagagaatcggttttgacatgcttaggcgtaactaaatcactaggaattggaacgccttgtgcatcatagtattcatgggcaagaagcttataattctcttgatagaaagtattaaacgcagctctgatattcatcacaatttcctcacaattaatctttgtatgcttcagttgaacctttagcaacggtctcaaatcgggaattcagtatctcaaaatagtcttgatacgttccctggagggcttcatagcattcttctaccgtagaatagacacctctgatttggtcagagccaggagcaggataataattagaccaagttaaaagtgcatacattacttacgtttccagctataatgagccaaaataagaagcactgcaatagcaagtagtgatgaatgcagtgctgccagtagtgcacctagtcctacgcccaaagtaacataatcatacttagttacttcttcacggtgtaaatcatagtttttgatgaaccactgcttaatctttttcatgtgctattttatccattatgaaagaaatgatacccattagaaatgcaacacttaacactgatactgtttcaggaagagacataaaggctgcaccgataatgccaaaacctaacgctcccatgcagatagttgatgcaacatttctaattaattcacaacgtttcattttattctcctcaagttgatagggttatagtatcactactacaacccgttgtaaacaactttattcagcgccagcggcttttaaaagctttttaagattagcagaacctcgggcagaaaaagttaccttaccatctttttcaccgatgctgccggtcaatttagaaagtttatcgctaggaacttttttaaaatcggctaatgtcccgtcaacggtttttgtaacaatcggcagttcatcatcctgtcttttagcttctgtaataaattcttggtacgttttcatgttgcttccgtttggttagtttgttttgatggagctatagtatcaccactaggaccggttgtaaacaactttgtgaaataaattcctatttcaaatcttctgaccagtccagttttagtggctcttggtactctctatcaagcactacaggtacttgaacttcaccctcgaagtgagctggacctacattgtagctgagagtaatgtgcggtgagtaatctgggaaatcatgagttgctcccaaagctcttgcatattggtgacggaattttaagtattctgaatctagcttaagaactagcgtacgtccgtcttgtgtgtcccatacttcaagtttacctgatgtagcaacttcaaaacttcctgaagcacaaacgtatggaacatgaactcttgaatagcatatcgtcgtatgaattttatgacgaggaactggattagggaccttcaactcacgctgaaggtcctcaatagcatcaagagttttctcagagaatttagcagctacatatagaccagtgctaaaatcactgaagttcattaggcatcagcttcttcagtggtttcttctgcgaactgtgcttcgatttttgcaacgaggtcatcaagtttaacctgaccgtcttcgctgatttcaacgccggatacagcaatcagcttctgcagtacttcttcatactgtgcacgcagagcagaaaggccttggatagtttcagacaggtcaaatacacgaactttcagagtatcgacttgggcttgcagttgttcagtagtcatttttgaattcctaatatagtgttgatttttgaataaagttcttctagagaaccgtcgttagttattacgatatcgccttcgcgaatcggaagtccacgctctgtgacgtgagtatcttttttagaaccttcttgctcaggacgaactacatgaataactgtagcacccatcgccctggctacatcaagttcatggtcttggcgggtatctgggacaatgaaataatcataatcaccaaaagtatcagccataaccaaagtgaatcgttttacccaatacatgcgatcgagcttatcacagacaatgtcagtcccaagggtctgcatgagacgacgaattgaccatggctcaacaggtttatttattacaactttacggatgacttccatcgtatcaccgtcaagtattttacgtttgttatcataaaccacaccaggtaaaggcaaatcatgatgaacatattcaatcgcgttcgccatgatacgaatcacgtctttagtagacagatttaaatcttgttcacgatcgtaatcaataccttcaatcatcgaccgagtaatgcgaggaaactgacgtgatgtatcgcgataccactcagtaagcattgcatcagccaacgcatctttaattggacctgctaactgatgctttgttgcgttatagttatccataatgtagtcagcagttgtatctttgccactacgttttttaccaatcaaaaataaaagcttcaaattattacctcatagaaggatgcattcccataactttctgttgatactgggattcgcgagtatcattgacagaaggtctaccagtaattattataccatctttttcaacttcgatgtatttgtactgcaaagttgctacacataccattgctgggtcggattcttcggttaaagaatactcaatttcagataaatcactcacccaacctccgatgtagcggacagttaatactatatcatgtttatcgttatcaagaacatgcattaaaactgcgccaggaaatccttcaccgccgttattccatccagacttgtctcggtcaatgtagttttgacagcttaacatccatttgtacatttgtacccatgaatcaagattttcatctactaaaaatctaacaggaacagcgtcaaactcaaaagtagacccaggcaatttagcacgatgcatgccttgaggcgagcctacagtatcagtagcaggaatatgaattccaggaactacagctgtttgaagattagctttaaacgcttgggtgaggcccccatcagggacctctaatataaagttagttgtgttagtttgattaaacagtccagtagacattatgatttccatacagaagtagcagagtagcgtttgcctttcgacatgaactgctgcagtggtaacatgactacattcgcccaatcagccggttttatctcaattaaagcaccctttatattaccaggaatatatgctttaatcattttgtcagcgccagcaaatcctttaacttggctccagtttatctttaatctggtcttattagatatcactggcgtattagcatactgtttaagaagttcttctaaaaactgctgacgagcctttggcggaatgtagtgaaggtttaacccatacatcaatgtggttgtaccttgctttccaagaccaagataaactatcaaaggaaatttatcccagaatggaagagtgtctttgtgcttagcgtcatacatgtaagcatatagctttccaggttgaggcttggttacagaatgaccacgtatatttttctttatagtttctgcaaaccatttagcagatttattgtttactgctgcgccttcattacgaattttatctttgatagagcttcgaaatgaatttaccatcacaagagcacgctcctgtttggtcattttgttagcaggttttttctcaatttctgctactttaattgccgttttaattcttgatgcatgacgagccattgctttactgaacgtagcaggatttattcctttgctttcagcgaatgatttagacgtcatgccttttttacgagcagcagagtattcaactcctaatgctacccattgattttcactacgggatttagctttaggcgattctgcagcttcagtgataaattcaaatatagccatcagcctttccatcctaattttttaagtgaatcttcggtaattaacctaaattctatacccattttactggcagtagcttgagctgctttccacttatcaacgtttacagaccatgtgtaaatttcatcaatgtaccgtttcttcgctgatgtcgtcaactttgtgggtttgaccggaggtctagtttctttcttcggcttaacttcaaaaaagaactgttgaccattagaaaacttagcccagaaatccatgaaataacggcgtttctttccatcagcattgctgaagtatggaattaccacgcattctgagttccaactaactacatctgggtggttatctaaccaccgcatcatgaaattgctcccaagtagatcggtatgtgatcttacgagggtcccccttatatttgcttaagttttttggtaaaaattttccgctatacgccattaggcttctccttacatttgtcaaagtgccaacacttcattccacgaggttttcctgatttgccacagtgaggacatgttactacaggttgagattctgaaacagccctaagctttgctcgagtttcttccgatctcttctttccggtgttagctaaatttaatttattttggtgctctttagttctatttttagctgcagtagacatgttttgtttcattgtatcgctttttgaaacacctgtcatagaaatactgcgcttttcatttgattctaatgtctgagactttccagtaagagctgcagacagtttagctgaccattcctttgacctttgacttcgcttctttcctgttaatatcacagaattagcaatagaaactcttttgcgaatccattcatatgatttgttatttcttcctgctaatttagaagacatgatatgaactgcgtatgataacttgtgattatctggataaatcttagctaaaagctgatgcgcaacataatgttcagctgcagtcaaatctacgaggttatcttcatcatcagtaccacccatacatcttggtacaatatgatgtcgttctttatatccttccaagctgcgagatttgcctctctcaataagctgatcataaattttacgataattcatattattctcctcagtagttgatagggtaataataccataaaccactcgtcatgtatactacaactttataaatactgttattaatatttataagaggataaactatgctcttctcattttttagtccgatagattattctgcaaagaccgtaaaaggtgctaaggcaaaagctatcccaaccgctgacatatttcgtaattatcgcaaatattttgacactgtggcagaaaactatcttttacaaacatattacataagtggagctcctagaccagaagaattagcatatattctttatggaaatagtcagctgtactggattcttttaatgtgtaataatgtatatgacccgtttagagattggattaaaacccaggatgcatgctatcaatttgcacaacaaaaatatgcagatgtaggtggagaccaaatactctatcacgtggatgcaaacggcaatcgttattataacctcgagcaatatcctgaaaattcaggcatttggtatgataaaggggactttaatcaccagtaccctcaatatactggggctttagctggtgttgacatttatgaagactctattatagaaaatgaaaaactgcgccaaataaacattatcaatcctagtgatattgaggcatttctttctgatattatacgagaaatggaaaaagcacctgacagcgaatacgaatcaggccggtacaaatcccagactacaatcggagaagttttatgattgaaatgaatgattcattaaaatggtttaccggtgttgttgaagacagacaagacccgttgaaacaaggaagagtgcgagtacgtgtttatgggcttcatccatttgaaaaggtgcaaggagctataaccggtcttcctaccgaagaccttccttggatgtcagtgattcagcctactaactcagctggaatttccggagttggctcgtctataactggaatggtggaaggaacatcggtatttggcttatggcttgatgaattcaaaacagcaggattagtaataggaacatattctgcgcacagaaaaactaagccaaactacacggaaggtttttctgaccccacaggtcaatatcctagacaggttgggtcagataccaacccactagttcaaggcgatgaaactgggtatagtgctataccaaacatcatccaagatagaaacttggatattggcattaatcctgacgatgctgacctaagcgatattcctgaagacccaaatcctgcaattacaataacagatatgcttaatagggatgaaggtcttagattgaaagtctattgggatacagaaggatatcctactgtaggtattggacaccttatcatggcacaaaaagtacgtgatatgtctgtcattaataaaactttatctaatcaggttggtcgtactgttacaggaaatcccggtatcattacaatggacgaagcagttgcactatttaagaaagatcgtgataaaatgctttctgatattaaaacgaattcacgggtaggacctgtatatgctaaagtcaacaaatcaaggcaaatggctttagaaaatatgagttttcaaatgggcgtaggtggattagcaaaatttggtaaaatgcttgatgccatgctcattggtgattggaaaaccgcttatacagaagcaagaaactctgtttggtttaatcagacaaaaggtcgtgcttctcgtgtttccatgattattctaacgggtaatatggaatcatatggagttcctgctccaaagccagaaggaaaaaacctgtctgcggcttatgtagaaccgaagtctggtggtaatcctgaagacccatggaccccagaggattcaagaattctttttaaagagcccgaatcttcatataatggtcaatatccatatgtacatacgatggaaacagaatcaggccatatccaagaatttgatgatacgcctggctatgaacgctatcgtattgttcatccaaccggttcatatgaagaggttgctcctgatggacgtcgtaccagaaaaactgtagccgatttatatgacatgactcagggcgatggaaatattttaatctctggggataagaaggttaacgttggagggaacgagacctattataacatgtataatcgtcgacagcaaattgatggcgataacacgctttatgtacgtggaaatgaaactaaaacgattgaaggtgatggtactatttttgtcaagggtaacattaagatagtcgttgaaggaaatgctgatatccaagtcaatggtgatgccactactaaagtagatggcaaccacgacgtgaccgtcggtggtaatttaacttggcaggtagcaggtactgtgaattggaatgttggtggggcttggactgaaacaatggcttctatgagctcaatcgcccaaggccaatacactgttgatggttcacgaattgatgtaggttaatcatggctgatatacttcctattaataccacgttacgcgaagtaatagaaggtgaatacgttgagcagtactttactgctcaattatctaccaacgaaacattaaaatcaataaatattatcgactatcaaccagtatctgatatctctgtgtctgaaacctattataaaggtaattataactcagtttttacttttggaaacgatgtgcttaaataccgtgaaggtgatgagctaaagtccgcttcagcgtgggaggatttacctaatcccaaaactgctgatttgtatctatggaaagcccccagaacactagagaagacatttacctatacagttgagataatatatacagtgacagaagaatcgtctggaggttcatccggaggttctagcgctccaatcataacagaacataaaaagcaaaagatttactctcaaaccgttaaaggcaactggagtagatggggcgaccaacttcgtgcttacgtatatgcggggaattaaatggctggtctttcatatgataaatgcataactgccgggcatagtgcgtatcctccgacagaagtaaatgctacacaaagtaaagtattcactggtggaatagcggtattagttgatggcgactcaattaccccacacaccaagacggttgaccctcatgatacgcatggaggagttgttcaacctcgcacatccaaggtatttgtaacaggcaaaaaagctgttcaaatggccgatccaatttcttgtggcgacactgtcgcgcaatcaagctcaaaggtattcatacactaatggctattaaagaacctttaaattatcagttaacgcgtactgcaaacgctatcccagacgcatttactggagcaacattcgatgaaattaaaaatcagcttattaactggcttagcggtcaaaaagagtttcaggactttgattttgctggttcgcgtttaaacgtgctattagacttattagcatataacacgctttacatacagcaatttagtaatactgctttatacgaaagctttatcggaacagctaacttgagaagttccgttgttcaagcagctcagcaaaacgggtatttgccaagttccaaatcagcggctactgcgtctattatgcttgaggtaactcatccaaatccagagccagcaataaaaatacctcgtggaaccaagtttttagcatatgcacgagattcatcagtagacccatacaactttgttgttactgaaaatgttattgcgctaagagatacttcagcaccagaaggggttaatagatatcttcctattgtcaatttggcgcagggacgtattattcgtactcagttgtcatatgacccgaagaaacctattgttattcgcgatcagtcaattgaccgcaagcaggttaagctgtgggtggatggcgctgaatggactaactggacagaccggtcaatggttcatgcttcgtctatttcaacgatttattatatgcgtgaaactgtcgatggaaataccgaattcttctttggtgaaggcgtggcagaagcctctgtagcaggaggagttcttgaaagtaatttcattggtggattaaaacctactaagggtgcgcaagtcgttattgaatatattcgtactgatggtgaagctgcgaatggtgcgactgatttcagctatgctgataccctgcaatatatcgtagtaaacaaaatcattgaaaactggtcagattctcctgattatgttggtgctgatggtggtggggaacctgaagacatcgagcgtattcgtgagctcgcccagattaagcgcgaatctcaaatgcgttgcgtgtctaaaactgactatgaatcattcgttagttcacgctttggttctatcgtacaagcagtgcaatgctttactgatcaggacaaacccggatatgcatttatcgcaattaaaccaaaatctgggttgcagttaactgcggttcaacgagaagacattcaggattatctaaaacctttctgtcttgctccgattactccttcggtaatgagtccagactacttgttcatccgtcacaatattaaagcttcttatgcattgaataagttgcaagaatcagagcagtggttacagtcaaaaattatagactcgattaatagatattatgttgatgaagttgaaatgttcaacaaaaatttcagtaaatctaagttgttgacttacattgatgacactgaccactcaatcatcggttcttctgtggatattcagatggttcgtgaaattgtcaactatttcactcttcctagcgcaggtattaaatactataatactattactccgcggacgttacgttctggtgatttggtctttactgttaccccaactgctgaaccgtattcagttaatatcgttggaactgacccagataaaaatggcaaaggaaatatggttattggaccatttaaaccaggtgacattaaagagaatactcatatccagccatatactgaaaacgattttgatagaactaccgtcggcgaaagaactcgttggtacaaaatcggtgaagtagattattatggtgataatatttactggagccttggagctattggagccgatcctcttcagtttgaagaccagagtattgagctttattctactcctacccaggatatcgtcttcgcccgcgatggaacacttatcgtatttgagaatgaccttcgtcctcaatacacaactattaaattggagcctattacagcttaatgaagtataatgaaatttatgatagtttaattaaaagaggcctcgaaagaggccttaataaaaagaagcttgattatcatacagaaaaacatcacattattcctaagtgtatgggaggagttaataataattctaactatgtattgctaactcccagagaacattttgtagctcatcaattgttagtaaaaatatataaagatactaagtatttctataagttagttagagctctcaacgcgatgtcaatgtttaatgataaatattctagacccaacgctaaagaatatgaatgggtacgaactttatgttataacgcgaataaattgactaatgtgggaagaaagcataaacctgaaactctacgtctgttctcggagcaacgtagaggtgctaataacccaatgtatggaagaaagggtgaattgtctccatcatttggtaaaaagaggagtaaagaatctaatgataagatatggttaaatcgaagcagaaatattagtcagaaagcaaaatataatatttcaaaggggaaacgaacatctcctatatggaaagaacctatgtataatgaattgtttaatttatacataagtaatccggtaggaggatgcgcgtttagaactaaagccgtgtctttaggatatcctaatacttcataccacagactagtacaagaatttaaggaaattactcaatgacaattgcaccgttcgtcaccagcttacgaattcataagctatctgcgaatcaggtcaatattcgttgggatgacgttggtgcaaacttctactattttgtagaactggccgaaactcgaaacagagcgggggaagttatccccgctgataacttgagttggtcttcactgggttataccgcggataatgattggttcgaacaaaatcgtattgaaccgcttacttattataaaatgcgtgttcaaactacgtcagcagggtttgagccgtctgaatgggttgaaacagaagagttccaaacttttgaagaaaacgcatacacatttgagcatatgcaagaattcagtttagtgaaagaattcattaaacagaagttttctttaaacaacatgtcgtatgttaacttcaacacatctgccatgatggcatctttgatgactgagtcttttcagtttagtcctgaatattctcatttatcagctattgaaaacttcgttgtaggtgaatctggatatcatgaaattcagggacctattgaagcagtgtgtgttgataaaaatagaactatgctgggagaaatagacggaattttgtatctgtttgaaagattccaacatatggttaaagtatcaaacgataaaggacagaactggcaatacgttcagttatttaatgaccgtgtaggaaatcctgtttcacgagtagtaatttatcaatcaagtaccacatcatatgttttaggctatgataaaatcttttacggaagaaaatcatctgacgtacgctggtcatcaaatgaggttaaatttagcgataacgaagtcacgttcgctaaattgggagaccagttaaaactgggatttgaagtagagttatttggtacatatgcatcactacctgctgatgttaccaaatatgcagaagcctttacatgcaatgatgaccacttatatgtagttgcaaaggatacagtacgcagagttaaattaaaagatgctccaatagacactgaccctttaagccctacatttggtgaaaaagtgtttgaaaaggaagtatctcatataacaggcaatcctaaatctgtatgctttaaaatggattccgttggaggcaaaatctttgcccttattaccggggaagttaaaaccttaggattagacccaacagacccaaggaacgttgtggattctgcaactaaaggcgtctatgtttaccaggaaggcacaaatacttggaagcgtgtatttggtaataccgatgaagaaaaacgtcgtatagagcatttatggacttctatgtcaactgacggaaaggaaatattcttttcatcagctaattttaagacaacagagtacgctcaggatattgagcttgagacgaaatatccagaactaatttctactgcagttaaaaatgttaatccaattcagtatcactctgataagcattatcacatgatgagtttcagagcagatgaattttcaggatgggaaacatttgttcctggacctatgaggttttatgctgaaccttggtttgtctggatggctcgtgaaggcaacagatgctggataagtacagctgaccatgcagttgtcatttataatgatattctttatcaaaaaagagtagatgcagcggcgcagggaactaccgagcgtattctatcggaagtgtgggataaaggtgacgcaacgttttattgccctccagtttcatttaatggatttttgcagtatgcttctggcatcatgtttcacgaaccagacggaaaactgataggctattacgcatttgactaccgtgttcgtgaccaggtaacgcttaactggaaaccaactgatgtaatgtttaaggcgtttctgcagaaccaaacacgggaagaagactggacacctgaacatactccaggcttacgtgacccagatttgcgtccgtatcttactaaaatgatgccggatagttacttgctacaagatagtaattttgagcacttttgtaagtactatctccaattcctttcagatggaaatggaacacattacaacagtctcgttaatcttgttaagaacaaatatcctcgcgaagaaaatgcatgggaatatctgtggtcagaagtttataaacgcaacatttatctgagtaaagacgctcgtgacgctgtcgtccgtttctttgaagcacgcaagaatgatttctatgctactaaaggaattgaagactcatataagttcctgtttaaacttctttataacgaagacgtcgaaatcgatattgagtcaaagaacactaccgaatatgacattattgttgaaagtacaaatatttctgacgatttagttggtcgtacgatttatactgcttccggtcgtagtaatgtgacttatatcgagagagaataccgggatggtcgtctgttatggcgtattactattcataacttatcaggacggttcattgaaggccaggaaattaaatcagagcgtacggactttgagggtattatagttcaaggtgtccgtggaaaggatatgctgagtaataacattgattatataaaccgcagccgttcttactatgttatgaaaattaagtctcagcttcctacttctcgtttccgcgacgatgtattaaggtttgttcatccggtaggtttcggtttcattggtataacattgctgacaatgtttatcaatagtggcttaaatatgaagcatgttgagactatcataaataaactcaagaactataaatgggatgcaggactgccatcagtttatcctgatagagttgctattatcgcctcagatgatacaatagaaagggatccaataactaatgagcctagatattcttctcgtgctcaagctggcgaacctttcccattacctgctaactataatcaagaaaataataatagtgttatcgctggacaaaacccaggacaaagacgtaaacctctgagtcctacatttgaccaatcagcagtaacgtttgccaattatcgtgatttagttaaccaacgtcttaaagacgatgcaggtaatcctcgcgatcctgaaaatccgacacaggtaaaaattgatgagtaattcaacaagagcaagttcaacgcgtagcacgatttatcgtgctatcattacatctaagtttagaactgaaaagatgtacacattttataaatcgattggtccgggaacggaccaaaacacactgtatgtttcatttggcaaaagcactccgtggtcagataacgaatctgaacccggatttgcacctccatatcccgctgataatggagatggggtagttgatgtttggacaaatatgatgggcgcggtcaaaattgaatcatcaatgcttgattgcgttgttccaagaagagactggggtgatactagatatcctaacccgcgtacatttttgattggtgatattgttgttgctaactctgcgccatataacagaactgacgctggatttggatggatggtatatagatgtattgatgttccaaaagacggaatgtgttcaattggaaatcttacaagcaaagatgaatgtattaagcttggaggtaaatggacaccatcagctatttcaggttcagctcctcgtggtcgtggtgatgcaaatggtactgtcgatttaggtgatggatatctttgggaatatctatatgaaatcccagctgatgtatcaatcaacagatgcacaaatgaatatattgtagttccttggccagaagagattcaagaatctccggctcgttggggatttcaaaacaacttaacatggcagcaaaatgactttaatttaatttatcgcatgaagtgcaatacgattagatttaaagcatatcttgacgcaatttatttcccagaatttagtcttccaggaaatactgggtttagacagctgtcaattataactaatccgcttgaagttaagccaatgccaaattcacctaatgttaaggctgaaaaaggctggtatagtgcttctggtcttgaaagacagtcaggtgaaatgatttacatggaaaatcggcaacctattatacgttcaatggaccaaacagaagagttaaatttaattttcgagttttaattatggggagcctttggctccccatttttatataaataagactatactttgatatgaggttaacctatgtatacagataagggtaaaaaaataattgacgtcggtgagattggtaatgcttctaccggcgacattctgtatgatggcggtgtgaaaattaatgataacttcgacgccatttacaacgccttcgccgaccaacgattatttgcagctggcggcggagcattgaaccaaaaaattcatgcaacaagctattaccaaaagataaaatttggagatgctaactctgcagggacagttccaatggggtcatgcatagatgctgattgttcagaaggcgcagttcaaatacgtctttcaaaaggtaaagcgggagaagctgtattcgttgtaaatagtaatggctcagcatcaaaagctagatccataaaaataacaacaaacggcgaaggcgtagcagatgcatttaaagacggatcgcgagagttgattatcaacacgccaagatgcagaattgagctatggtgtgttgaggtaaaagctaacggtgctgctgtttgggattattcaatttcaagtatgtttggcagcacatattcgccattagaagctacatataatttaacaagttctcctattaatatccgcattggatataatgatgattactccaccgttaaattgttattaagcttcagtgcaaatccgggtggtcaaaccatcaaaaggcaatcatctgaagtcatgcttatgattgacccgactattacttcatcagcgccaaacggaagagtatttgacactgaatatgcagtgttaagaagtggtgaatcatctgaaaatgaaaagatgtattctatttcatactctattaacgcgcagaaagatttaatatgcacagcttcaacatcttatggaaacgcacgtttggcagttaaagttattgctacacagaccgtaggggtatctcaataatgaaacaaaatttgatagtaggccaatcagtagatgatgggtctggtgattacctccgtaaaggtggtcttaaaattaataacaactttgatgatttatattcagagttaggtgatggttcagttccattcgcagcaggtgcatggaaaacttttaaagctagccctactggaactactttaaatgctaagtttggtcaggcctttgctattaatacccaggcagcaagagttaacgttcagcttccaaagggtacagccaacgactataacaaagttattaaacttcgtgatgtttggtcaacctggcgattaagcccaatcacagttattcctgctcaaggcgatacattaaaaggttcagcttctcctaaaattttcaatactaacttccaagatttggaattagtttattgcgcccctggccgctgggaatatattgaaaataaaacggtagataagctaactaacggtaacttaagtactgtagcgaaaaaatcaattattgctactgcgggtcagactgactttcttaacatttttgatggcgtagaatataacgaagactcgcttaatgtatatcgtcgtggtaatattttatattacggtgaaaccagtgttatggataaagccaatgctgattacggttctcctggaacagtagcaggtcaattggtagaattaaacggtaaagacattcgtttaaaagttccatgcgttgaaggggaagtaataacatttgaaaccttcctagatggaattggtgtttatcggtcttcatacaacaagttggctatccagatacgagattcagcccagactacatcccagacgattcctgggtcaatgatagtagataaccttgctactctccgcagaatcactctggatgacatgggtgtacttccaggcgtaggggtaaatcctaactcgcttgaaatttcattgaacggaaaggaattactcgaagctggaactgctggtcttcctttattttattgtgaaggcgcagaaggtggatacgcagaagactgtataaacaatggtggtcaatgggtaaattctaaccaagattatagactggaatttgactcaactggtactaacgtcgaagctattatttttggtgaggcgtttgaagataaagaccttcttaccgtccgttggttcaataataacatcggtactactatggatatcaatgatatcatggcagaaaccgaccaagtgtatatgaatgctgagcaattagtaactctaaaaaatcgcattgaatacacaaattatgatgaacctaatcagaaaaatatgcgtccggttgctgacgatattatgattaaagtcaataatattgcagcattttttgacgtaatttatccgattggcacgatttatgaaaacgctcacaaccacgcaaaccctgctgactatatgggatttggggtgtggaagctttattcacaaggccgtgttactgctggttggaataatgattcatctgatccttatttttcgcgtaacaacaataacttaaacgaaaatggtcagccatcattaacagcaggtggaacggttggagatttgacatttacgttaggaaaagaacacattcctgaactaatgtcaagagataaagttctaatttcagaccctgaacatggaagcgtagttatcggtggatgtcaattagacccagacgcgcagggaccaggttattctaaataccgtgaagacactgttgcggtaaacaacggtgtagttccaaatgacatcactaaaattcagccaacaatcaccgtttatcgttggattagggtaggttaaaatgacgattgaaactaaaactcgtgaaggagctaaagttaattcaagattagctgctttttcagaatatcgcgttgacccgcaaaatattgcggtaggaaatacggctcctatagggagcctaacctttgaacaaatggatttaggggtttggtatccaaatactgaagctgctattaatgatttgatgtcattgcagtcagcagaaattggaactattatttgcaatgacactggaatatctccacagcccgcacagcaaattacgcgtgctactttttcaggtgtcgttgcgttagagccaaaagaagacggctctgtcggtgacccagtaataattcatattcttggcttaccaattagaattgcaaacggtgatgactttgcagcagtagcaacacgttggtatgataaagtaaaagaattagaagctgttggaaaggttgttcaacaggttactcaatcgccggcaacaccccagtatgttgatattattcatttagattatcagaaccataattttgaaacatataaaaagtatggtttaactgttgaatttactattacttcaccagctaaagcaggttatgggcaatgggatgctatcggcaacgaatctaaaacattcggcgcgaacacatttactttccactattttagaaggatgggataatggcccagaataactataatcactacagtgatttggccaaatatacgatatttgacccaacaaatacacaatggcctgttgctataaaagacgtccaatcagcgttagagctgattggtagctgggcaagaactgataccggattacctgtagcatctcctacagtagccggtgtaattcgcacagcaacacaggctgaagttgatgctggaactattggtaatgctgcggtaactcctgctacattaaaatccacagttacccgtcctgaagcaactacagcagttcttggcttaacacgatatgctactaatactgaagccgcagcattaaccgcaggaaatagaactattaccgcggcggctctcggtcatgtgtttaaaaccgtaaaagcccaagaaaacgtagatggaactgttaggttaactactgcggctcaagcgcaagcaggaactgacgaaactaccgcagtaactcctaagcgtgttgtagaaatgattggaaagttcagcgttagtcctcctagttatacctctgcgacagaaagcaacttgggattagttcgtgtcgcaacccaagcccaggtagcagcaggcgctgttcacgatggatacgcagtaactccaaaaaccttcatggaatcaaaagcgtctgacagtgtatttggtatagtaaaatttgctaaagactcagatgtggcttcagctacttctaacaatttggctgttactccaaaaagtcttcaagcgctaaaatccaccaaggataaatatggattaaccagattatcaggttctccaactactgatgcttcattggcagcggctgcaacagatgcagtctttaaaacccgtagaataaacggaaaaactcttgacaatgacataacgattactaacaatgatattaattgttatacaagacaagaatctgacgggcgttacatgccagctggaaccagagtaggtaatgttacttgggttgaaggtcaatcttggattagtcgaggtgcaacgtttacatgtaatgcaccatgggaagcttctagtagattagctctaaatgttaatgtaaaatttgagcgtaacaacgacggatatgacaatcgtattttcagatttgttgtaatagttaacggttcccaatggggcggtgaacttactcttaacatcgaaaatactaaaggcggacgaaatggtcattcatggagatttgaagcttacgcatctagcaactttttcttcaataacattcctccaaatgccactgttcaaataagaccaacagaagacagtcgtattatattttatgactgcatgcttacattctgtacaaatagaccgtaaggaacaatatgaccaaactagtagattcgcttccgttcgtagacggaattccagacgattttcaacagagaattaactggataaaaaatacagagcctcttaatggggcttcaacccgctatggaaatgatggagaactgaatagagcttctgttcaaatccagaaaaacgttgttcaggtacataacgatttgaacaacgttggaactgctgtagaaaatattcaagtagatgtagaccaaatcaaaaaatcgttagaaattacaggttcttctgacgccattgagcaggtttatatcaataaaaagaatattgaaaagcatgatggacaaattcttaaattagaagaagacaccgaaaaacttcgaactgaccttgattttctcgaagaggatgtaggtgtttatgattctagtaaagatgactattacagaacagttcgtgataatatagtttgggttaaacgtgaaattggtgcgtatcctgggcaagatattaacggacagccgaagcaagactctccgggttctggtatgaaataccgaatcatcaataatgcgtcagctatagtaaaacatgacgagcgtattcaggcgctagaggatgcatacaatgattcagacgtaggttctctgactattgaagtaaacgacctgcgtaaagaagttggtcctaaatccggagctacgtcagcttcaatttatgcaaggcttgtgaataacgctgatgctatttccgcagctaataatgaaatctttgctattaaccaagccattgattttaccaatccagtaaaaattggagctcgtactactagattagaaaacgattatcgtatagttgacgcaacacttaactctgcacaaaccgggttagttcctcgtgtcaataatattgatgctcgtttagggtcttctgataagcctgatactattgaaggaaaaattagttctctttcaactgaccaagggtacatttctgatgttgtaggacgtgatacttcatcagggcttcagggtcaagtagcatggataaaccaacaggttggtattgttcctagcgagcagccgattcctcctgggtcaattttagcgagaatgaccaatgttgaaggtatgcaaaactctcaacagtctgctattcaggacattcaagtagaacttggcaataacaatgaagggttaaagggttctgtatttacattacagactcaaatgaatggtgacttttcgtcagaaaacccagttcaacgtgatggtgtatacgctactgtagtagaattgcaagataaattcgtgactgcagttactgacgtagaacaagctggagcatacctccgtaaacagggcgaatggtttaaaaaaccttcatcaataggtgaattcagtaaagaagatttcactgttgatttaagttctgatgcattggtaaatcctaactcattggtcgctgctccattcaatgctggcattcgtattgtcgatgacattgttgttgatgacgatggcgtattttgcgtagaaactgatacggttatcgaagcttctgattcagataaaggcgtgaaaattgttattctcgttaataacattgaggtgttttcctacggacttggtgttaaagcagtaacgggcgagcagttgattaaaaccaagaaactcattgagttttcatctggtgatgcaatcaaaatcgtgtatagagctgcttcagaagaatcgcaggttcttgttaaaattaaatctttggatattactattcatccagctgtataacaaaaggggaccttcgggtccctttttcgtataaataggaatataaagaggagttcatatgtcatacaacacgtacaacccaaaaacgcttaaagacgctatacttcgacgtctaggagcgccggtaattaatgtagaagtaactgaagaccaaatttatgattgtattcaacgagcattagagttgtatggtgaataccactttaacggattgaataaaggttatcaggttttttatattggaaaagacgaagctgacaacgcaagatttttaaacggcgtgtttgatttgcgcggtcgtaatgtatttgctgtcacccaaattgttagaacaaatgtaggttcattaacttcaatggatggtaatgcgacatatccatggtttactgactttctaatgggaatggcaggaattaatggcggaatggggtcaagctgtaataaaagctatgggccaaacgctttcggtgctgaccttggctattttacacaattgatgacttactggtcaatgatgcaagatttacttgctcctctcccagattattggtataactctgataatgaaatgcttaaagtaatgggcaacttcatgaagggtgacatcattgtctgtgaatgctggaccaaatcatttatgaatacagatgtgatggtaggcaatacagcaggatatggattcgccggagcccaaactgctgaccactggggtttaggagatagataccagaatcctgaccttcgcaataacggccaatatgctggtgaaggcaatacaaatagagaaggtgcatataataatcgttgggtaaaagattatgctacagcattaactaaaaagctgtggggtgaaattctttttaaacatcagggtctgcaattggcaggtggagttacagttgatggtcaaacacttaaggtagaggcccaagaagaaatcgagaggctccgagaggaacttgatttacttgacccgggttgtcctattctgttggggtaaaagatgtctacatttgattctaggctcttcgctaaactcgaagattatcgaggatataataaaactaatgagactgaaattctcaatccttatgtgaatttttacaatcataaaaatagccaaacgttagcagatgctttatcggctgaggctattcaaatgagaggaattgagttttatttccttcctcgtgaatataacaatcctgatttgctttttggagaagacccatcaagtaaattcaccaaagcttggaaatttgctgcttatttagattcatttgaaggatattctggcgataacacattctttagtaaatttggtatgatggttaatgatgaagtcaatctgactattaatcctaatttattcaagcatcaaactaataattctgaaccaaaagccggtgatctaatttattttcctatggataactcattattcgaaattaactgggttcagccatacgatccattttatcagttaggtcaaaatgttcaacgcaagattactgcacaaaaatacatttattctggtgagcagcttcagccagaattgcaacgtaatgaaggcattaatattcctgaattttctgagcttgatttagaaccaatcaaaaatatagatgctcttgctgatatttctgatgtgcaatacgcagaaagtgacgcaatcaataaagaagccgctgaatatgttcatccgtattatgttaataacggaagaggacttgaatctcctcctaaagcagattcatttgatgacggatttttcgaataaataaaataaagatgggacctttgggtcccttaggagaaatcatgtttggacattggtataattcgtccttacgccgatacattgtattgcttggagatttattttctcatgtacaaattgctcgttggcgtgaagacactggactaaaatatattaaagtacctatcacttatgcttcaaaggaaaagttcctttctcagcttggaaaatggactgctattcagtctaccgagaataaagcaaaaatagaaactgttttgccaagaatgaatttgcacttggttgatatgcaatacaacgcgatgtataaaacatcacagctgaatagaacaaaatcatataaaactccttcaaaaattacatctcaatataatcctactcctattaagatgatttttgaattaggaatttatacacgcaatcaagatgatatgtatcaaatcatcgagcaaatcgttccttattttcagcctcacttcaatacgaccataactgagctttacgacaaagacacaagttttaatcgtgatgttagaattgtattacagtcattttctccggatgaagctgttgatggagacaatatcactcgtcgtagattagaatggtcattaatgtttgaagtcaatggttggctgtatccgcctgtagctgaaattgatggcgaaattagaaccatttatttagatttcttcgctaacagcaaagagttaactccagaaggaaactttgaatcagtagatagcgaagttactccacgagatgttcagcatgaagattggaatggttctagtaaacaaacgtattctcatgatattcctattccggtaaatccggaggctcctggaccgagaggtgaaaaatgagtgaattacaattagatatggctaaattattagacatcgaaggaattcctggaatagaaggacaagaaattccggtttatgaaaaactcgaattagttgaggttaaatctaacccaaatgaccgtaagcctgacctcgaagatgactattcggtcgttcgtaagaacatgcactttcaacagcaaatgttaatggacgcagctaaaatatttttggaaactgctaagaatgctgactctcctagacatatggaagtatttgcaactcttatgggtcagatgactacaaccaacaaagaaattcttaagcttcataaagaaatgaaagacattacttctgagcaggttggcaccggaaagggagctaatcctcagcaaggaatgaatattcaaaatgcaacagtctttgtagggtctaccgctgatatgatggatgaattcggtgatgcctatgaagcacaagaagctcgagagaaaatagtaaatggaacagactcaaccgtttaacgttctgagcgatgcccatcctttaaatgacgggaaactgacggttattcgtcacccgtctgaaatggaaacgaaaattgaaaacggagttcgtttctttaaatcgcaatgggatgataagtggtatcctgagaagtttgaagactatcttaagttgcatgggatagttaaaattcgtttgcaaggtgaagacccagctcatttccaaacgtttaaggacaaaaacaataagcgcacccgctatatgggattaccaaaccttaaacgagcaaatattaaaatgcagttgacgcgtgaaatagttgcagaatggaagaaatgccgagatgatattgtgtacttcgcagagacctactgtgcaattactcacattgactatggtaccattaaagtccagcttcgtgattaccagagggacatgctggaaatcatggcagccaaacgtatgacttgttgtaacctcagtcgtcagctcggtaaaactactgtagtagcaatctttcttgcgcacttcgtgtgttttaataaggataaagcagtaggtattcttgcgcataaaggctcaatgtctgcggaagttctcgaccgtactaagcaagcaattgaattacttcctgactttcttcagcctggtattgttgaatggaacaaaggctcaatcgaattagataatggctcatctattggggcatacgcttcgagtcctgatgccgttcgtggtaactcatttgcaatgatttacattgacgaatgtgcgtttattccaaacttcatcgatgcatggcttgctatccaacctgttatttcatcaggtcgtcgttctaaaattattatcacgactacaccaagtggattaaaccacttctatgatatttggactgcagctgttgaaggtaaatccggctttacgccttatactgcaatttggaactcggttaaagaacgtctatataacgacgaagatatgtttgatgatgggtggcaatggtcacttcaaactatcagtgcttcttctcttgaacagtttaaacaagagcactgtgcggaatttcatggcacatccggtactctcatttccggtatgaaacttgccaatatggattggattgaagttactcctgactcgcacgggttttataaatttaaagaagcggaagcagaccacaaatatattgcaactcttgactctgctgaaggacgcggtcaggattaccatgcactaaatattattgacgtgactacatctgaatgggaacaagttggagtattacattctaatacaatttctcacttaatcctcccggatatagttattaaatatctaatggagtacaacgaagctccgatctatatagaacttaactctacaggtgtttctgtagcgaagagtctttatatggatttagaatatgagaatgtcatttgcgattcaatagttgatttaggaatgaaacagacgaaaaggtcaaaagccgtcggatgttctgcactaaaagaccttatcgaaaaggataaactcattattcaccatcgtgctactgttcaagaatttcgtactttctctgagaaaggagtatcctgggcggcagaagatggatatcatgacgatttaattatgtcactcgtaattttcgcatggttaacaacacagcaaaaatttgctgatttcgtggataaagatgaaatgcgtttagcatctgaagtttttaaacgcgaattagaagatatgaacgacgattacgctcctgtagtgttcgttgacgccgtgaatagcgcagaatatgcgcctcaagaacatggtctttcatttgtataaataataaaaagcaaacaacattgaggatatatcatgcctttagtctctcctggaattgagctcaaagaaacgagcgtacagagcacggtagtacttaacgctacaggtcgtgccgcaattgtcgggaagttccaatggggtcctgcatatcaagttactcaaatcactaatgaagttgaactggttgatatgtttggcggccctaataaccaaactgctgattactttatgtcagcaatgaactttctgcaatatggtaatgatctacgcaccgtccgtgtagttaaccgtgaagctgctaaaaacgcatctccgctggttgataatattgaatggactatcactactgctggtagtaactatgaagttggtgataagattacggttaaatatgcagaccaaactgtagatgacaccggttcagttactgaagtagatagtgacggaaaaattaagtcggtgttcattccgacatcgaagattattgcatatgcaaaaagcattaatcagtacccagatttagggtcttcgtggacaactaccattacttcacagagttctggtgtttccgctgtcattactttaggtaaaattatttctgagtctacagttttactgactgagcatgaaactgcccatgaagaaatgacaaaaaccgaattccagactgcgcttgcgcaatataaaatgcctggaattgtagctgcgtatccgggcgagctcggaaaccaactggaaattgaaatcgtatcaaaagctgcatttgataaaggtgaacagctgacgatttatccggctggtggaaaacgcgcttcgactgcaaaagctgtatttggatatggtcctcagaccgatactcagtacgctatcattgttcgtagagatggcgcggtagttgaatcaactgtgttatcaacaagtcgtcaagataaagacatctacggaaataacatctttatggacgattatttctccaaaggttcttcacgttatatatttgctaccgcgcaaggatggcctgaaggattttccggtgttattcgtctgggtggtggggtttcagctaatgaatcagttactgctggcgatttaattcaaggttgggatttatttggtgaccgtgaagcactgcgggtaaaccttctgattgctggtgcttgtgctggtgaaacggatgaaatcgcaagtacagtgcaaaaacatgtgtcgtctattgcagatgaacgtcaagattgtttagcactcatttcaccaccaaggtcaacgattgtaaatattcctctgacccgtgctgttgataatttaattgattggcgtcaaggtgaaggaagctacgactctgcaaacatgaacatcaatactacgtacgcagcaattgatggtaactataaatatcagtatgataaatataacgacgtaaaccgttgggttccgttagctgctgatattgcaggcctgtgtgctcgtacagatgatgttgctcaaccttggatgtcaccggctggttatcgtcgtggtcagattctgaactgcattaaacttgcgattgaacctcgtcaagcacatcgtgaccgtatgtatcaagcaggtattaacccggtaacgggtcaaggtaccggtgatggtttcattctgtttggtgataagactgcaactactgttccaacgccgtttgaccgaattaacgttcgtcgtctgtttaacatgctgaagaacaatatcggtgattcttctaagtggcagctgttcgagttaaacgataactttacccgttcttctttccgtatggaaacaagccaatacttggcgggtattaaagctctgggtggtgtatatgacttccgagttgtatgtgataccacgaacaacacccctgctgttatcgatcgcaacgagtttgtagcgagcttctatatcaaaccggcgcgcagtataaattatattacgcttaacttcgttgctacggcaactggtgcagatttcgatgagttgatcggaccacagtaatatgaaccccaggacattctggggtcatctaacctttagatgataaattatattaccgcacactttaatagcctctatgatgatgtagtcaatcgagaggctatataaatatctataggaaacaacgatggaattaacagacatcacccgtgcgtttgaatctggtgactttgcacgtcctaacctgtttgaggtagaaattccttacctgggtcgtaacttcagtttcaaatgtaaagcagcaccgatgccggcaggtatcgtagaaaaagttccagttgggtacatgaaccgtaagattaacgtcgctggtgaccgtacttatgacgactggactgttaccatctataacgatgataaacacgaagtacgtaaggcaattattgcttggcaggctcaggcccacgctcaaggcaatgatatctctggtatgactccagccgattacaaaaaggttgctacggtacgccagtttagtcgtgatggcaaaactatcacaaatgaacacaccattactggtctgtggccaactaacgttggtgaagtacagatggactgggattcgaataacgaggtagaaacgtttgaaactacctttgccatcgactggtgggaataatgctatggggcttcggccccgtatcgaagttctgtgagttatttgcttaaatatctgacaaaacttcgatataaatatacttatagataatttcggagactccaatggcctttcatattttggacttattcgctccgtgggaaaaacgcgacgaagctgaatataagcaacaaatcaacaatgacctagagtcaatcactgctccaaaatttgatgatggagctcgtgaagttgaatcaaacgaaaacgaaatccagtacaattcattcaaccaaatgatgtttggttccaatgaacctggaatgaaaacaactgctgatttaatcaacacttatcgtagtttaatgaataactacgaagttgacaatgctgttgaagaaatagtttctgacgcagttgtatacgaagacggtcatccagtagtttctcttgatttagattctaccgacttcagtcaagcaattaaagaccgcattcttgaagaatttaatacagttttaacatgccttaatttcgagcgaaaaggagccgaccatttccgccgttggtatgttgactcaagaatattcttccataaaatcgtcaacacaaagaaaatgaaagacggaattcaggaactgagacgtcttgacccgcgcaacttacaattcatccgtgaaatcgttaccgctgatgacgctggtactaaaatcgttaaggggtacaaagagtatttcatttacgatactggcaaagaaagctattatgcagatggcagattatattccgccggaacgaaaattaaaattccacgcgatgctatcgtatatgcacattctggactagttgattgttcaggtcaaaacatcattggttatttacaccgagccgttaaacctgccaaccagttaaagctattagaagatgcgttggtaatttatcgtattactcgtgctcctgaccgtcgtgtgttttacatcgacactggtaatatgccttctcgtaaagcggcagcacacatgcagcatattatgaacacgatgaaaaaccgtgttgtatatgatgcgtcaactggtaagattaaaaaccaacagcataatatgtcaatgacagaagactattggttgcagcgtagagatggtaaagcagttactgaagtagatactcttcctggtatgtccggtatgagtgatatggatgacgtccgttactttagaacagcgttatacatggcattgcgagttcctctttcgcgcatgccggatgcaaataatcaaggcggtgtgcagtttgatgctggtacagcaatcactcgtgacgaacttgattttgccaaatttattcgtagattacagcataaatttgaagagattatgcttgatccacttcgcactaatctaattcttaaaaaagttttgtctaaagatgagtgggaagacgaaataaataatattaagattgtgttccataaagactcatatttcaccgagttgaaagatgctgaagttatggagcgtagaatcaatatgctcacaatggctgagccgtttatcggtaagtatatttctcacaagacagcaatgaaagatttccttcagatgtctgatgaagaaattgaacaagaagccaagcaaattgaattagagtctaaagaggctcgcttccaagaccaagaaaatgaagaggatttctaatggaaaattatatttccgcaattgaatccagagacctcgtagcagccaaaaaagcttttggtgcaattatggctgaacggacatctggtttaattgaagagcgcaaaaaatttatcgcagcgtctgtcatgattgagggtgaagagcccgttgacgatgaagatgaagacgacgaagatgaagataagtctgagaaagacgacgacgaagaggacgagtaatgcttatactgcctgaaaatcatgaattagttatcgacgctgtcgaagcttttcttcctgaagcacaggcacgttttgataagttgtccgcagcgctttctaaagatgatataaataaaattgtagagaacatggttacttctgagcctgatttagcaattgctttaggttcaattaacgaatctctacaattaaatgaatttatcgttaagcacgttgattctaaaggtactattacccgtaccaaagatcgtaaaacacgtgagcgtaacgcgtttcaaacaaccggactttctaaagctaaacgccgtcaaatcgcgcgtaaagcagtaaaatcaaaacgtgctaatccatcggctcaaactcgtggattacgtaaacgtaagaaagcacttaaacgccgtcaggctctggggctaagttaatggaaaacctcaatgaacaacttttaattgagcattggggtcaaccgggcgatgtaattgatggtaaacccatgctggaatctattatcgttgaaggcgaaaatgaatctggcttaaaacctggtctgtatatcgaaggtgtttttatgcaggcagaagtagtaaaccgtaataaacgtctttatccaaaacgcattcttgagactgcggtaagccgttatattaaggaacaggttgctactcgtcaggctctaggagaattaaaccatccacctcgtgcaaatgttgacccgatgcaagccgcaatcattatcgaagatatgtggtggaaaggcaacgatgtttatgggcgtgcaagaatcatcgaaggagaccacggtccaggtgataaattagccgctaacatccgtgctggttggattcctggtgtatcaagccgtgggctcggttctttaaaagactcaggaaaaggatataacatcgtacaagaaggctttcgtctgactgttggtgtagacgcagtttggggtcctagtgctccggatgcatgggtacaaccgaaacaaatttcggaaaatacctcggcacaagttgccaatagtgctgatgatgcttttatggctctcgcagagaagttaaaagcgttataaagtacgaggaggtaaatatatatgtctgacaccatgatcgttgttgctaccccgaccccgggtttctcttacgcttctggtctgacctacggtggtggtgctttcgctggtgctccggctaacggtccgtctgaaggtcagatcttcttccagaccgttctgccggcttaccagtctccgaacctgtgcatcggtcagctggcttggatgaccgactacatcaacaaaaacggtgttggtaacccgaaaacctgggaagttatctctcagaacgttctgatcttctgctctgctgacaccgctctggttctgaacccgcgtatcgctgtttacgacggtttccacaaaaccaaatgggctccggctaaattcaacttcaaaacccagtctcaggaaaaattctctggtaacgttaccaccccgatcgctgctttcggtcactacctgtggggtgaaggtaaaccgcgtaccgttgacctgtcttctgttggtctgaaaatccaggctaaccagatcgacccggttatgatcgctgttaaaaacaacgctgctggtacctaccagatctctggtaacttcaaccgtaacaccttcatcgacggtgacatcccgggtctgtacctgggtaacatcaccatgaaaaccgaaggtaccctgaaaatcgacgctaaaggtaactggaactacaacggtgttgttcgtgctttcaacgacacctacgacgctaacccgtctacccaccgttctaaatctgctgaagacctgaccaccctgctgcgtctgacccagggtaccccgtacgaaatccgtatcccgggtgaactgaaagtttctggttctggtaaaaaataaataattatgtaacttaacacaggacatcaaaaatgcttaaagaacttttaatgaccgaagctaaaactatcgatgcttccgtcgctcttgacagtattttcgaatcagttcagctttctccggaagctaaagctaacttcagcactgtattcgaagcaacagtcaaaaaacacgcagtagctctggcagaatctcacattgaaaagattgctgagaaagcagaagaaaaagtagaagaagaaaaagaaaaagctaaagaagaagctcgcgaagagctgaaagaagctgcttctaaatactttgaccatatcgctgccgaatggatggcggaaaatcagctggcggttgatcgtggtattaaggctgaactgtttgaatccatgtttagcggtatgaaagaactgtttgttgagcacaatgttgtaattcctgaagaatcagtagacgtagtcgctgaaatggaagaagaacttgctgagcaaaaagcagaaactgctcgtttatttgaagaagtttctaaacgtgatgcttatatcaattacgcccaacgcgagtatgctattcaagaagcaacccgtgaattgactgatactcaaaaagagaaagtagtttctctgacagagggtatggattattctgactcgttttcaactaagctgaaagctattgttgaaatggtgcagggttctgtagagcagtctgtaacggaatctgccgatataaatactatcgacaaagaagcagacggtttaaacttcacaactgaagcagtcgaagaaactcctgcgactaaaaccccatccgttatggatgcttatgtagcccaagcggctcgtctttcttaatttaaaaggttatacaacacatgaaaaagaataaacttatcgaaaaatggcagccgctgcttgagaacgaagctctgccggaaattgttggcgctagcaaaaaagctctgatcgctaagatttttgaaaaccaggaagctgatattaatcaggctccggaataccgcgatgaaaaaatcgctgaagcatttggttctttcctgtctgaagcagaaattggcggtgaccacggttatgatgcacagaacatcgcagctggtcagacctctggtgctgtaacccagattggaccggcagttatgggtatggttcgtcgtgctatccctaacctgattgctttcgatatctgtggtgtacagccgatgtctaacccaaccggtcaggtattcgctctccgcgctgtttacggcaaagacccgctggctgctggtgctaaagaagctttccatccgatgtacgctccggatgcaatgttctctggtcagggtgcaaccgagaaatttgaagcagttaaagctggtgatgctctgactgttggtgatatcgttgttcacgatttcgcacagaccggtcgtgctcatctgcaggttgttgaagatttcactgtagacgctggtgctaccgatgctgctaaactggacgctgcagttactgctgctctggaagctggtaaagttgtagaaatcgccgaaggtatggctacctctgttgctgaactgcaagaagcctttaacggttcgaaagataacccgtggaatgaaatgggcttccgtatcgataaacaaaccatcgaagcgaaatctcgtcagctgaaagcacagtattcaatcgaactggctcaggacctccgtgctgttcacggtatggacgctgatgctgaactgagttcaatcctggctactgaaattatgctggaaatcaaccgtgaagttgtcgactggattaactactccgctcaggttggtaaatctggtatgacccagactgttggttctaaagccggtgtattcgacttccaagacccgattgatatccgcggtgctcgttgggcaggtgaaagctttaaagctctgctgttccagattgacaaagaatccgctgaaatcgctcgtcagaccggtcgcggtgaaggtaacttcattatcgcttcccgtaacgtagttaacgtactggcagctgttgatactaacgtatctccggcagctcagggtctgggtcgtggttataacaccgacaccactaaagcagtatttgctggtgttctgggtggtcgctaccgtgtatacatcgaccagtatgctcgtcaggattacttcaccatcggttataaaggtgctaacgaaatggatgctggtatctactatgctccgtatgttgcactgaccccgctgcgtggttccgatccgaagaacttccaaccggtcatggggttcaaaacccgttacggtatcggtattaacccgttcgccgattctgctgctcaacagccgaaaggtcgtattacctctggtatgccttctatcgtcaactctgttggtaagaatgcttacttccgtcgtgtatgggttaaaggtatctaataccaataagggagccttcgggctccctttagttgttttaatggatataaataaacttataaatccacagaggaaagcgcaatggctaaaatcaacgaacttctgcgcgagtcaactacaacgagtagcaacttaattggtcgccctaatctcgttgcattaacgcgcgcaactactaaattaatctataccgatcttgttgctacacagcgtactaaacagcctgtagcagcgctatatggtatcaaatatcttaaccctaatggtgatttgacatttgcaacaggtgcaacctatgcaggtcaaatcggagccacagaacgtgagtcaattgaagaactcactatggcaaataaagactcattcaataaagacgatatgttcaaatatcagaatgtggtctttaaagtacttaaagatagcccgtttactgatacaacagaaaccgatgaatttggacttgtatctgaagctgtagcagctaataatattcgtatgctgtcagatgctgcagtcactgaaaaatttgaaggacctgattcagacccaatcaccgaagccagttttaaaattgataaatggcagacccaggttaaatcacgtaagcttaaaacagatttaacggtagaattagctcaagatttagaagctaatgggttcgatgctccagaacttattgatgatttacttgctactgaaatggcagaagacattaataaagacatcctgcaatcattgattacggtttcttctcggtttaaagtagctggtgtatccgataaaggtgtattagatttaactaagcaggattctgctccggaacaaggtcgtactctgtatcgtttcatttgtgaaatgaattcagcagttcaacgtaatacttcttattctggtacttatgcagtagcatctactcgttgtgctgcggtgcttgcagcttccggttggttaacacagaagaatgatggaagtattccggaaaacgcatacggtatgctgaataacggtttacctctttattgtgatactaacagtccggttgattacgttattgttggtgttaaggcagaatttggtgggaaagaaactgtaggttctttattttatgcgccatataccgaaggcttggatttagacgaccctgagcatgttggtgcatttaaggttattgttgacccagctagcttgcagccttctgttgctttactggtacgatatgcgctgtcagttaacccatatactataggattggacgaggacgaagctcgtgtgattaatgctgcggatatggataagatggcaggaagaagtaagatgtctgtactgctcggtgttaagttacctaagcttattgcggactaatttgcggggagcttcggctccccttttttgctataaactaaatatgtcaaacctcggggagtattcctcctcgagggatttaaacacgttcttatcatagagattgacgcattctattccatgtctacgggctatatcaacagctactctcgtccctccagatacactcccgcatcttttttcaggcgcccaatataataccttatctacaggctcagtgcattctaggcccaatacctgcatagaattccgtgcaaatagtgtctgtactatcttcgagcattcatcccagtacgacgtaacttctctcgccttaatgatgcttttgattttggcttcgtttgataattcagaccatacaacaacacctgtatcaggaacatggccacaaaagccagaataaggaataatcctacaagaatttgacctatcgtatttcgccaaccacgcttcatctgaacccggagctccacctgaatatgaaaaatgcccctcttccgagaggcgttgaccgattatagtcattagactcagaactctgcgtggcgcttctcttgaaccaatcagcgccagcctcattattctaaaacctcatgccatttgctacgaatagtgttttgaattaaagtagtcagttctttcttaacagcagaaggattatcagcgaatagcatgtcatgaccttcacgagctgcttcgttgatgatatctttcatagtcagtcccataactcgaccaaaatctttggcagttacagtaccaatatgagacagaacgttacttacacggttccaggttacatactcggaaaagatttccagaacacgcttatcagtatcagtgagttcaaccttagctttaataggcttatcagatttagctttctcgctgaacttagaattcttacacttaatagctacacgggtaccgttattaaagaatttaggattaaccggtttaagaacatagccttcagctacaccggtttcagaagaagcctgtggaccgaacacatgtttatttgcatgttcaaggtcagtcgtgtcaacaagttcattatagtaattgacaatagatttaaagtcatttacatactgagatagctcagcgaatgaaccacgaccaagcagtggagctaatttaagaccaagaccagtagcaaacgattctactacataatcgtcccaataaactttttcgttaccggaatccgacaggatatcaaacacgtagaaatctttatcaccataatctacgcccttctgaataccaccgccagcaaattcaccgaagatttgaacagatactaaatccatggtgttcagcatgttctgcatcttaacgaaagaatccttgtacttcttcatgataatctcatgaccaaagaagctttcaccttctaaaataggaccagtacgcttagccggaacgatttcggtaggggtaataatcacactgaagttagtgccatgaattttctcacgagccacccactcaacggtatgcatatcaaaaccagcaccacgaatcttctcgatgaacttaccgttgtaatgattctcaagactagaatattttgcaaacattataatttccttagaatgtgattttcataaagtcagtatcaccgttacgctgggaactggtataatttgtaacaaatccttcatcatgcaaataattaagaacacttgtaatgtgtttcttaactagactactcggatacataattaactcacgcttacccgctaaagcggttttctcaatctgagttaatacttcttcttttgctgccgataattcttctgtagcaacattaatagcagtattagccattctatcggcaaggttcataatttttctctcaataaataaaataaaaccaggagtccatctatcttggacaagggtaatggtatcagaggatttcccctgagcccattataccacatcgatttttaaagcaattaataaccgctcggtacgaagcgatacatgatatatccgcttttagttagcatgatttcaaattgacttttgcttccaacctcaagtactaatggaatatctttatccattagcatccaatcaatttttccataccgttcattaatcaaatccgttattttacgtgcaccacttttatagtagtaagaactctgaacagccatcattttactaacaaatttagatgcaaacaaccagacatttaccccattagcagctggcgtaaatttcttagaaagcatttcttcaaatcgttctactacaattgggtctactttagacattataaagtcctcatgtgtttaacaagtttcttatgacgagattttataccaacgtttgttaagcgtttccgatatacgactttttctttttgcttaaaccgttcgtgtgctttctcaactgagacccacaatttagcagcttccgctggagtgatatctaatgctctcgcaatttcttgaaaatctttaccgctttcatgcattaagtgagcttgtagtgctttcataataacctcatctatgtgacgaggacataataaaccaatccgtgaatagcaaaaaagggagcccgaaggctcccgaatattaaggatagataatacccgcttccagcgcagtacgatgaacaatgtatccatttctagattcttgtacatcgacttctggataatcatctagcattttagccagagtataccgatgcaggtaatagtcgctgtcagggtcgtcgagtttccaatctttgccctcaacagtcattcgctggatttcatccattacccaccatccgcaccagatataggctgttccacggaacggtagaggatgaatatacggaagttctccgtctggctcaggggctactcttttggtaatagttacatcgccagttttagtgactgtaatcggggtgtaatcttctgcggaaacctcaacagaaacctcaatcacttgagaccctatatcagacgtgtcaatcactaaagtgctagtagaaccttctacaggagaaccgtctttggtccaagaataaaccccagttgcaccttctggagcaccgataacgttggctttaaaagatgcttcagacccttgttctgccgtaatagactcaggagtcaaagtaacagaaacaccactcattgtctttttagtaaaagcaacagcaatacctttagttgcagttccattattataatctggagcagaaaccgttacttcacaattcaatgtgtagctggtttccgttgactcggttaaggtaattgttttacccgtttggccagaaataacagaagagccacgtttccaaacataagcaatgcttgctcctgacggggcgccagtaacatcagctgtgactacttgggattgaccaatttctttagaaacagaagttgggctcaaagttaaagtaatggccggcatagttttgttcttaactgtcagagtagtttctgcttcagctgtttcgggatcgccttcagccggagtaacagtagcaactactttaacggtcttactacctgcaggtcctgcagcaacataattcatagctgcggtaacagaagattgttttacaccatttacggtccatacaaacgtttctgtgccttcagctgcggctccagaagttgttgcagtaaaattggttgttgctccaatgactgccgaagcagccaaaggagcaatagatacgctataagccataggtgttccttattttaaagttacaaatgaagaattacgtgtttcacgaatcataacagacccgtttcttttgatgtaatagattaaactaaacagtgtctggtgtgctgatgggtgttcaaacgacgttggccgagatttccaatctggggtatctttaatccattggtaaatccaccatggaagagtaatatatcctgggttcttacctagcaattgcatgtttggactaaagtttttaggaagctcaatggtttcatcagttttaacaattttaactactttgtccattgctttgaagaattcttcagggtccgtagtactaattggaatgtttgtaagttttccttcatcatcgatatggataacgctgtctccaataggagcttcagcataaaatcctttatcattgatagaaggagtttttacttcaaatccagggtcatttactttgggtgtttctttataaaaatctgggtcaatatcatgaattttaacacttgcacttactggagcatcaaacagtagttttgcttcatcagacgcttcatcattgaaaagtgcttttccttcaatttcatcatctgcttggattaaatcagcaattgatagaccatcgttgtcttctggcataggctcatcggccaatttagccagttctttttctaagtcagcaaccatattgtcaaatgagcgggtcttcttcagtttaataccgaaggttttggcatattcgtcgagcttgtctttagcttcttttttatcgagtgcctgaatttctttaatatagtctttatctagcattgggtgtgcctcatgtaatgtataaatatgattgtatttataaactgaggatagtacagtgcacgacatccaagtcaaatttaaagattttagtcatgttcatattgagtgtgatgactcaattttctatgaactcagagactattttagcttcgaagccgatggatacagattcaacccgaaatatcgttatggacattgggatggaagaattcgtctgctagattataatcgtctcttaccgtttggtcttgttggccaaattagaaaattcgctgaccaattcggatataaagtttatttcgatccaactatattcgagcaagaaactctttcacgggaggattttgacaattggttatcgactaaagaaatttattcaggattaactaagattgagccacactggtatcagaaagatgctgtatatgaaggtctagttaatcgacgtagaattcttaatcttccaacgtctgccggtaagtctcttattcaggcattacttgctcgttattatgtagaaaattacgaaggcaaaattcttatcatcgttcctaccacagcgttagttgaccagatgattgatgatttttgtgattatcgtttatttcctcgcaatgctatgttgggtattcgaggtggtactgctcgtgattcgaatgcattagtttatgtatctacctggcagaccgctgttaagcagcctaaagaatggttttctcaattcggcatgatgatgaatgatgaatgtcatcttgcaacgggtaagtcaatttcaacaatcattgcgggtctcaccaattgcatgtttaagtacggactgtctggttctcttaaagacggcaaagctaatatcatgcaatatgttggcatgtttggtgaaatcttccgtccggtatcaacttctaagttaatggaagacggacaagtaactgagcttaaaattaatacaatcttcttaagatatccagatgcagccgcaaatgctttaaaaggaaaaacgtatcaagaagaaattaaattcatcaccaatgttaagaaaagaaaccgttgggttgctaatttagctgctaagctagcatcgcgtgatgaaaacgcttttgtgatgtttaaacatgtagctcacggtaaagagctattcgagatgattaaagctactggtcatgagcaagtttattacgtatcaggtgaagttaatactgaaacacgtaatgctttaaaggctatggcagaaaacggaaagggaattattatcgtcgcaagttacggtgtattctctacaggtatttctgtaaaaaacctgcatcatgtaattttagctcatcccgttaaatcgaagattatcgttctccaaacaattggtcgtgttcttcgtaaacacaaagataaatctttagctactgtctgggatatcatcgacgacctcggtgtaaagccgaaatccgccaatgctaaaaagaaatacacgcatttgaattattgcttaaaacatgcattagagcgtattcaacgatatgctgatgaaaaatttaactacgtaatgaaaacggtaaatctatgattaaatttgaagatatttacgaagccacaattcgtgaggctactatcgataacttcatgagtaaaattaatgcttgccaaaccttagatggtctgaaagaactcgagaagtattacgataagcgctctaaagaaactactcttgctgattctgatgacatcattgtgcgggatgctttggcggggcgtagacaggctcttgaagctgattctgaagatgacgaagacgaagacttctgatataaaaaagccccaaccgaaaggaaggggcaaagccaattggctacatcaacactagactaaattaaaagttgcgtttcttgtaattgctcttctgtgtcttcagtgacaggcaattcaatcgcataattatagcaagctccgggatgaaccgggcctttgtctgtgtggacaaccaatgcttcatcgattggtcctttacagacgacacataccgtattcgacatgattgtctccttagtttacaagtttatttattacgcgccagcttcaaactgacgaaggtcaataatgtgcttaatgctaaaacctcgtgacttgatagcatccattgcatcgctacagaactccaaaagaattccccaatattgcaatttagtatctacacccaagatttctttatcagcgcttaaaacagttttcatttctgatttttcatatacatccatgcatacttcaccaccaacctcgccacggccagtgtaataatccaaccgtgctttaagattttgctttttgagggcatctaatcttaacatctcttttcgacaggtcgagtgcttacgcacccatttaccatacagaacggggttattagccgcttcatactgtagtttagtctggtcgataatcaaatcattatccaattcatcctgtaattcttctaatctcattctatctccactctactgtttctttggaaggactagtcccattatactctactgctagagttagcattactacgcatctgtatgcgtatacgttctagcgtatcggggtcgtctactatagaaaactgcacggtgacaattatagcattatcgtcatataacggaagcacatcaactgatagacgattaatcctaggctcataattacgcacagcagagactatattacgctttatcgtatcaccagttaatggagtcatgttttcaaataattcgtttgtgatatcacaaccaaacgctgggtcaaatggccgagacccctttcttgtggttattattccaagaaggctgtttttaactgatcgagctcctactgtttttgacacgtcagtgtcccaagcaagtcgcatttctgggtcaaggtcagaatagagtttatcgatattgctcatgacataatcttaaagaattctttaagccccttaattacatgaatgtgagaaattccgcattcacaagtaatgggaactgccaattgaacctgtggcttcaatagcatatttttaatgttaactacatcttcggttgtaatagcagaatataaatcatcgatttctgcatcgtttaaatcattaaagtaaatctgctcatttccaaccacgatataatctatgcattttgatatcatcattggaatgtcggaatcgtcaaaaagattaggatacttgaactttatcttgaatccctttaagtcataccagaggtcttctggaggatcgatttgcgcatgtgtataatttaatggcacaggaattttacgcccacaggtgcaattccaggtcacctcatgattaacctcgcctatactatgcgcccaaagtataactataagtaattccgattcttgtttgtttaacccagtagcattagtacattctctgagcaatgctttaacacattcatcgattgtaccgtttttcttcgctgcaattaaattagcgtattcttctagtgtaaaagctcggcactggatattcttgccatttattcttgtttcaaatttatatgtgatgttcatatccactcctcttattcaattatttataaatagtataaagaggattaccttatggccaacatagttagatgcgaattaccagatggtgtccaacgttttaagccatttaccgtagaagattatagagaccttttattggttagaaacgacatgaacaccaagtctgaagaagaccaaaaacagcttatagcagaattaatggatgattattttcatgaccatcctgtcgagtatcgtccttatatatttcttaaagtatttttgtcaagtattggtaaaactaaaataccagtcagaatgaagtgcccaaaatgcggaaaatataagcagtatctttttaatcttaatcagcctccgttgacaaatccgaaagtagaggttgcaggattaacgcttaagttcaaaaaacctatagaaataattgatgatacaggtaaaatgattttagacaacattatatctgtgaaggattcatctggggaataccagtggaatgaattaagcgatagtaataaattgacagttatcgatgctatagatgttgaaaccttggaaaagattttatcgcagatgaagccgtttaactttgagctaaagacgtcatgctgtgataccacgacagtattaaaatatgataacattgttgatatctttaagctattgctacatcctgacgagattttcacattttaccaaattaaccatagattggtttctcaaggtaaatatgacttgaattctataatgaaaatgctgcctatcgaacgtggcataaccttatcgcttattgaaaaggaccttaaatcatgacagcacaaagattaggatatcctaatataagcataaaattatattctggatatgatgcgtggctagctaatagattcgttgaattagcagctacatttattacattaacaatgagagattcattacgcgggactaatgaaggtctgcttcagttttatgattcgaaaaatatgcacacgcgtatgaacggtgatgaactggttcaaatatctgttgcaaacagtaacacatcaagaacacaaactcgaatttacggaattaaacactttacagttggtgttgatgataaaggcgatagcattatcacccttcagcttggaacgctgcatgacataatgaatctcaagttcagtagagcgttttttagttctgcatatgaaactataaaagaaatgataggcgcgatgtatgttgaccaaccattgattgctcctcctatcaacggaattaacgcttacgtcccacgagttccatggactagtactctcaaagattacttacgatacgttagaaacgtaggcatttctactgataacgaccaatttatttttgcctgggaagatatcactgggattaacatgatggattatgaatcaatgatatcccaggacccaaatgtattcatgttcggggctcctcaaacaataggtcagtttgcagcaggattaaaatatccattagcatgggattttgaatggcttgttaagtcaaatagatataatagaaatcccatgaaaaacgcaacattttatgcacactcatttgttgacaaagatgttacccgaattattaatggagaaggccaaaacagcgtattcattaatagatcaggcggatattctgacatgatttttaggaatggctatgaagaagcactacgcatttctacgatggctcaatatgacgggtatgctcaaactaagtgttacggtaattttgaactaactccaggaatgaaaatcaactttgttgatttaaaggaccagttcagaactgacttttatatagatgaagttatccatgaaatatcaaataacacatctataactaacttatatatgttcacaaacggctctgcccttgaacctgtagatttgattaaggtgaaaaatgaacttaaacgtgattcttcctattaagaaaatagtaataaatgaaaagacgatatcaattccaaaactggggttaaagcaccataatctgatgaaagatgttaagggtccagatgaaaacatgaatcttcttttggattcaatttgtccaggattaacagcagccgaatctgatattgttgtattacatttattagcatttaacaacagaataaaagaaactgctgttaaagatgattttacctacgatttgaataaggtttacatttgccagcgattaactcaaaggttagatggtaaagaattcaaattcagagctcctcctcgttattccaaactaggttcagtagattcaattttgagcgaatttcttgaatcagtagatggaaaaccaatggatataaactttatgaagcttccagcttttgtgacaaagtgggctgatgacttagtaaacactatagccattgatggacctgaaggaccaatcaaaggcatgcttaacgtaatggaaatatttgaatgactaagaaatcagaaatgaattcaatgcgtagaagagttattgctgactcggctccacagaaaaaggctgagtctcaagctgatgctcagattaatacgctagaagatattggtcgtcgcttagacgaccaacaagcatctactgatttgatttcggatgtaatagaaactaaatcaaacgaaattatcaaatcggtagaagatgtttcagctggtgttgaattaactgctgaagcttcagaacgcacaacagatgctgtctctaaactaaatgataccgcatcgttaattaatgataagctcacgaaacttgccgacttgttatctaaaaagcatgatgttcagcaagatgtccaaaagactggtactggaacatcattagaaacgataacagaacaagtcccggatgctcctactcagcagccgctagaggaattactcgaaagacttattcctcctcaggatggcagacgtcctgacgcggatttctttcctagcacagaagagcaagaggaaaaagctgagcctaaaaaggaaactgaggacaagaataaaaagtttcttgacctaaaatttggagaattaattaaaagcgttaaatctggttttggaaaaactatttcattaacagataaaattagcagtatgctgtttagttatactgttagcgctttggcccaaatggcgaaaactgccgccatggttttgggtgtgataatgcttatagatttaattaaagttcattttaattattggactaaattattcgaaaagaactttgttgaatttaacaagcaagccaaagaatggggtccgctattaacagcaataagcgagatgtcgaatgaaatagtaaaatcattcgtcaagggagattggggcggattagctaaagccataggttctggcttggttgatgtaattgacaagctcggagaaactattatgctcggaatgagtaagcttcttgctggaatgttacgcgcattaggatttaacgattcggcagataacattgaaggcgctgctttagacagatttcaaactgttactggagcagaactcgatgaagaagatgctaaaatgagagcaaaatatgttgaccgtcaagaaagagaatatgacgaacaacctgaatggaaaagaaagctttctgctaagttccaaaaattcaccggtcagattgatgacgatgaatataacaaactgctgagcggagagaaaaagcagtcagcgtatgcagacttgccagaagaagaacgcctcaaaatcatcacagctcgtaataatgctgaagcagaaatgaagagaacaaaagcatatgttgaaaaaactgatgcatctgattccactcgattagactctgctaaggatgcagtacaaagcacaaccaccagatataaagaattggagaaattatctccagaagttgcaaaagatttaaaggttgaattagaccaattgcaaaagcttcttgattctaaaatatcagaacctgctccaactgccgaagctatacctgcagcagaacaacctgaggttaaacagtctgcttctattaaagccgccgcggatagtcgtgaagctgctcgtacacgtgaatctaatacacagtcgcaacctattcaggttaataccgctgtaaataagaatagcacatacgtttatagaacgcctccacagacttcgacagctgctcctggaatgcaaggcgctatgaaaacctcttaaggaaaaataatgatttttgaagaactggccgatggccttgaaaacatcaaaaaatcaggaactcgaatttcccaaggtaaatctaaactgacgaatgcgccaaccactaaggtggcgcagttcccagctgaacgttcagctgggaatgattccgcccaagatatgagagtacatgacttatatcgcaatgggttattattcacagcatatgattttaaaggaagaacaactcctgatttgcgttcatttagacgagatgtaatgttatcgtctgtattcgattcaccaatgtcagcattggctaattcatcaagctctaccactagtactgcaccagtagctaatattctattaccgcggtctaagtcagacgttgattcagttagccataaatttaatgatgttggggattctcttgttacgcgtggcggcggtactgctaccggtgtattaagcaacgtggcttctactgcggtgtttgggtcgatagagtctttaacgcagggattaatggccgataatggtgaacaaatttataacaccgctcgtagtatgtatgccggacctgacaatagaacgaaagtgtttacttgggatttaactcctaggtctgcagatgaccttatacaaattattcgcatctatgaaatttttaactactattcttacggtgtgacgggaaattcatcatacgcaaaagaagttaaagctgctattgatgaatggtataaaggaactcttaaatccgcagctccagatggggctaaagtagaaaacacagtgtttgagcaaataacatcgtttttaagcaatgttattgtagtttctaacccaacgatttggactgttcgtaattttggatattctacatcaatggatggtagagaggatatatttgggccatgccaaattcagagtatccgctttgataaaacgccgaacggacatttcaatggtttagcaattgctcctaaccttccaagcacgtttacgcttgaaattactatgcgtgaaatacttactcttaatagaggtaacgtttatatcggaggtattgaataatgtttactctcgaagaatttaagagtcaagctgctgatatcgatttccagagaactaatatgttctctgttgtattcgctactgtaccctctagtaaaacccaggctcttctaaacgactttggtggagagctgtataataatatgggtttagatggaaattggcttggattgacaccaggtgaattcaatcagggtataacaactatagtgacacaaggaactcggcaagttgttcgtaaatcaggtgtgaatacatttatgattggcgcaatgactcaacgtgtggtgcagtcattattaggagaatttacggtaggtacttatctgctcgatttctttaatatggcatttccaacagcaggattgatggtttattctgctaaaataccagagaacagattatcatatgaaatggataagttccataacgctcctaatataaaaatcacaggaagagatatggaaccgctggttctttcatttaggatggacccagaagcaagcaactaccgggcaatgcaagattgggtaaatgctgttgaagacccagtgactggtctgcgaggattgccacaagacgtagaatgtgatatccaagttaaccttcatgctagaaatggattacctcatactgtatgcttgttctcaggggctatgcctgtagcgtgtggagctcccgaatttacatatgatggagaaaacacgatagcagtgtttgatgtcacgtttgcatatcgtagcatgcaaacaggttcggttggaaaacaagctgctatggattggttggaagataaggctattcagaaaattgagacgattaatccaaatcagggcttgagtgcgtctgcttcaagattgtctcgtttaggcggggctggtggtggaatttctaatatcactactacaacaagtagaataatttaggggccgtaaggcccctttgttttatgcaatgcagccaataaaccctggctcagtgcgaagaagttccatttcgtctgtggtccaaactactttaacaggaatgataccttctgctttaccgtttagaaccgcttcgacaaacgatggttcagttggcttacggaagatatcttgaataagaaccgtcggagtaccttcgttaaacccttcaagcatgataagaacttcttcattgaacttctctgcatctttaacatcagcagaccattcaataccgttaaagcgaaatacgtgtttcatatcaatttcctcattggtttgtgtaagtctatagtatcacgtccttgtgataagtaaacaactttatgcaagtttttctgggataccatccaggttgatagcaccagccagtagctccatggtacgcgtgtagctaaccttatctgtagaacggtctggcgaaaagtaaatctcatttaaaaagcctttgaacttgctttcttcaagaggttccactttgccctgttccatcaagatgtcaccatcatagagatgaacggattcatcgatttgctctggaggaactaccgtcatttctaccatgaatgtcttgttattcgctacaccaactccatttctaaaaggagttccccataccttgttaactttcattgccaacccgcgaggaagaataacttcagcctcatcgctaaagcttgacaagacacccgggataactaccttaactttatcggccccatgaataacgaatccaaacttaaactcatcaccataggcaacttcctcgcctctatcaactctttccaagttgtctgttccaataacggaagatactgcatcaatagttgtttctttgttttctaaatcagaactaggtgcgtctggcattaatgaatcaccagcatttgaataagcaccaaagataattggacttaacgaagtagaaacatagttctggaaataaaacattttagactcaatgttatctttaaagtcttcatattttcctcgctgaccgcgatacaaaagagtgcctggttcaagacgcaaacctttttcaaaggcagaatcgagcggacgaattttcttgtcaataatcggatcgcctaagctttccataccaataagatagttattaacaaatgaataaccagaaccgcagtaatggtgtattgcatctctttcttcttcgcttaaacgagattgcatttcacggttatattcaattgctttggatatagaatcgccaacaattgacacataagcggatatcatataattgacaagattttggtattgacgtaaagctccgaaatcgtcagctggaggcatatcaaatccacgagtagctacttcaacgattttacgcattgtttccatagatgcaggatttttagcttgagcaataacgtcagcaacgtctgaaattcgttgttcagcgattttcattttgtctgaacccgaaggaatgaaaaccttccagtcgtcatgcattctagacatttggcctacaaataatctctcaactgcatcgccaaaattacttccatatccgccacgaacacgatagtgcttgatatcatcaacataaaaaggaattgatttttctaatccggctttgatatctttttggaggtctaccgtatcgccttctgcgtttagtactggagtgttagtagttaattcgtaccagcgttcacgtttattttctggccaatcttcatcaacatatgaaacaaatttgccgtactgtgctcggattaaatcttttcgagacactttcattttactcattacagcgagttcagatttcttgtcttctttttcgccaatggaattagccaatgcttcggctttggtaacgttttcgccggtttctttagacacataaacttcgcctactttggaatctactttggtgtaaagttcttctgaaatttcaggaattccttcaatctcttcaagtttcttacctttacgaaccataatagaataagcatacttacctttgtagtaagccatatctttcattagattgaaacgaccgccggtgcgagtagtaatcaaccgagcaagaatgcgttgaatagctttatcctgtccttgcattttcttcggattaaagcggaacattaccgcatcagctttaatttgcttaactactttgttgacggtctcaaaaatggtattgatagcaccaatcgggtcttggcctaaaccacctttaagcgcgccgatgttgcctttttccgacacagagaaaacatagacctggatgaatttatcacccatcttgatgttcttaactgcatcaccttgacctgacccttgtactaaccgaatcattaaattgttattacccggcaccttaatcaaaaagacctgtggtaccttaagttttggcttaacgttctcgacgggatagattttactattctcttcatcgaaaacttcatttaaaagttccatgacatatcctcgtttgtttattctatttatacgaaaaaaggcccgaaggccttaattaattattgttactgtacgccaaacttgtagtccatttacagactcatactcttcaatgttttctttgaagtttcttaatgtgttaatgttattaaactcaagaacttctgtgtgaacagaaataccaccacgtccgtcaagagatttagcaatcacttcgtataaaactttcattttattcctgttgcctcagtaaagttaacaccaaacgcggcttcgaatgtattagccacttctttatcatatctacgctgtttaatgataggtaagaataatcctactgtaccatcatcacgaccttcagcagttacccatccattgcattcaagttcccagatagttcccggaagagaatctctgagcttccataaatgagtacggtcaagttcatgtaattcttcgggcttatctttaagacctgacccagcgttaacacgaatacgaccacattctgatacgaacattaagccgcccattttaccaggttgttttctatgctcgtacgaaccgacacatttcaaatctacggtgataacctctttaaatttaacgaggttcttagaacgcttatcttcccaataagcaccgatattcttaaggataataccttcgagaccttggtctacgtatgtcttatagatagcccgagcttcatggatgttatgtacgacacggttttcaattagaataaccttgtcatagcctttgctcatcatttccaatgcacggaagcgtacatcataagcaaatccaggaactttaccttcggaatatactacatcaagcggaacataatcccaaacttggaatctcataccttccgcttcttcagcagagattgttcctttgattgctttattagccaatccgtttgattctgtacgagccgtctgttggaattccttagccttacttagctcaggaagctcaggctctttaaacatatcaaacaggtcgttttcttcttctttcacttcgacatgatataccaactcgccgtcaatcatcacaccattaggatggcgttctcgggcttctttggtcatctcgataagttgacgcttaagtttatctagacccaggtattcattaccggaacgagtaagaagagttacatcatctaaatcatctccgcggatttcagcgaagcaccgggctccatcggctttaagctgagcgaatgcaggaaatttaatatatgatagcgctttctcagaataagctgatgctaacatctgtggcatctcaggaattaatttcttccataccttgttagcaatagaacctgaagcgccgcaacgcatatccttaagaaggacacggaccagtacactagcatcaccctcgttcatcttagagagcaaatctactagcccctggattgccatattaccagtaagtactcgtgctgccagaatgtcttggaggtaatctagaccatcagaaaacgtctttgaaggaacatttggatatttaacgggagtatattctggaactttcttaataaagaatttaaatcgcccggaatacgccagcagataagctcgttttaaatcaacgttatctttattgtcaataagaatttgggttttagctttagaacccttagcatcttcaattgctttgatgatatcaaaaatcattattcacctaattcttctgaaagttcgcttacgctacgatgataagttaatccatcgatataaacaaacccgttattgatgcattcattccaaatcgggcacgcctttgcttcacgccaaattggattccaacgataaaactgattaacatgaccgtaatcacatgataaccaacgtttacccaccttagtatgaactacaaacattattcctccttgggtatggtcattataccatacccagattgttagcaattaatttggtggttatcacatgtaatacgaccgttattccaccagtcgtttccaggaggaacatgcggaccaggactaaacggaatgataggttgtttccaccaatctcctggaacttgtcgtggaggccaattaaaaggatgttgctctttacgaatttggtctttgatagcttcttcccacaatccagaaagagacttctgcggtttcttaacggatttcagagattccaggcaagttacaatttgatgccaatcttcaaccataattccaggagcagtcactgaaccttctcgctcaccacgaggcatataaaacacacgagtttcagtgtcttcaaatactttgctggccgcagcaatatgtttaggcaaatcatctacatagcagacgatgcgatcgccgtattttactttagccttttccagtaaagcatctttagattcatcataatcgcagaccatgatttctgtaaatgcatcagggaacaaagcatttagattgaaacgacgattaaggttagcatctactgagttaccaagagccgtgatagcgacaaaatcgtatttttctttgagcttattaactgtagctaaagcatcagcatacggagcaagataacgaataaaatcgctgttgttgtacttcagaagcagcttaacagccagttcttcttcacaatcaaacagctcagcgggtttaatgaatttttcagtagtcatcatatcaaggatatgctctaccggaagattatatttttgggcaaaataaggcagaccactttgccacttaacgatgattccatcaacatcggttgcgattactggctttgacattcggggaaattcctcaatgcttgtttaaatttggcaacgctatttgcggcaccggtgaaattgaaccagattaaccctggagcgtccgcgggttctatatcaattatttctatattataatactcagcagtctttagcatttccctggtgatacgtcgggcaaccatatgaccgaagtgaggattaatagacatcgtcgttagcagcccttaattgagtaattggataaagctcggattctgcatggattgaacgattgccatcaacccaattaacttcataccacggttcaactgagtaggctttaatggctggagccgtatcacatacaactccaggaattccatttgctaatcttactgtactgaagatatgatatttcatgcatcaagtctcactgcccattcaggcaattcaaagaaatccggagcatcaatttcatactcaacggtgtgttgtttaacgttagctgacatgatatcaaccattgggtggtttttcaaactgcaagaaaaaataccagctttaggtttaggcacggatacaatcatgttgatttcctcaaaatttagttatgaatttttctttcggcattttagcatttgagccatcactgtcagaatacccaattggcatagttgcattaatgaattcaattttagcatttataacattaatgctcagagaatctacaccgtcaatcatacgaaattcaggagggcaatacttatcaatgtatgctttcacaccatttttattagcaggtgtaccatcgcgggtatcgctgataatggtttcaacttttttctttcgtgaatcatagaaagctgatacaatcatttcaatttcctcttaaaacgggcgaatattaacgtgaaccacagggacagcaaaaggttgcatgattacaacttttgtgtctttagttgcattcaggcgttgtacttttgcaagattaacagcttcttcctttgtcaatccacctttgtaggtatcatttcctttatttgaggtccaaacaccccaatcattgcttccatcgtcggtcttcggttcaagttctttgtagatggtttcttcaaaataatgctgaaattcttgattagtaataatacaccacatgtgagaaaagcgaacttcatctacactaacgcgtttgcattctccatctggcttaatgatttcaaattcaactaatccggtattttccgcatatttaaaggttctggtaattttaattggattattaccgatttgctcaaaaacacccttgataagagcgcctggagacaagcttggagtctttttaagcttatagaatttacctttttccattatcatttcctcaatagtggggccgaagccccgagttagttaaaacttgatttcgtttgaaacgatatcccagattgcttcacgttgttcttcggttgttttacgaccgaggatgtggcgcagataaattttaacaagcagctgacgatttgtgttccaagacggatgtgaagataaatcacgtttacgaacttcatcatgaaatccaactttgatttcagaaccgttgaactgaatatccagagtaggaccattttcaaagctaaagaatacgtagttatcttcccagtacatatcgatttgagctactgtgccgttgttgtgttcccacagcaaagtagtagaaacgtcccaagcattgttctgtacgtatttgcggttgaagttagtgaagttcatttttattctccgtagtttgtttatctgtttgggtggtacaggtctatagtaacccagaccacccaagaagtaaacaacttttattcaaaaacttcagacatttttcacctctacagtttttacagtttttacttctgcaaatccgatgcttttaaacagttcatacttggtagtttctggaacgatatcggttagctcaaggatgatttcttttgcttcttccagagtaaagatgcttcttccgtccttaacgaccggtgctggtttaatagcagctgatacttcaaaaaccacgtagcggtcagtagtactttgattttcaaacgctcctatttgcacaacccgtccttcttctaactcgtgagaagaaaataagcatgacagagaccggtcatattcatctcctatggtttttgccgaaatgattttaccagtttcggttttaatcttaacaacccggcccagcgaatcaagttctaatggcgtccagccttgaactccaacaacggtggcaatgagatagttaattgtgttcttagcgtctttccatctacggtaagtttctggggaaatgcaatatactcggtttttgctgtaattcattttgatatcctcaaagatggggccgaagccccagtcaagattactgtttagtccaattatccatgtttaatttaccaacctttttcatttgttcaattaaagcatcggcacgattacgaccattttcataccaggttacatcttctgagtaaccgtcttcttcatctgtgtaggtttcagaacgaatacgaccaacaactggagtgttcagaacatatacagaacccgtgaaccagtttgttaaagtgatatgccagcagaaatcatctgatggaccgtccggtgtcatgcatggaacgatatcaccttgaactttagacaaaatccacattttctcatggacagtttgagctttgtaaccgtcatggtctttagtcttgatagttgcgttcaggttgatggtattcattttattctccgttgtccgtttgggtggtacaggtctatagtaaccttgttgaacttagaagtaaacaacttttttcattctgcggaaaataaaaaagggactcccgaaggagtccctgaacttatgctttcggcttaccaaaacgagaagcatcatcgcgaagaaccgcacgagcccgacgcatgattttctcaaccgtctgattgatacgcttgttcgacccacgcttgtagccagcgcgtttagaggtaccaacaacttcttttactgcagtttttgctttagcttgtttagccattttatcatcttccattttggagaaatacatgggagcacgttcttccgaggttcaacttctttcgacagttctttcggttgtagctcccgcaagccctcaagggggtacgtttaaactcttatctgttgcacaccgttagcttaaaggttccgggtccgatttatcggggataagatatacaccgatggatgtataggccttgaggcgtactcccgattggccatcgcctcggggtagcatgcacttgccgtttattttctagctgcactttggtagcaaatcaccgttggtttcgggtgttttacgtggggataaccaacaacgtccacatcatacgttacccatgcgtacacatggtgggcgtacaaattacttcagcgttaccacaaagtggcgaacagctttgcgagcagcagaaccaagatgcttagcatacttcagttcgtccatcgcttctaaagtatcacgaaattcagcttgtgctgggttcaggtgtttaaaccctttcagaacttccagtgcttctgcatagatatcgattgaagcaccgtagttttcgtgaccggaattccatgcattacgttggagttccagagctttagtaagttgtttgttcattgaatcgttcctcaaatgaggttaaaatttggtggacggtaaccgaggtttagctcgggcatccaccgcgtagaattgctcgggtaactaattgtccgacgcccaattcatattattatttatatacgcatgcaagggacttataatgacaagtcacaaacttctgccgaatttctttgggtttcttcacacctgctgctactaacggatgaggtacgtttctgatattaccaacaggcagtggagtcaaatcaccgacttcaacaaatcctttcggtacatcatcaccgatagaatagatttcacacatatccggcagttgtccttgttcttcttttccaagaataataccggaaggagaaacaatttcatcaccttgctgagcaggttcagatacgagaattacatactcgcctagagctttaattggaagttccatgtgttacctttattgtttgaccatgtagttatattaacatggtcagtttaaagcaaattacttaccgatcatctgcagcagatgctcaactttcataccatttaccgagataagtttatcaaaggtaaatgagcgccaaccttctttctcagtatcatataccggaagtgaagtagtgctttctgctcgggcagatttaatagtgctttctaccaaatcagatggaataatatctttatcacgagtacagcgcagagtacgaatagtgccatcagctttttcaaacacaatctgggattcgcccatgctcagcacagccttcagagtttcacgaatatggatgttttgttcagtagtcagtttcattttgatgtctctttaatagttttgataattacagatttgcgcttggataattcttttaataatcgaactgcttgatcttcaaatttaaatgttgctaatggtttccatttaaaccaataccggcgttctactgagtatgatataacaacatcaccacttaggttaagtttattaatttcaacaattctaagtttcattattcaattccacagaattctttaatgttataccaattcaacttatccaaattacgttttggaacattgaacacctcgattccagcagaacgaagaatatcgtcccaaccgggttcgttcttgtcgtatgtttcgcagtatactaattttttaataccagactgagcgatggcttttgcacaatctggacatggagacagtgtgacatacattgttgctccatcaatactactgccgttccgggcagcaaaaagaatagcattaagctcagcatggatttcattgactttagaccatgcagagtgggctgctcgatgttctttgagcaatccgacttttttgacttggaatccgtcttgacgcaatcctgtagatttgtaaggaatttcaccaatccaaccttgttctgctgcatggtcacaacagttcacaccaccagaaggtgaaccgttatagccagtagaaataattcgtccgttcttttcaattactgcgccgactttccacgagcagcattttgactcttgagatacgagatacgcaatttgtagtaccgtcgacgctttcatttaaatcaccagataagttgtgttatttgttttaaccaattttaactcgtcagtaggagaagcaaaactctctactcgagaagtacgaatgcctgtaccatctggaaacggatgattccctcgttcaagaacatcggaaaagacataaccataaagaggttggccttccttaacattaacgttactgtacaaaatagcatcatattcttcgcgtggaattgaccaaacaccttggtcagaaccaataacagcactgatcagccgaatgccatttgggctgatttctgctttaatgccacgagcatgttcaattaaaagagcttctaccgcttcacgtaaagtcattagatatgtcctaaaatgttagtcatttcaacttggcctgttccggttaaagccaattgagtgtgttgattgctctttccattattaactgtaatgatataagcatcaacatagttaaaggatgactctcgtcggagagtcactttacttccaggaacccggtttgctacttcctgtgcgaagattttaaccttcgaaataaattcatcatgcgaaaatttagcgtcagacaacataagtctcaacctgttgggtttcaaaattagcaataattccaacgataaaccagtcgtgttcaccttcgccgcaagaaattttaatttcagacgaaccgcctgaccggtcaatagaaaatttaataacttcgccgtttggaataagtgcattcattgcagataaaaactctgcatgcattttggctacttcagatggagtaaactcatctgttaaatgattagcaacaacttgcgtaaatgatacttttactacttcggaatactttggaaacattatactttcctctaaaaatcaccgtgggctacttgccagcattcaacaccgatacgacgccacatttcaactacctgcgccctgtcatctactgcaagtttgacattataacgatcagcaattcggtcccagaagatttcttcttttaccacatcgtctttgcgtgaatcgccttgcttacgttggaagtgttcgcctgtttcgccaacatggtccaacaaccatttcttcgtaatgcgttgataaacagtagggtcttctttagtaccagactctctgccggaaacagtaagaattttatatcctttgttacgaagcattttaagaaattcaattaccatttcctttggatggtctttaccacatttggccaagtcataaggagaacgatgattgttatctgctaacgtgccatcaaggtcaaagataactgcttttggcaatgattcatctggaatgtacaaatcatacggatgcatcttagagtagaagctacggagcacttcaataggaactgcattcgcgccacgatagaggttacgcttaactagttcagtccaaggaacgtcaaagcgtttaatttcccacttgacaccatcaatttcatatgccaactcttgccacttcttgatagtcgttggattaaggttagtatcagcaatgatgacacctttagtggtttccatctcgagtagagtcttcgccatagaaaactggcatacagatacagacttctcacgaagcttagaatatttgtaatcattacgtttatcaaggccaaagatgccttcacgcaaatcatcacgagacaaaacataccaaccgggattagctgctacgtattcgttagcccaggttgttttaccagagcctggagccccttgtgtcaaaaccaattttttcattatacatccttaagagtgtcaataaaatcatgaagagccttagacttttcaccccaatttgcacgatatttttctttaattgctcgcaatggcttattcattgacagtatatcatttttgtcataattttcagctgcgcgtccaaacacgatgcacgccaattcattttcagcaattaaccctttaagtgtttcatactgttctcggttcattataataccatcacttaacgcaacgaggttctttaaggtcagaacgataataacatatcattccgttagcatctttagtataacgtaaaatgtcattcatccagatgcgatactcttgagactcttcaaacggcataccaacccaggctttaccgtcaattacttttacttcccaatgtccttcccatttttgaattgggtctggccactcaggatgcaaaaccgggacatccggtgcactagaagaacatccaacaagtaggctgataatacccatggctaatagacttcgtttcatctggtagcctcctggatatcttctgcaaacttattgaagcttgcattaatctgtttttcaactaacccaggtttagctgcaactacgtttccacgcttagcatctttattcattttagcgttggaagtatcacgagctgctcggttttcctgatagcctttataggttgtctgcagattttttatagaaacaccgatattttctatttcttttgcttgtcgatcagattcatcttggacgactttgaggtcagctttaagattttctacccgccacgaaagatatttcaatccaccgacggataatgctaacacaccaatcatcaaccaagttgtgtttattttgagcatagtttaaggataacctctacgatatcatcacgggataatcccgaaatgaggatgtgacgatcagaactttccgaaggagaacacttgaagcaagcttctacatattctgccatctcagaataattcagctcgcgatgcataatgccaagacgatgtttgccataaatcgggtcaacgattacatagcatttgcatccgttggcatgaacgtttggttgagtgatgtttttaaacacctctgcaccatacttcgcgagatgattatctaggaaatcaatcatttcatctacggcttcaggcaaggcttcggcacgctgctcgttcacacgattagtgtactctttttgcttcttacgagcagcttccttgcgtgccatatgcgttcgtaggtcagtgacgaatcccactttcttggtgccattccacacaaaatcccgtcagaatgagtaccatatttgttaacaaccatatctaaagtaattgcttgcatatccatttcattatcctcatcagttggtgtaagtctatagtatcacaccttgatgaggatgtaaacaactattcttcagaaatttcaatttctttttcgtactcttttggaacatatccagcccagtacttcaagaacactttttcgaggtctttaagcagtttatcaacatctacagttccttcgtacatgttcatgataacaccaaaaagatgacgctgattaaccgtggctttctgcgcagcaatagcgtagtctttacgagcacgacctctgtattcatcatagaatgactgacatagctcaagtgactttccgaggtaatctagataagcttgctcaaacgcagaaattttcttaattgcgtattcatctccagcaaaaagagaacgcaaatcatcggaatttgcagatacgacagacgcaaacagtctttcatttgacgttattgagtctttagtgtgatgaagagccgagtaccattcggttttaaccttaaatctctgcccagtgtttagaactgcaatgtatccttctacgccttcaagtgcacgaacaccttcaacccaagtgtcggggtcagaaattccataagcattaattaaataaggacgaattttagcattagcgtacaaatcgtcatatttaacatactcgccggttgcgttatcacggacgtttaacacaaacagctgtggctcctggtatgcaagaacaacacgattatcaggtgaaacaaattccatgtttacagtatatccatctagtgctagttcaagaacaacttgatgaagcgaagagtattcttcactattaagcagggcagaagaccttctcgcctggtcactgtagagagatgtttttgacttaaggtatagatacccatcatcaacataagatgatactagagagccatcagccttatccataatgtattctacatcgctaatatcaattcccatcgttaatgggttttcattcaaattaaagaatttttccattggacgagaagcaattcgaattggagtatcaccatccatttcaaacatgatgccccggcactcaagagcatctggttttaaccactcgctgtagcttgcatagtgatatgaaaacactctgaacttaccatccataggaccggtaaaatctttataaaagaattttgcaacttctgagctttcacacagattcattaaatttttatatagctctaacatttctttaccttatgtttgcaattatcgtagtgccatctgatagcaatggcctttgaagttattataccacaatgcgggcatggactgtacaaaggctttttctttcctttttggctttctgaccgcttgagtttagtttcttcagattgtgttttaccggttaaagattttgatatcttttcgcgtgtttctttggcatgagtctttccttgagtgggacttactctgcctttcagtgctttagataaattctttctatgttcttccgttcgtttctttccggagaataagttagatgtataattagaatgctttattctagagctttcataaaatctggaatgaactttaaaattctttccagaagaattacacatcatccaaagagcataattcattttagaattattatgtatctttgataatagcaaatgggcaatgaaatgttcacgtccagtcaataaaactaaattagaaacatcgtcatttcctcctaatgattttggaatgatatgatgagcttcagtataatagtttaattttcctttatcattgcctcgtaatttaccctttgctattaggttatcatatactttaacatagttcatttagctttgttagtatgttgtgtgttccatggaggattgaacttcttaatcagaagaggttcttccaagtccatagtggatattgacatctcgccaagttcattattaatcgaaagattaaaacactgacgagcatagaactctacttttttgccagccattagtgcttcaaaaatcttggcagatttagctgaatcagaggtttggtctttccgattaatagcagttctataataatttatacgtttacgaagattttttgtcttaccaatgtaaaccagctcatcatcaactgcgatggcataaactacgttcaacttgtttgctatcagaattggtttgatggtaaaatctggttctaactcaagttgaacatattttataaaagaaaactcgttagcaatatcattcataataaagaggggccgaagcccctttccttataagtactttttaaatccaattagaacatcatcagtgacatcattgtcaatctgagctaccagataagaacttatctcaacttcctgaggagcagattggactgcatcagagttaagatattcacgaatccagggaataggatgtcgagttggtgcgtcagtgattgggcacggcagaccacagctacgcatgcgagatactgttaagtagtcaatgaagtcatgaagaattttaacgttcagacccggaagaccaccattacggaaaagatggatagcccaatctttttcttggcggttaacttccatgaagattttaattgcttcttgttcacactctttagcaatctcaacccattcttcgccatcagtgccagtttgaagttgacgcagaatgtactgtgtgcccttcagatgaagttgttcatcacgagcaatgaacttcatgattttagcattaccttccatgatttccatatttttatggaagttgaaggtacacgcaaaactaacatagaaacgaatagcttctaatgcgttaataacatgtaagcaaagataaagagatttcattaaatcgcgtttagcttctttaatttcgatattatcttgattaaagcagcgatttttggcattttcccatgcgcgagtcttcgctataacatcatcatagtaaacaccaattgactcagcgcgtttcatgattgcttcgtcaagaacgatttcatcaaagattttagctgggtctacataaaggttacgcatgatatgcgtgtacgaacggctgtgaatggtttcactgaacgtccaagtctggttccaagtatctaggcttgggtcagaaataagtgcagataaaactgctgctggagctcgtccttgaattgaatcaagaagagattggtacttcaagttatcagtgaagatattacgctgatgttctgggagtttttcaaactgaccacggtccatcataacgttaacttcttcaggacgccaaaagaaactcaattgcttctcaatgagttcctcgaatactttatgacgctgaatatcatagcgtgcaattcctagaccagaaccaaagaacatcggttcggtcatgatatctacttgcttggtattaaaaactgtactcattctatttcctattctgtggtgttaaccatccgtggtctaattataattcccttttattaaagcttacaggccgcgcagtcagcagagtcttgaatcatatcatcgttaccggaaccgtcacgggtgttatgatagtaaagagtcttaccgccaaagtaccagaaataaagcaagtcgtccatcattaccgacatttcaacttttcctttagggaaattcgccgggtcgtaataagtattagcagagatgctttggtctacaaatttctgcataatcagaacctggttcagataaggcttattaccctgtttcgcgagctgccaggcataatcataaagggaagcattgtgctcaacatttggaacgacttggttgaagcttccttcttttgattctttaactgacactggtccacgtggtggttcaataccgttggtagagtttgatacctggctagacgattcgcatggcataagcgcagataacgttgaatttcggataccgtatcgcttgagatcttctcgcaggagttcccagtcacagacatagtttggagctgcgagttggtcaattctttcgttgtaccagtcaataggcagttcaccacgtccgtatcgtgtttctttgtaaagcgtgcatggacctttttcgctagcaagtttaacagaggctttgatgagtgcatattgaatacgttccatcatttcgtgagtaatatcattagcatctgcgtatgaagcaaagttgcttgctaaccaagctgcatagttagtaatgccaacacctagtgctcgacggtctttagcttttaacgctttgtctacaggatagtcttggtaatccaaaaggttatccaaagcccttaccattacttctgcgatttcgttgacttcttcttggtcttgccagttgaagttgtcgagtacgaatgctgcgagtgtgcatagcgcgatttcgccatcttcttggccaacatccgaagttggtaacgcaatttcgaggcagaggtttgattgcttaaccgtagccacatcacgaataaaaggaccatattcaccaacgttatctaccatgtacgggtaaattcgagcagtaccagcacgttcagtaaggaacaactcaaacagttcacgagctttaatacgtttctttcttacgtctgggttcttttccagctcttcgtataaagtacggaacgcttgtgcatcacggaagtattctgtgtacagcgtgccaagacatacatcgggactgaacaatgtgatgtaatcattcttaatcaaacgttcaatcatcaggttattaatctgaacaccataatctaaatgacgaatacggttttcatctacacctttgttgttcttaagtacgaggaggttttcaacttccaagtgccagattggatagtacagtgtcgccgcgccaccacggactccaccttgggagcaggatttaactgctgtttggaagtgcttccagaaaggaataactccagtatgtttgacttcaccgaatccaatttttgaaccctctgcgcgaatcatgcctgcattaataccaatacctgcacgcttactgatgtatttcgtaattgatgcagcagcttcgttaattgaattaagactatcaccaccttcaataaccacgcatgaactaaactgacgtgtcggagtacgaacaccagacataattggcgttggcaatgaaatctttttagtagaaactgcatcatagaaacgaataacgtttgctaaacgattttcgccatcatcttggtgcaagcacataccgatcaacataaaggcaaactgtggagtttcatacaattcaccagtgtgacggtcttttacgagatacttctcgataagctgcattgttccagcataagtcatagtgaaatcacgctcatgcttaatataagaatcaagcaaagtaatttcttctgctgaccatttacttagaatttctttatcgtacttatttgcgttgacgcatcgggaaatgtggtcaataaatgcaggtggctcaaactgtccataaacacgcttacggatttcaaacatagctgcattagacgccacatattggtaatccggttcatcaatagaaatgctattcgccgctaccttaacgatagtcttttggatatctgcagtgctcatgccatcacgtagatgggatttaataatttcatataactcgtatgggtctactttggttccttcgcacgcccattcgaggactttaatgattttctgcatgtcaaattcttgactaacacctgagctcttaattacttgcataagtcctctaattcaaatgtatctttaaaaagtttattcactacaagagctattatatcaccatggcaagaaagcggtttgcaggtgcatcctaatctcattcctcttaaagtttctaagtgctctcgctttatttctccgttccgaatcttagcaataaaatcgtccttaaatgccgcaatagcatcaggacgattatcgcaatctttaccgacgtaatttccccacattgttccacgttggatatttacatcgaagtcggaatggtatttattaaccacccgacatatcttcatgttatatcaacttcaaaccagcagattaattgtgttttgccaatagaccattcatatgatttaatgacagataaaacgcgttgttcgatcccgtcaaaaactatcttgtcattaacttcaggcaaatcactagagaatgcatcacacatctcgcctaatattgtttgtcctttacgaacaaatcgaatattcatatagccattttccccttaattgttggatgggatttatatccttcaagaacaaagtcagatggtttcatcattcctgtaacccaagctaattgttcttctgttgctaattcatgaaattctttatcttttactggaggccaataattaatttcaagttcacacagctcttttggcctctcactgttcaatatggttcagataaatgtgagtgttaccaccagtgaataccaaatgcccaggtttaagattggtcattttagcaatgatatgaaccaatgctgcatatgacgcaatattgaaggggaggccaaggaatacatctacagaacgttgataccactggaggtccaaatatcctttacgaacgttgaactgataaagcagatggcacggtggtaatgccattttgtccaaatcaaccgggttccaagcggtcacaatctggcgacggtcagttggcaattgcttgatacggtcaatgaccaattttagttggtcaacgcccatgaaatcacgccactgctttccatacacgggtcctaactcaccaccagaataccccatgtcttttgcctggttttcataattgtcgtcccagacagttttaccttctagtaatgaaccatgctgaataagacgcaattcatgaacattagtagacccctgcaagaaccaaagaagctctgcaatacatgctttccatgcaagacgcttagtagttacagcaggaaaccctttttgtaaatcaaaacgtaactgagtaccaaacttcgcaatagtgccggtaccagttcggtcatccgtctcataaccgttttcaaaaatgtctttaattaattcttggtattcacgcattaaatttttcctgaagaggagtaaagaaaagctgatcaccacgcttttcaaatcgcccaataatagacactacatcatctttgaccatcacattgccatgtgacattccgatgaacatcttcttataatcacgttcaatttcaataggtatatttccatttcggttatatactgtagttgaaccgttataagtgctaagaccattataactgaaaactagaagatgaataccatgcttaaatggaaatcttttccacctcttttggactttgtcttctgatagctgagtgatatcatagtttgcgctcatagaccacctctgaaatgttagtcacttcatcaatatgataccagtgattttctttagtaatgaatcctgattctggccaagtaggagctgctacaaattcagcaggtagagtgacatcagaattcactctatgactttttctgatggttgtttggataaccctatctgcatatggatatgccttctggatgattccggcaccacctatgatagaataattaaggtctctattaaaagtgatagtactgttgtaagaagtatgagcggccataatgtcaccacccaagaaaccgataaattctaattcacttacataagcatctgcaaagaagccatttttagcagttgccaacgcacgactcatgtcttggacaacgattgtcttacgaccaggaagaggtttaggaaaactcataaaagtctttgctccgcaaatcaagatagtatctcgagtacgattagcaaagtttttcatgtcctgggaaatatgtttccatggaagaccatcgcctaaaccgaaagcattttcgtttttgccgtctacggtttttgtaggagcaaatgcataaactatttgaatcatttaaacctcagcaaaattcaactcgttcaacattaccatcttcccacttctgttgaagctcttggagacgtttgatagcgctatcgatattggacattgcacagatagttacccattcacggccatcccaccaaatcaaatcatcgtaatcatctactgcgaaattttccattaaccttgcctcattccacacttaaaacaccggccacctaattgccataggctaccgccgcagtacttacaatcccagtcagttaaaatccacatgacttgtacccactagctttaatcatgttctgaagagttttaaacccttctttaatggcttctgaaatttcctcaaatacttcctttttaagaatatacaacgaacccgcttgattgccagaaagagctgaaatcacaacttggtcattaattaaaaattcgccatatgctgaatcaattttacctgaaacctgattgcctcgggaatgagggtcaaatacgagctcaatatgagttactccaggaatttcatcaaattggcagcgaatgttaacacgcggatatcccgttacactaaatttagacatataaaaataatcctaatataatgccgctaataaaagcggcagtaacagaaattagcaaaactactaattcagcctcaatcatttcttggccttagcaagtttaaatgcttttttgaattcttcaacatcttcaacaggaatccaaaagcctgagccatacccatcttcatagcatgggcagttatcacagtaatcattccaatagacagtttcaccacccatagtgaatggagcttccatttggcacagtacttcttcaacacgctctaattcttctgggtttttatcgcaaatgcagaaattccatttaccacgatattcagaaccaagtttgatgctttgacgttgaagtttcatttttattctccagtagattatggagctatactatcacaagcatagctccttgtaaactactttttgaaaacttttttgatcaagtcaatcatttcttctgcattttctggggtaacgatcaagtccaagcgagtaggaccaggttggattgcactaccattttcatataccggttcgaagtatttgaattcataatcagagatttcaaagtatgcgtctccaaatccttcagcgtcagcagttgttccatctttaaattttacttctgtgatgaaactattatcttcgtcgagcattttagtaggaaagaacgaaccaccatgctcttcaatcatcaagcgcatccggcgatttccgctagatgaaaggtcccactcggcagcaagacttgggataatgcgatattctgtgttcagtttcataatttacccgctaaaagtcgttaatgtatcttcacggcattcatcatccatgccaggaaaatattcttgttcaagccataaccatagtgtaggagtatcaccttctaccgtgatttcgtttcctccccatggggcagatttgttactaacttcaatcaaaccgtatttttcaatggtttcaatgaagtgttcataatcatatatttctacagtaacctgtgccattatcatttcctcaaagtggggaccgaagtcccccaaaggtaattattcttgccagtcttccatcatccaatcgatatcgtcccattcgttggcttctaaccaagcacgaaccgcttctttagaaccacggaggtcaatatttggccaaccgccaccagggccttctttaataactaaatcaaaatcaataccatggtcagtgtcataaaaacgtgaaccatcttcaaaaatcaaatcagtacaaaatcctgatttattgatgtaaggttctgccacgatatcaatgtttaatttacccatgatgttttcctctactcgttttgtttcgatgtagatatagtatcactcatcaactggcttgtaaacaactttgtgaaaatatttttgtagggataaagaaaaagggacccgaaggtccctttatattagaggtcgttcaaaatatcattcagatcgtcatcgccaacactgtcaccagcatcgcccattatatcgtctgcggaacgagaagaggtcggtttggattcaaaatcagacaggtctttgtcaaaggaatccaggtcatcaccaattttatcggcttgagctgctgcttttgccgcggcaccaccaagagctgctgtacccataatctgtttaaatttggcttcgttaacttcaaacgatttaaactgagatggagcaacaatttcgctgaggtcagccatattttcggtcaggaatttctgagtttcttcatcattgatgtttgcaatctcggactgaccaaggaatttacattcatcatagttctggaaaccaccgactttcttaactttcatgacgaagtttgcaccttcatacacacaagttacatcaaccggagtttcacccatatcaacatcgacttcaaccatcgcgttgattttgtccataattttctgaccgaaacggaatttgaatactttaccttcgttttctgggttagccgggtctttaataaccaggatgttagaccagaaagaagttttacgtttcagaagcttatattcagctgggttgctgttataagaatcgtttttactcagatgagcacaaaccgggcaagaatcaaaatcgccgtgggtagaagtacaattttcaatgtaccatttaccgccgtgtttgaaaccgtgattgatcagttttacaaacggcagagagttttcatctttaccaggcaggaagcgaattactgcttgaccattaccagcattatcggtcttcagtttccattcgtttttatcttcattagagaaagaagaaccacctttcagaccggccagttgctgttgaagttgagcaggattttttcttttgaacatgatttattttaccttgattttatttagacagttatttgtgtgacgcgctattgcatttacagaaatacttttcccgcacactggacagttttttctgggcattgttttacctttcatgccgcaaggatgaggttgtgtttgatgtcgtttcttagcaccatcactccaagtttttagaacttgtttacctcttgtattatttattctatcaccattttcataatagcgatgcaatccatttgaaattaatttcttatgctcttctgtctttggaacatctgttaagagttctgatattcttttacaatgatgttcagaatttttctttccaaatctaggagcattttcaccagaaccaccaaatttaccggaagcagtagataaattataaaatagttctgatttagcaacatcataatgtttatgataaaattcttcttcgtcaagagcgttatcacatacatgtagtattttaacatcgggtttttgaagcgaaattgcgttcaaaaatctttcttgttcacatgacgaccaatactcaatatttctgttgtcaaaaataacaccattgacaaaggtgcaatcatgttttgacccaatataatagtaaggtggagttttattctttaccctatcagtaaaggtaaaccaatatacgatattcattggataattatatactaatttctttacaagatttgattatgctaataaagagtttcttagcttcagcaccgtcaacgtttaaaagttttttataagcttttaatttagtagagtaattactccaaactaagttatccgttgcagtatcatgtgtatttattatatctaaaaacgagtcaagcatgatgaatgtctcgaaagatataacgtttgactgcagaagtttgaacacataagatgttccgactttctcattatattcaaaaatatcatgaagcttatctacattaactttcttggcaaaatagtaaatgttctttacatcttccgagaacgttgttttaatctgcttcaacttacctatatattcacgataaaacacaagggcatcagcatcactgatatcgccaatccaagcatcttggttagctacgaggttactcatgaatatcagtgttaactcttttaatgtatatttctcagcgagtttctcaaagaaatatttgtctctacgcttttgataagctttatcagagacccgcataacccagttatacttaacaacgtcatatcgaccggcaaagtgttgtttgagcattaaatataaaagataaacgctcttaccgttaacgtatctgttattatttccaggcatgcggagacgaatcataataaaaagtccagactattcgttttgtgtgtttgactaaatgatggacgaagcatattttcttccaatgcttctgacataattttttctatgattgctggaggaatatatctattgaagtttccctcaggaatagaattttcttctaaccactgagttgttgcttcaagataccccattccaagttctgttaccatagactcaatagtaaatccgttagcttgcttatctaacagctgattaatggattcagagggggaggtatccccctcgtctttaagcgaaaatagagtcataagcttctaccacttcatctttttcagtttcaaaacgatcgcgtgtgcctttatggaacagagcaagcagttgattaaacagtttgccttctacgccaagttctttcttggcgcggtctttaatgtctttgttaagttcaagatagctttctgctttcaacttattacctgaggcttctttaatcatatctcgcagagcctgtccatgtaccgcttcatcaaatactacttgctctttttctttcttagccattatattcaccttaaaagttgttaatttctttcattaatttagacagaccggatttaacaaagtagctataaattttgccacgacccggtaattgatagttattataacaatctaaaatgttagcaacaatgtcttcgcggatgtaatcaaaatcgattaacacgcggttttccaagaaacgcttatactgttcttcagtaagcaaatctttaatgttttcgccagcatcaagacactcttcaacaaacgtcattttcgttgaaggagtacgctcaccatcaacatgagtgtaccaaaaatctgaacgaactttaatagaagcgacgttatctttcttgtcacctttaataattttaaccatacaatctaaagcaggagaaccggttttagattttaccagtttcttctgcattggtgaccattgcttaacattaggatacttatgcaattgagtaaagtcaccatccgaagaaacaatcatgactggatggccttcgagactgaactttttggttaataccgcaatgctgtcatcagcttcagctttatcaatatcaatgacataataaggcatatactgcttaaattcatcaattacagtacgaagaccttcaaagtatccatcccagtcccaattggattcttcacgggctttagcacggttctttttatagtaatatgctacgtcccgacgccaatacccattaactgcgttatcaacgcagatgacaattttagtgtatccatctttcttccacttaaaagcattaaattttaaagtagaaagaataagatgacgaaccataggagtggttagtttgtcaccttctttatacgtatgaagaattgtcgccattgcaatttgtgacaagtcaattaaaatgacgccctcttttacctggtcttcttcagcgaataagcaatttaaatcagacatttgaacctcgttcaattagttagtacagccattataaatacttctataatgaagcataaccccataggagactctatgagcgatttactgaaacaacatttccgtgcaacaaacggcttggacgcaggcggaaataaagttataaatgtggcactagctgaccgcaacgttaaaaccgacggcgtctccgtcgagtacgttattcaagaaaacactatccaaaaatatgacccgacacgtgggtatctcactgattttgctgtgacttatggacgtcgtatctggattgcaaataaagatattccaaagcctgctggagattttaaccaggcgaattggacttctttacgtgttgacccgaactggatttataccgtccgtaaaggagagtttgaaattcaatctggtcagttcatcaacgttgactctaacgctgcaggtaatgctacattactgcttccgttagcaccagatgaaggtgataccatcgtagttcgtgatattggcgggcgtcctggctataacggaatcttaattaaagcacaagatactggtgcgtctatcgtatttggtgaatcgcgtctgcgtgaggtaagacttacacgtccgtattcacaaattatgcttacgtttagtaatggtgcatggcgtgcaagtttaaccgattttggcgatactgccaagatggtagttccgaacgggattgttccgacgcaagttcaggcaggtgataacgtagttcgtcgttatacttccaactcagagattttcattactctgccgttgttcgctaattcaaacgatatcatcaattttactgaccttgacggtacatcgccaattaaccatatgactgtgcgtacgtttgacccaactatctcaattgggactcctggacaaacagaggttcaagtacgtacttcaggtaatgggtttttggtatatgactcgattgacaaaatctggcgtatttttgaaaatgatttacgcacccgagtaagaataattacttctgatgttactttaatgcctaatgagcatatttctgtatttggcgcagataacaatactgttaaaacaattaacgttactttgcctacagacgtagctgttggtgatactgtcacaatcgcaatgaattatatgcgtaaaggacagactgtagtaattaaagcttctgatggtgataccatcgctagtaatttgaatttactgcaatttccaaaacgctcagagtatccacctgatgcagcatgggtgcaatcaagctcaattacctttaacggaactacatcgtatgttcctgttcttgggcttgcatatattgaagataaagcatccggaaaaagctattggattgtaactgaatctgaccctaccgtagaacgagttgatgctaaagacaatacaactagagctcgattaggtgttattgctcttgctacgcaggctcaagctaatgcggagtcaaacccagaaaaagaattagcaattactccagaaaccttaaatggacgtcgttctactgaaacccaaactggtatagcaagaattgcaacttccagcgaagttaatcagtcaacaactgcttcttacttggataatgtaatcgttactcctaaaaagcttaacgaaaggtctgctactgaaacccgtagaggtttagcagagattgcgactaatgctaaaatggatgcaggaacagacgattttacaattgttactcctaagaagttgctttatcgtactacatcagattcacggttaggtgttattcaattagtaaaaactggtggtgctcctaacacaactgctgatcgttcttctgctggcaccggtatattcgatcattctgattacaaaaatgcagttactccaaaaactcttcgtgagtataaagctactgtaaatcagtcaggaatagtttggttagcaactgatagcgaagttagaaacggaactccggcttcttcaaatattcctacagtcgttacaccagaagctttgcataaaaaagttgctactgacggagcaattggattaatccaaatagctacacaaactgaagttaatgctggcggcgtgactaataaagcagttacacctaaaacattaaatgaccgtacagcaactaacgatcgtactggtattgctcgcttcgcgacacctggtgcccagggtgaatttgaagctggtacttcaagtacagtaatggtaaaccctaaattactgttcgataaatttgctaatactgatcgtatccaagttaatactagttctggcttaactattactgggaacctctgggaccattataccatcaacatacaggaagcaagtacttctcaaagaggtacaaccactcttgctactgctgctgaggttagaaccggcaccgacgccaagaaaatagttactgctgccacgctacatgctaaaacagcaactgaaggagctatcggtcttgctcagtatgctacacaggcacaagttgatgcaggcacattaagtgatagaattgttcctcctgcttacttgaaacagactattcaggtaacagagtcatggcaagctacagacagcgttagagggaccgtgaggctatctacaggcgatggaacgtggaaaggtaatgataccaatggctcaactcttccggataacgggtatgcctctaagggcgtcgcagtgtctccgtatgaattgaaccttacactgaaacattacttgcctcgtctcggtaaagcctatgacacaggaatgttaggtggtcaaaccccagacaaatatgctcgtcgcgatatcgcgcagactatttctggagcttggtcatttagtcaggacacttcatttagcaataatatttctgttcagaatattatatatgctaatggtggtgaagtgaagatttctccaacagctgatactggaaatgtgcatgttcgttttcaaaatagagacggaactgaacgcggtataatttatgctgagccacagactgcttcagctggaactttaaaaattcgtgtcaaaaacggaactggaactactgctacaagtcaaacttatgtatttggcggtaacggtacgttagaagttcctaatgaagtatcaactaaaactctgaggtcttctggaaatgcaatagttggcggaactgttatggttaaggacgttcagatgcttgctgtcgagggattgaattcaatattcggtgcccaatcacagtccgcatttattcgttcccgtgacgctgatacacaaatttttgcacaggattcaactggatcgtatccaattttaactaccaaaaactatgcaagactagctgatggccgttatgtcaagaaagctggtgatacaatgaccggcaatcttaacataagcggttctgctatcgtcattacaggttctgaatcatggtatgtgccaacgaatgaaaccgtaataagacaaggttcttggactgctgaaattaaagacgctactaagttaaaaggccttcgtggttatatggttccaatcagaacaccgattgacccgggtaacccaagcactttggtagtgaccggatatgaagaaaagactgctgctggcggtgttttaactcaggttggtgtaactacaaacaatacttatcagctttggacaccttatcctccgacaaccgaaactgctgataagcgtttcgcgcatactgtgtggatgaggatttataatccaaaccttaataagtttgatgattggatgcgagtgttcacgtctgctactcctccgactgcagctgatattggtgctccgagctcagtatcaactcaggttaaaacccttgaagtcctggaatggattaagcttggcccagttaaaatctggccagaccgtccaaaccaaactctcaaatttgaatgggtaggtgattaatggctgaaccaattttaatggcagcctttggcgaggatttcgtggaaacacgaatcctctctgaggcaaactctgtgaagtattggctaaaagcttatgctacgcattctaatgctgttcctaataagccagaattgaatattaatggtgcctttgatatgacctcctccttacggagggggattaatgttgttcaagttaatggtgacagttttattaactttaaaacatttgacgttaccactgatgataataacgctaataacaaagcgtttgtagaatatgcaaatggattaacgtcaggattgtatattataatgacacatgaacgatttcaatccagtccgttaatagacagatggtttaaaaacaagtggtctgcttcttggccaggttctgatttttccaaatcatttccaaactctgcctatgttggagtgctcggagcagcaaaaggacgcatattaattgagtcattttacggaaatgatggtgtagttaaagaagattccagagctaaagtagatactgtatatgataacgttggcgatgtaggatatacaggttgcccttatcgttccattgaagacactaatgagtactcggattctactggatatgaatataaacgttatccagtacaaaatgaatctataagcaaaatagctgattatggattatctcctggagattctgtatttttagtatgtgatatgtatgcatctaaaagccttcttgatgcgggttctacaactagagctagcttgcggtggttcaagggtacatctttattatcttcaaacgtatcattagaagttccaaaaaatggagctgatagatggttaagatttgaaagatttactgctgttcctacggacgctgatggatttactattgtggtatcacgatatccaaaaacgtctgtagttggtgattctaaaatcaaaaaccttgtatttgttcaaacctctcacagcgaaaaacttaacagtgttgttcaagagtttggtgtgaatggtataagaatgaataaaggcgttgaaggagaaaccacagtgattatggaacttccaaattcaaaagtcgatccgagcggtgttattccagttcaatcgttcagagaaacatcagactaaggaagccttcgggcttccttttttcgtataaatagaaaatatataagaggataaactatggccgatttaaaagcaggttcaacagttggtggaaatcctatttggcacgcgggtacttttcctcttgtgccggcaggaaactccctaacttatagaggtaaaaaggtttatactgagatagataaacctcaagcaaatgataacgattttgtatctaaagctaatggtggcacaggttctcaagggttccaaaaagaagttgaatttaaagctggcgttaagatttccgcaacgttttctggtggttcaaacttaaatggattgtattctggtaacggagatggagataccagagaaaaatctaacatggatttgcgttcatggtacggtatcggtatttggaactcatgtacaagtgatggggtccaggggcgtacaatctggttcagtgctaggcgtggtactatcggaacagttggtgatattgtttcaggttcccaagttattgctaatgcttctactccaacagccgctcagcatttaactcgtaaagattatgtcgatgggcgaataaatactgttagcaacgtagctaacgcagcagtcaagaaagctggtgatactatgaccggtgtacttagggctaacgctggcgtagttatagtaaataaagcaacatccggtgaatatgctcctagattagatcaggttatttcacgcggggtaacaatagattttggcacatactaagaggtagccatggccgatcaaaacttaaaacaaatacaatttaaaagaactagcacagagaataaagcaccaggtgcagatatcgtagcccgtggcgaaatagtgttgaatacacatgggcgtactctcgctatctacaccaaagatgaagccgataacgttgttcagcttgcaggtaaaggtgttcctttcttagatactgcaggtaatcttaatgttgatggaactactacgttaaaagacaacgttactatttctccgaataaagcgatcaattttgaagcttctgatttaagcggagcattagtacgtcatatcaccggtaagtgtgctaataatgatggctggtacattggagctggcggtgcatctgaccagggatttcttgaaatcggtacgtatgataacggaaatgaacctatctattttgttcaaagaaccggtggaacgactcaagctgaagttcgtcgtttagcattattagatgggtttggcgatacctctatacctggggaccttcgtttaactggtaaaacagtaaaaatttcaaacggcagcactcttactttggaaatgggtgtaggttctaatgacgcttatattaaaaaccaaagaggtactggcgttcttcaattaactaatgacagcaatttaacgttcagaaattcccaggtttattacgccatgaacggaagaggtcctggtaaatccggtactcttctgacgaatgtagaaaacaatcgtcaagcctggcaatacacaatttcagctgcaactgccacaaccccgcgctgggttaaagtagctacattgaaacacccaggaatggcttcttcacaactggatttaatgattacaggtggcattgattctggacacggaagacattatgttgattttatcacgttatcaggacgcaatttaacatcctggagcactagcaatttagataactgggttgaatggcgcaggatgggttctcctaataaaggaaacgttccagaatattacgttgttaaaaacgatgctgctacagattcagaggcttcatttgatttttacgctaaagttcctcgatacggcaatgggctttatgtcacagtgctgaacactgctggatacaacggccaggatagtggtaaagtaattatctatgaaaccaatcaggacactggtgatactggaccgtccggaagtattcttgtttcaatgaaacagatttttgatagtttagcaaaaccagatttcggtgataccacaggtactcttccggttaaccgtggtggtacaggtgctactaacgtaggagacgctcgaaataacctgggtcttagaactgcggctgttcgtgatgtcggtgaatccagtggaaacgtgatggaagttggtgccttcggtattggtggtcacggaaaatcacttgtagatattacttctgacgttgatttaatgactcgccttaaggctcttggcggtacaacgtttagagccaacgtagcgagtggttataccggggctccttattattcacatggcgcaggtttcttttctagaactggcgatacaatgtctgcgcttaatatagattacgcaactggtaatgtcagagtatttgctataaacgatagcggtttagcaagtggaagagtgaatgctaatatgctttacggtacagcaaacaaaccaactaaggctgacgtcggacttggtaatctgacaaacgatacccaggttaagaaagctggcgacaccatgaccggtgatttaactgctcctaacttgcatgcttctggatcaggaaccgcatcgctttatattaatgcgggaagcggaaatgctcatatatggtttagaacaaacaccaatgaacgtggtgtaatttgggcaactccaaatactgctgatttaggacaaattaatattcgtgcaaaaactactggtggtacttctgctggtgattttagcttccgttctgatggcagatttgatgttcctgtagcagttaaagttggtggagcagcaatgctaaccaaagacggaaacatcacctctggttcaatgtttggcggtaatcttaataactatttgaataccattaaaaacgacattgttgccggcgataataagcaagtaagtaagactggcgatactatgaccggtaacttgactattaacgctaacctaaaagtcgaaaatcctaatggaacatttgttgatttgggttcagagaactcagacaaatacagcagattgacccttgcacgtaaagttggtgatggcgcttccgtagcaatgcttaaaattactcctgaaggatacgtgcaatttggttatcaagatgcagttgctactccatctcctagcaagtacatccgagttaaatctgatggtcttgatgtagaaggggacttggtttttaatcagacatatcgtggtgctgaaaatgcagttgatatttctgataagactaatgaccttaacaacatggttattaaaggcagtgatttaggtactcgtctattatacaagtgtacttctaccggtggcgcttctaatatattgaacagacctacatctgatggtaactttgttcttgaagttctgtctttgcgtaaaatttctgatactgactggtcatgtaagcagacctttactacaaagaatggtaatgttgaaggcacatatgttcgatactgccaaaacggcacatggtccgcatggaaagaggttgtcgctggtgttcaaccgattaatttaggtggtactggagcaacttctgtagctgccgctcgtaataacctcggtgttggtgaatggcaatctgtggcatttggtgtattgaatgtcaacggcgttagtaatgcagacccggccatcacatttaaaaatggggctatggttcgtgaagcccaaggtggtagtctcggcgcgttaatcctgtcggcttctactgcatctccagacggcgcgaaatatattgcttttcgacccttcggtgattcgtctggtactgagattagagtaaaagccaacgggtcaagtgagtcactacttgaatggtcttatggcccaggtattcgttcaaattcatctggcgcttttgttatctacgcaaaaacaggtcaggcactccatttaagaccaaacggtgataattctaaccaagccacagttattgaccaaaatggtaaaatgactgtcggtggtgaatttgaggcccagaactcaaaaatcactggtaatttgaatgtatctgaagataatagaatgattgttcttggcaaaaactctgatattggtttagtcaagaaaagtggtatgccaggaaaaatggctatcggtaaatctaactcgtttactattatggtatcaacaaataccaacaaccaaattaatcctgctgatacgtttaatgacatattcaaagtagatgctgatggaaaccagactgtttacggaaatgcccaagtcaacagacagttaactgtttctagttcagctactgttaatggtattattaatgccaacggaggtattattgttcctactaccaagtatgtacaaattgccgatgctcctacgcagaataaccaagcaacaaataaacagtatgttgatgataaggttgcttctgctattagtaatgctggcgacacgtatcttccattagcgggtggtactgtaactggtaacttgattgttactggaagccagttaaaaagtacatcactctgggttaccggtgatgctgccgttaatggtgttttaactgttgacggaaaggctagatttaatcaagagttcagtgtatctacttcagttaacgtccagaacgatggtaatagccatgtgttcttccgtaaagcaaatggtacagaaaaaggacttctttgggctgacgaccctggtaacgttagtataagagcaggcggcgccattgggccggtgtggaatttctggagcagcggttcctgccaattcccaggagctatttctaactataacggaattagtaccactactaattatcctgcaggaaaacctaatggtacatataacaataccgcaggactagtaactagatttagtaatggtgcttatgcttcaatatacttccaagagtatgtaggaaactatcaccaggctattcttaatgttaacggatttggtcgagacgacaacttctttttccgatccggtggcgacttcttctgtactcgtaatggctcttttgataacgttgagattcgttctgaccgtagagccaaatcggatatcaaagttattgaaaatgctttggaaaaagtagaaaaactaaccggtaatacttatgagcttcacaacacatccggtggtactactcgttctgcgggtttaatcgcacaggaagttcaagaagttcttccggaagcagttactcaggatattgaagcagacgggggtttattgcgtctgaattacaactcagtaattgcacttctcgttgaatctgttaaagagctttctgctgaggttaaagagcttaaatctcaactgaaataatgtaaggggcttcggccccttttaggagaaataattatggcagtaacaggaccatgggtaggaagttcggcaaaggccgttactggtgaaacctggatggcccaggctggagcaaaattgagattggggacacccttttggatgtccaacatgattggaagaaacgtctggaatgctagaataactatttctggtaacaacccagctacaggacctaaggttcgtggcgcttggaaagataagaacagtgcttcatggaacgtgttactcgacgctcgtggggctttatcaggaatttgggaaactgggtttaatttggttgcctttggattatcagagccaagcaaaacgtttggttataatgacgcaattgttctagaaggcagtggaaactttaacgttaactggcgagttgatactgaagacggtaatcaattccattttaatagctcccgagattaccgaggaagacgctgttatagctgtacagacaacaatgctttttggaactggctttatgctaatgatggacgaacattccagctgtcgtttactgcatattaagcataagttagagcaataaatagctctgtaaggagagcaatatgtcaagcaaacaatcaataccattttttgatatgtttcttgggttgctcgagctattattcaaagatggagccacgggaagagttctcttttcccgtgtttttgttgtcatacttttagcattgttggcgtttgctggttataagtcagatagtcttattactgcttacgtcgatagtacatatgacaagtatgataaactggttcaaaaggatagggatacccgatttgataatacagcactcgaacaactccagatagtacatatctcaagtggtgcagatttttctgcggtctttacgttcagacctaaaaacttgaactacttcgtagacttaattgcttatgaggggactttacctagcacggtagattctaaaaacctaggaggatatccaatcgacaaaacgtctgctgaatacagtacgcatttatcgggtagatatttttggacggataaggaattcgttttcttaccgacaaaaagaaaaccacctgaaatatcgtacatgtttagctgtccgtatttcaatttagacaatgtttatgctggaactgttgaaatgtactggtacaattccaaacctgcattatctaacgaaagactaacatcgatatgtggtcaggcggttagagctcttggaagagctaagtgattacttattactatgcatagccatcgttcgatagatagactcaaatccctcgttgtattcttcaacgagaattctcttctcttcgtcagttaactcagaaaccattttacgaaagttgctctgatttaactgacgcccctgctcgttcttgattccaatttcattcaagaacgcaataaattcatctcgcttctccatgatatgttcagcattgaacttagtcagaatagaagcaacagtaacgatttcttggacaatttcaaacttagtcattatttttcctacaacataatggattatgtgattatagtatcatcttgataccgcgttgtaaaccagtttatgccaattcccaacgagaattcaaatcttccttggtagtgatatactcagcaccagaggacatccagagcccgtagcgaccatcttttactttagccgttaaataccattcctttccaattggacgaaccctacgattcatccagtgacatacgtcaattgcctcctgaaaagacaagtcaatcagacttccaagcgcgattttattcattaacgcttcgagatatctttgtgattcaacgacagattctaagttatgactcatgctaaaactacctctccacgattgtctaaaacacgttcaatgtattcaactgcatttataatgtcacctctatcctttgccttaatagtaataattccatacgtataaaagtcggctgacaaactgaatggcttagaagtgtcctggttaaacgtagacattactgcttgctctaagtgttttacttctaagtcattagcccaagagctaagaactttaagcctaacttgtaaagtgtattctactttaattgctgaaagcaattcaacacgtttatgatacgccttggcttcatcttctctgcgtaaagtttcagtattcatagataatctccaatatcataagcatcaacacatttctgaaattgttcaagaacttcttcaggttcaacgttagctataatagctacagtaaaggtaccattattccaatcatgtaccatccaatctccatatccaacattctgaaggtcttccattagttcagaatggatatctgctactaatccagaatggtcccctaatttcttgtggagagcttctaggtcatcacaaataatagttaaagtagtacatttggaattattcagaatgcgcattgtctttacctttgtgtttttgcttacgttttgattctttggcagcgcgctttttatctttatgcgcgcctcctttgttaaagtcattcttcgctactgggttgtacatgtgcaattacctcatttaagcagttgcgtgtaatatcaaaacgcttagcaataccacattcttggatatgtgcttttaaatctccggcatgcacataccccaattccaagataaaccgtttaatttgagccttttctgaacgatttaagctattgaagtaatctgccttggcgcttattgctctcacgctctatcttccttacattcaagttccttgatataatagtcaatatctttaatcatttcttctgtcattattttgtacatttcagcaagaaatggtttagcaccgccattaaatggatggctaaacgggcagatgtattccttatccatgagagttttcatgaatttgctatctgccattttaaacccggcttcattggtatatgtaccccaattatcgtccatcatttctaatgagcgctgaagcgatttacgttgaatttttaaaagcgtaatgttattctttaatgtactaatcattagtataaatcctctgagaataattcattggcgggtcccgatttaggacgaactgtattaacttggcctgcatgtgtagcgatgattaatgcttcttcacgcgtgaagtactcaccccattggtcaacaaatccttgattgtctccatggacatgatcagaaaccaatttatcgcgaaacatatctaaaacgttcgccatatcagcagaataatggcgagtgcctggaactacaattgttccaccagatttcaattcaaaacgatttgctgcacaaacgatacggcgttgaagtaatcgtccatcccaccaatcagctactttaaagcaaatttcaggaatactaacttcttctggttcattaattagagaaccgtgacgagaagcatcaacaaatttattcatttgttcggaaaacttgctcatttaaagaatcctttaattttctgccacaaacttttcttttcacgaataccgatttgccgaataacaggttcaccctgcattttctctaaccattccattgagttaacagcttccgccattggaacaaatttagcaagggccttttggtaattatctacatccatgatatgtttaccatctgcattgtagatagcatagcattttgtgaatttcttatcaatgtatccgataaagtgcccacggaaccatacatcccaacaatcagttgggatattagcattcaagttaactttttctacacaacgctgaagttcattcaatactttaaacttgttcattacagttccttaatagagcggatgatggtttcaatgttttcagcagtacgagcgatatctaagtaagtattgcctgttgcagctacacggcaagacattccgaggtcagtgaagtgtttctgatgctcttcagaaatcttgtaaccgaagatacggaaagtacctttgttgttaacttcaagactacgaataccgaatgtacgtttttccagaactgcgatatagttactacggtaaacagtaagttctttcagaggtaagatatcttccatctcaccgagaagtttcatcatcaggtctttgtgctcattcatgtcttcagtaagaggacgagctttacgagtattgcgtttcttcagaagttcaggcttgttctcttctgcatagataactgctgctttagagatgatgtcctgcgcttcaccagtgatgattaaaccgtcaccagatttctcgatgagacctttcttaatcagaacaccgatgtttgagtttacagaacttgcgttcatggtttcttcaaggatttcacgcagttcagaagaagtgatgaaatcctttttagctacctgaaccaggatagcagcagttttctcgttcagagcatcttcggaagctttgatgatgtaagttactttagacattgtgattctccatgatgttttattcaatttgtttggtatgatactataataacatctgctaaccagcttgtaaaccattttattctgctctctgaaaaattttcttcaaagagcagtaaaaatgctatacgttaaagatcaagaacttatcgccattctcaagtttaagcacccagaaatcatcatatacacaaagaacgacttggtactcttcaccgtcttcatagttacttgcttgaattacctgacgcataggatactcgcgattaacttcgaactcatcgagcaccacaatgttacctttgacatagtggctcagtcgagtgccatcagcttgagtagaaatataaagaatgtttttgatatcagattttaatgatgtaatcattttgtttactccgtgttgttttgatatggctataatacaacaaccgtgtaagcatgtaaacaactttatgaaaataatttagggcattctaaggagggattttggatggatatagatttatatggaaggacctggagatgacctccaggttccctagattaattgaggagcaataaaactagacctaatacggcaattacagaacctataactaaataaaattctatcatagttcttccaggtctttcagatactcagcttcaggagttgtcttttcccagtacttaacctcttgtgctaggcgttttgcttcctgagcaagtttcttggcttcatcatcagtgatgtgatagatgttcattgaaacgagtttttcagaatggtctttgaatagttcattctgttcaatttctttagtcaactgcttacgagttttaccttggataacgatgttacctgcaataacctctttaataaattgagcttttgcctgagcaagattaaacgcctgtttagtttcagctattttatgctcgattcgtttagcggtgaatgtcttacggacttctacaaaatgacgaatcagctcaccggaagttttgaacttgtcgttcagcttaccattctcatcgatgaccacaatgtattgactcattttctcaatgagtttaaaatccttcatgattttagcatgacgctgctcagggtcatcgctcaaagcatagtctttacggaatttcaccttaaagccaaacccggtcttagaacagtcatcatcatatgtgatgtatcctgcatcttccaacgggtcaagtactttttcaacgtaagaagctcgttcaaacttgtatggaatttcactgatatagattgagttccgtgaagtttctttatacacgccgtgcagctcaacagaaccgtcttcagtttgaacgatttttccgttaaatttagggaactgaacttcaggttccatcatttcgccacgaagtgctgctttagtgcattctaaaacagattcaaaactatgcggaagaatagaagttgaataacctgttgcaataccgcgaacaccattcagaagaacagttggaattaccggaagataataagcaggtggaacatgctctttatctttatgcaccggagcgatttctgtgtctttgtagattttacggaagttgtcagaaatccggcagaaaatataacgacttgccgcagcagattgaaccaaacgagaaccgaagttaccttgtccatctaatagaggatagttgttattccatgtgtttgccatcagtgcaccagcatcttgggcagacgtttcaccatgatgatatcctaaatcagctacaccaccggcgacagacgcaagtttgtggaatttttctttattaccacgagccaaatcaagggcacgagcaataacaaaacgctgtacaggtttaaacccatcaatcaagttcggaatagcgcggttttctacagtgtaaatcgcatactcttttgcttcattatcaatgatagatttcaaatcgcgatgacgaagatttgacgccttagccaaatcatcaatagaacctgcttgttttaatagagtgtcaaaaatatccattgtacctaccaaattagtgagccgatttgtactataacatcggaaatgaaaagcacaatataaatcattccgtaaatcattccatagtacaaaaccaaaagaatgatggaaataactgcggcagaaactaggagtttcttaatcatttgtaaactcctacaattttacaaatgcgctcaaacataataaatgctgcagtgaacgcaatgcttccaattactttagtggtaggcacaaggccataccacatgaatgttcctgagcaaatcattaaggccatcagaaacacatagcccatcacgaagaaggttctcattagtatttctgcaaagtaaagatgaagttatcattcagaatacgattcagctcagagtaggtctgcgcatcacttgaatgctgacgagtaaacgccaatgcaagctgacctttgccataaccagtggtgagtggtttcattttattagcaggaatccagaacacaccgtaagtcatgcaattcgagcgcagagtacgacccaactgagaacgtccagaacggatatgagaaagaacactttcaaatcctgcctttgaacgctgtttagctacaaagaaacgagcagatgcaccaatataccctgctttgccatcattgaacatcaaaaaataaaatccttcacgctcagtaatttcacgagatggagcacctgttgcccaatcaccgttacgaatagaaccgatcagttctgcgccagcgttatcgagatcagcaaaagtcataatattacgcatgttaatttcctcagttgattaaagtttattctccgataaggggccgaagccccttctactaccaaaaatatactactgccgttacaccaccaacccaaaacacaagaagacctaaagcaagcagacgatacacgatgtgtcgtttcatttttgaccttcccatacggtttctactaaggatttaaggccatcagtttgaataatatcaatcgcattaatggcaaaataaattccgaatccgaacacggtgacaatccccagtgctaccgcaacaataacagacagaacagctgttctcattaagttaaagcgacgatcaaaactattacgaaccattatattttcctcagataaatgcattaatccaaacgttaaccaaatcccatgcgaaaacaccaatgaaagtaacgataaggcagaatactacaaagatgttcttcagaatcgtaagtaactttttcattttgttctccagtttagctaacaagactatagtatcactggagaacaagaaagtaaactattaaatgcacaaattacgaattttttcttccagagctttgactttctctatgtgctcatcacgagcagcggcagctccattaggatacaacccgccatacgttgaatcaccgttatcacaagcaatgatagtataatgccaattcatagattcaagaatcttatactctttcaaaagctcagctttaatagaagcatttccgcgtttggctcgaagtgattttagctctaagtaactcatgttttactcccgttcagtttgtaaggccatagtatcatggccaatcccggaagtaaacaactttttaaaatttatgcatgatgtacccgccagcaccaactcgcgaaggttttacgacttccatgagctgttcgataccgccactgaacatcggtgtgtaccgtatgacattctgggacacttcttctgcaacgaatataattatacagtctgcgactttatgtttaaacatgggccctagatttattccacttccatctgggaatggaccgtctttaccagttgtaacattaatccatggcttatgatttgctcggtcatgaacaaagtgtgttttaacttcaactctaacaccttggtagtagggatgagctagtacgtcccaggcccattcatacggatcgttgttattatggtcaacaacttgatcgtttacgtatccatcaagaaaatccgctaccacatactctgccggtatagcaattctacatcttttaagaacatcaattctgtcttgagatggatcgatatctaaactatatcttgcagtatcaatgatttttacttttgcttcaccccttagcttattcaaatctagggtaaatgtccggagttggttcaatctctgcagggctttgttcatcaatgccataaattcctctgatatgtaattcaccaaaataaacacgatcgtcgtggttacaagtgtctggttccacaacaaaatcatcaccaagttctacaagttcatcacagtgcaaccaagcatagtgaacatcaccttcatgtttaactacatgatgacaaaacaccgtagcagcatgatgagtaccacgaagattaacaactttagaatgagatacgttaaatggattaatcatgtttcacccataataaaagaggagcccgaaggctccttataattagcgaagttctgaaccccaacgatcagttacatcttctaatactacataaccacatgtacgcattttagcgtcgttgtaatcaaccgggatagatactacatcacgcggatgaactttaactgaaacaatacggtcagaaccactaccgaagtgaccgatgtaagatttagagcagacatgcagacctgctgaacaagtacgctgatcgtcttcatctacctggttacgcggcattgtaacagttttaccgggagagttatcaaacgtgtttgaagcacagtccatataagtggaacgaactactttccaaccaatgaagtgaccatcatcagtgatgtcgatatcgtttgcattcaggaaatcaaacagacgataaactgcacgacgagatgggttcagcatcaggttttccaggaaaggcagataacgtttaaagtcttcgccatcttccatggctcgaacgatacgctcagtcagaccagatttcagctcgatatctttatagaataaagtaccatcttcaattcggacgttaccctgaacgaatttcttgatgccttgttccaggttaatgtggtcaatagcaccagcgatatcaccatctacaagtttctgcagtgcagatttaaacccaggatgttggctatcagcgttataagtagtacggccttcagtaattgaaatgaatttggaacttgctgcccatttaaattcacgctcaactggagcttctactttagcaggaacagctgccgcggcagctcgagcttcgcgttctttaaacacacgccgaatggtgtcacgggaaacaccataattctcggcgagctctttcttagtgtacagaccgtttttgaagtttttaacgattgcatctttttggatttcagacagacaggtaacagccatttattcacctttattttcagaattttgagtagaagctccatcaaggagctccatgatttttacgatatcatcgacgagtttgctgtcagtccgccaagtatccaagacacttgcgatgacaggataatcatctttaaactgttcaatctttttatagaagattgtctcagcatcaccagacagtttattataaattttattacataaagctaaatcatcgttttcatctttgattttactggtacggcaaaccttagcgattttgtttagttttgtcaggaacggatttttcattccagacgcagtaaacttactcgacaagaaattcaatttatcgtaatgcgcaatatttccacagatacggtttccagtagcatttgatggcatgtactggtcataatctaccttatcaatacacttgatgtattggtcgataataaatcggtcaaatgaaagcaatccatcagcttttgccgcggctttcatagcacccggacgaattgcatagaatttcttaattccacacgcttctgccagagaccgcatatctgtgatgctcatattccaccaccaaacattatctgggaaagtgtggatttcatcacgattgcgaccgattgcataaccttcaagctcagcaatttcagatgatactaaagtctgacggtcttcttcccagtacccgtctttatcaatccaatgcagagaaacattaggagattttggacgtttctcttttggaccagtatcataatcaggaagagcttttctctgggcttcaagttcagacacacggaatactacaacttcatcagtatccatgattttcttcagctcatcaatgacatgtaattcatcttcattgtctttgattacagtaatgtgtgcccagattggaactaacccagatttacacagagctcgaaccgtagcaatacgcttacccgctttatcgtcaataagaacgaacgctttagttctatcaaccccgcaaatatcagaaatgtttacttggttatgacgatgccaagaactgcttgacactttacgacgagcaggttcatcgcatgaaacataaactgatacttcgttgtctacataatatgaacgaattttatcgagattatacttcgcaactacttgtttaatatcgcggttcccaatggtaataccacggctctgaagaatagaacgttccttagaactcagcttattgaactcacgcaagaattcacggtcagattcatacgcttcaaacgctttaatatctgcggtaattacctcttcttcaagagcattcacacgcttctggatattagcaattgtttcttcgtcaagagaaagctcttcacgagatggagtaatgtctaattcgccaagagggaaatgaacataaaccttgccataacgattaagcagccaatctgccttaacatctacaccgctgatcggatatacgatttttccataaactgcatacagaccataactttcgtaagagctattaacgctgaaccagtcggtcttatctaccgggaaatattcaatttcacggcgaagagaatctacctttggaggtacagcaccaaaggtacgcaaaatatatgcgatttcataatgccaagtatcaatatcttctactttaaccggaacagtgatttcaagaccagtttcttcgtcttctttcatgtcatcaacgaacattggacgaatagtaggttcgccgcggtttttcatgacagtataacctgtagctttaccatcatgataagacactacgttaaatgtactcgtatagcttaatggtgatttagaaccaagaccaagagcaccgatgaaatcattactattattctttgtggattcaaagaacgttttgtacatcgtcatcatgtcattatgattaagacctggaccataatcacgaattacaaatcgtgggtcaagacgagtaggagccttgatataaaatggacgattttcattaccgttcagtttatgagcatcatcacagttagtagaaagttcacgaacaacagcacgaactttatacttatagagtttgtttgacaagatgtcaaaagctttacccgaggccttaatagtaaacgttgaatcatcagcgtcagaagaaccaatgattacttcatcatcacatttaattttcattttattcctatcaattatgtcgtttaatgatttctgctacttcaagtaactcttctgcagtagcggtattagttgtaaaaattttattatggatttctttgaagcgttctttgaattcctcagctgcttggatgtcaaagaaccgctggatgatacgatattcacgatatatagcatcgttgaataattcttctgatgggatgtaactacgtttcataatattttcctcagtgatttagggaaattatatcactataactttaagcaagaatcctagaatcatctccaagcacttcttgattaaagccatataaatccattcttataaagaaaaagggacccggaggtcccttagattaccacaccctactaactcgaccataaacctcatgtttagaaccatcaatgttttccacccagatagtaacccaggttccgggcagaggtttcttttcagcgaacagatatccatagtcgcctgagatcaaagtaatccaataacgttgcatgttaattccttctaagtaagggcaatagtacccttactatttattctttattcactcatccatgtcttacgtggtgcagcatcattacccataattaattcaaacagttctttccagttttcaggaagagtgactacatcataaaccgggtcttgaataacacgttcgtattcatcttcttcaagagagccaagacctttaatataacgaagtttccaacctttgaaatcatctttatggtcttcatattcaccaagagaatagaaccaacgttgttctttacctttggtgagaataataaccggagttttcacaaagcggattcgaccttgttcaaataattctggccaattactaaagaacgccaaaagacttgggaaaattgaaccaacaccatcaacgtctgcatcagtcatgatggcaatatttcgatagttagtattttcagcgggttcaccgatagtcaaaccagtgattgcacaaatgtcaaatacttccttgttcttcatagcatctgcagcagacattccccatgtattcatgaacttaccacgcaaaggatatccgccatgaagttcacggtcacgagttgtaagtagataaccgatcgcagaatcaccttcggttaagaataaagttgtgtcagcatctttaccatatttgttggctttgatgtgcttagctactttagctttctgcgctttcttggcagctttagtttctgcggctttctctgcagcaagtttacgagctaacatcgcctcaataatcggcatatgaatatcttcggatttcataatagcgttagcaagtttcttataatcaatatcaatatggctacgaatttctccccaaggagaagtcagacgctctttagtctgagaatcaaatcgcatgttagacatatcacgaataaacatgatgacagtcagacattctttaattcgcgctttattaacttctagtttgtacttacgctttaatgctggaataagttcattgctcagttcatcaagaactaggtcaacgtgagtaccaccgtttttggtgtgaatgttattaacatatgaaagttgacggaacccgtcatccgaacgaccgatggcaatagcacaagtatcagaatcctgcactacagcattttcgtcatacatgtgggcgtaagctttaaacttgccttgaacccgtttacccatgaatttaaattcaatatcaggataaactactgctaacgtcatcagacgatcgtgaatgattgattggtcaacatcagtcaatcctgtgctttcaaagtgactgaaatctggaatgaatgatactgcagtaccagtcttatctttgatgaattctttatcttttgctgggtgttcttcccaggagatattttctgagccgttagaacaacgaacgatgatttcatttttaccatcgcatgttgcaccagtaaaagatactgaaaagatgttggttaacgcagaaccgacaccgttcataccaccagttttacgctcagaatcatcaccaaagttaccacccgcacgaggacgagtccatgcggctactggtcctggaatagtttctccttcaggtgttactacaggagcctgcggaagaccacgaccgttatctgttacaataattttgttgcctttaatgtcaactgaaatcttattcgcgtgtttgaaattagtacgaatagcttcatcaacagagttatcaatgatttcatcaataagtttgataataccaggaacatactttactgattggaatttaccaaaaagaaaacggtcatgcgcttcaaacgcagaactaccaatgtacattccgctacgcttaatgatatgttctcggtcactcagaattttaatttcgttcttaatcattacatttcctcggttagtgaaggaattatatcaactattaattatagcaagtaattcttctttgatatacatcaatttaccaagaacctcatggcctcctttaaccgctttatactcgggatatcggggccgctgtcgttcaaacatagtccattgagcatcactaacgttagcgtatgcatatcgagttccgtagtactgttcaatccggtactcgttgttttcattaagtgaaatccactcttcacagacttcataatatttctgcatccaaatagtacgaccattcacgtcattaattggccaccaagcaaacctgtattttccaatagcccgctctactatttttaaatgtcgtttagcacgtctttgcgcagttgtcattccaataatcataatattctcctctggccaacaagactataataccaaaacatggtgtccatgtaaacaactaaatgacccgaaggtcatttattcataacgaattgtgctatttttgagaaaaagccctgagcacactgttccgttaacaggttttcctgttggcccaatagccgtaaagcctgtgtgctgaaaatcatcctctgagcaagaaaagaacttatatccggtgattttgatatcagtaaatcccgcgttatctaacacgcgagttgcgttatcagcgtcagtgcatccaatcatcatgaaggcaagcgctgtaattaaaatctttttcattttaatttaaccctataagttatattacctactttaataacccggatttctccgggtttcatggtaatgcgtgctttagttcccatcaataatcaccactctttaatccatcgtagtgaactgccggagcagaaaccacccgcttcatttgaccttcacacttagggttaaagcagttaacagtatagtcacgatgggaaattttacgcataatttctatcttttttccacagacttcacacttgtaatcatacgttggcattaacagcatccttccatttttgtgttttgactatgatttgctcattcagcgcacgagtaaccatcatggagatttcatcatctgatacatgagtatcatttttatgacgatttctgaaatgcagccaaagtgcatccactacacagttaataacatctgcgcactcgccttcaaattcttctttctgccgccatggacgattaatccaatcacacatttctccagtttctgaagaaagttgcagcatgacattcccaatgctacgattaggaataggataagacatttttgatgcttcaaaaataggagctaaatttaacattgatatgcactctgcagtgctgcaatagcagcgattgcttgaccacgattatgaatagaaagattcataaccaaatcggttggaattacattcgtggaagttccaacttcagtaaagtatttgaattcgctatcaaaaattacaaggtcttcaccgccgacttcatcgcattctgtgccattagcccacgtaattcctgatactctattattttggcggtcaactttagtaacagtaaaactcccgccattttcatagagttcatacacaaagtcttcattaacctcatagcgtgaagaaaattcttcttcagcttcatcattgacgaatttgtactgtacgccttctttaaaattcattacacaatctccatgtattctgggccatcaactgtgattacacgagcaaaggtacgaactgggacgatatcaccatggttcgcgaatacatacaaccaagtccagtgctcttctttaccgaaggttttctctttctgaacaacgattaagtccgggttgaacagaacatcttcaaaagcttcagcagtaatttttacggtattttcagttttcatgttattctcctcagtagttgataagataatagtaccacatccttgtggcaaagtaaacaactttttatactaaaccttgacgttgcgattctgtcggctctacatcggctttaggcagaactgcatagttgccttgaaacactacgtttactagggttttaccgtcttcttcccactcatcagtgacaagaacatttttatgcagcgacagattagtggctgaattagtagaactcaccgattgggtaataacattgtccagtgaattcacgtgtacccacttgcgcagatagctttcgttaaacatagaatcaagcaaatcacgcgattcgagagcaactacgaatttttgcagcgaatacactgctttgtcttcattttccagttgaagcaaatatgaagacattttgttagaacggttaaagattccaacaattacgccttctttaccgatatgcttaccaccaatcactttaacgttttcgcctacaatcaaatttttcatcgtgtttctctcagtttgttaatgtagagccattatataacggctctttcataaagtaaatagctatcggtgagaaatttcacatccaacatcgacgccgaacagatacccagcttcccaccctttagccatcatagccttggccaccagaaccatcgttggagagatttccgggaggatttcccggttgaaccactcttcgaagttttcatcgaactcaaactcttccattagccacgccccttaggtaaactcagtggatcggtatcttctggacttggtgcttcgcttaggcctagagcatagcgttgagcatatttaagcattagaatatctttggcacagtcatggatactatcatgcgcgataaatccgtcgagcgtaccctttggaagaggagtagttgtcaatccgcgtgtcagaagcagtgattcaatcgcggtacgaatatcacgctgattccagaacttacacggctcttctttaaatgtatcaatttcttcttcagaaatcccttgagctctctgcacatcgcgaagacaatctacaaaaatcggaaagtcaaaactctgtccacgacaccaaccaaaggaatcccatggatgaattccattatcaatcagatactgctgggcttctttaattccagcaattactgataaatcatctggcgttgaggcaaggttagcacgggcttcagctgactgcttcttccaccattcaagagtagacttaccaaacaatcggtgacctttctgagatttcaagtcaaacttaatacgatgaccacgcttgaccaattcatcgaagctttccagaacttcagggtcagaatcaaaggtgattagagcaaggtcaatcacagaagagcttgacacatttccgaatgtttcaaaatcaataataaagtctttagccattttgagcctctagcataaatttaatttcgcgtaactggcaaccaatatattcgctcagatacacctttgggtcatatcctgtgaaccaagtaatagcattagcattatctgctatatcacgaagctcattcagaactgtatcaattttaatgttaatagcacgcttaacattatccggtgcttcaaacttagattcttgtaagccaacaatcattgtttgaaggtcttctaatttcaattcaaacatattacc

SEQ ID NO: 7 - DNA, 42974 bp, synthetic construct
  misc_feature 1..42974: note = CM001_colE7
  source 1..42974: mol_type = other DNA
atgagtattcagctatcggcccctcaggcattgtttctgaattgcgataacaaatacaaagcctatgtcggcggtttcggcagcggcaagacatttgtcggctgccttgacctgcttacgtttatgctcaagcatccaggtacgcgcctgggttacttcggcccgacatacccggctatccgtgacatcttctacccgacatttgaggaagcggctaacctgctcggccttgatgtgctggttaaatctggcgacaaagaagtcgtggttactcgcggtaagacggtgctcggtacagttatctgccgttctatggataacccaggctcgatagtcggcttcaaaatcgctgctgcggtcgtggatgagcttgatgtattgagccgtgagaaagctgagctggcgtggaacaaaatagtcgcccgtatgcgtctggttatccccggcgtaactaaccacatctctgtcaccacgacaccggaagggttcaagttcgtctacgccaagttcaaagagaacccgacgccgagttactcgatggtgcaggcatccacacacgagaatgcgcggttcctgccaccggattacatcagctcgctgaccgagacttatccggcgcagttgattaacgcgtatctgaatggtgagttcgtcaaccttacctccggcagcgtgtattacgcatatgaccgccgtaagcaccgcagcaaagaggtaattcaaccgggcgacacgttgtacatcgggcaggacttcaacgttacgaagaacgcaagcgccgtgtatgtgcaacgtaaagacggctggcacgcggtggcagaactgaaaggtctgtttgatacgccggacaccgtgcgtgtaattactgagaagtggaagtcgcagggccaccgcatagtcgtttacccggacgccagcggcaagaaccgcaagaccaactcggcgtcaatctcagatattgcgttactccagcaggccggtttcgatgttcgcgctaaatccgccaaccctccggttaaagaccgtgttttagccgtgaataccgcactggaaaaaggtaagctgtgggttaatgaccacttatgccccgagatagcaaagacgctggaacagcaggcatacgacgacaacggagagccagctaaagacggcatcattgaccatatggcggatgctctcggctatcctgtagtttacgagatgccggtggttaaaccagtaatcaacatcccggtgactttcgcactttaagaggacaacaaatggtttccgcaaacattaacgcagggcaagggcagaacgttaaaacccgccaccgccagtacgaagagtatttccctaagtggcagaaggtgcgacatgcgctttctggcgacctgacatcgtatctacgtgacgtcagtaagaacgagccggacccggtttacggtcgccagcgtcaggctgaatacgaagcgggggcaatttgctacaacttcaccaagcgaacgctttcaggcatggtcggcagcgtaatgcgcaaagaccccgagatgattattccgtctcagatggaatacctgaccactaactgtgacgggtcgggcgttggcctgtggcagcacgcacaggatactctgtatgagattgatgctgttggtcgcggtggtttgctggttgacgcccccgcggtagaagtagctaccatggcagagcaaaacgagggtttactaaacccaacaatcgctttctacaccgcagagaatatcatcaactggcgtctccagcgcgtcgggtctgttaatcgtgtggttatggttgtattgcgtgaggaatacgagtacaccgatggcgcggatgagttcagccccaactacggcgagcaataccgcgtccttgatattttcgaaggccagtatcgccagcgtctgtaccgctttaaccagaaaggtgcactgatggaaggtggctatatcgaaatattcccgaaactcggtaatattccggtcggggtgattccgttcacattcattggtgcagggaataacgactcaacccctgacgatgcacctttgctgccgttggctgaacttaatatcgggcacttccgcaacagcgcggacaatgaggagtccagcttcgtcgtaggccagcctactctgttcatcgcccccggtgagaacatgagcatgggacaatggaaagaagccaaccctcacggagtgcgtatggggtcacgttccggccataacatcggttacggcggcaatgcgtttctggtccaggccggtgagaacaacctagccaagcagaacatgttggataaagagaaccaggcaatccagattggtgcacagcttattaccccgacgcagcaaatcaccgcggaatcggcacgcctgcaacgtggtgccgacacgtccgttatggcgacaattgcacgtaacgtaagcatggcgtataccgatgcgctgaagtgggttgctggtatgcttgggcttagtgacggcactgaaattgagttcaaacttaacatggagttcttcctgcaaccaatgaccgcccaggaccgcgctcagtggatggcggatattaacgcgggcctgttaccggctaccgcttactatgctgcgttgcgtaaggcgggggtaactgactggacagacgaggacattcagaacgctatcgaggatgcgccgctgccgttaggtgctgttactcaggtggcgggggagattccgcagtcggcgcagcaacaggacaccactcagccgtaagttcacatatagccccgaaaggggctttcttatagtatgctattaactttagtaccacagggtttaactatgagcttacttacatccctcatcagccatcagatatggctgcaacgcaccgcatccggtgaggtgaaagacctcgcaccgttcattcaggagatgcgggatgaaatcaaacggcaggtgctgttattcggcgacgacgggcgaagcactgcgcggctgaataaactgttacgggaccttgaagaagcactgacagggattacaggtgactggcaaacaaagctgacagaagacctcaaggaactggcggcgtatgaggctgagtggaacgtaaagacactgaccgccaacgtagctgcggaatttgttacgcctaccgctgaacaggtgtgggctgctgccgagtttcaaccgttatcgttgagcgacaagcctgttgacttcactaagctgatgtcaggttggggtgaaacggaagtagcacgtcttgtaaccggcgttaagatgggctttgtacaaggtcaaacaacacggcagattgttaagaatgtagtaggcgccggtgggcgggctgacatctctgagcgtaacgccgctaccgtcatccgcaccgcgctgtctcacgtgtccaacgaagcccgtaacgagacgtaccgccagaacgacgacatcatcgagaagtacgagtgggtgtcaacgcttgacagccgcaccagtacgatttgcagggtcagagacgggatgacgtgggaaattggtaaggggccgatgccccctgcccatccgaactgccggtcgtgcacggctccggtaatcagttccgagttcgacttcctcgataaaggcgcaaaacgcgcggctaaaggcgcggaaggtggcactcaggtaagcgtagacaccacttactacgagttccttaaacaacaaccggcgtggtttcaggaccaggcgcttggtcctgttcgcggtaagattttccgcaacagcggtatatcaccggaagagtttcgcgtaatatctgtagatggtttcgggaatccgctcacgcttaagcagatggcggaactcgataaacgtgttgctgattatctgaaaggggaataatgatgggctttttcaaagtaactgacgtaccgtctcgtcgcgtagtccagtacgcccgcgtgtctggctctggcgagaacgtggtgtttattgaagacgaaagtgtactcggaacaccagtggacgatatgccgtttgcggacaagaccggtattgcgctgccagcggcaggtatgctttacgagattccgtacctggcggatgctggtgatgtgtatttctccgtacaaccgcaggacgctgaactggcagacggcagcgcaaatatcgctgtcgaagttaaggcgggcaaagcaccatatgcgctgacctggtacaaagacgggaaggaagtggtaaacgccccggaagaggctctgtctctgacggttaacgcagttggtgaatacttcgttaaagtcactgatgccgatggtatagaggccgtaagtaaagcagcgaaggttactaagccagaataaactgaagccccgaaaggggctttttagtgcctgtgattattccagttattccactcaattgtaaatgttgtaataaactattcgaatagttgacttttcaccaaaaatgtgctaagctccacctgagcttgtgaagtatgaacaagcgaccgcggcgcgggcaggtaacggagcgggacgtaagtcctgagtgtagttacgctgacgcgttcggaagggccatactctattgcttgtgtaaaaagtaactggtttactgagattacgccgtttctatgtttaaatgataaggtctagcgccccgctttaaggcggggctttacttatcgagaaaggggaaacatgaatcttaaagcaactgtcgtagcgggagcatgtttcatcatcctggcttacgcacacggcatctaccagtatcgcagcggctggaacggaggccgggcgaatctcgtttcgcagcaacagcagaaagcacaggctgagttagctaagaaaacacaacggcagcagcaggatgaatcgaaggccgccgccgctgataacgaaggcaagacgaaatcagaggtaatcacccgtgaagtcgttaagtacattaaaacgcctggccgcagtgtgtgcacttttgaccctgagcgcgtgcagctcaagtcccgcgccgtcgcaaacgccaattccatccccggatacgacgatgatgcagccgccgtgcaaactggcactgccaagtaacgacgcggacgaggatttagctattgacgtccagaacacagaatgtgtacggcaactgagacttaaagtgttcatgttgcgggattacgtgaggaatattctggaatagttgccttgtatgttggaataatttattcttgacatgtaaatccgggtggcccggattccaacgtccaggggacatactgatgagcgaagaagtgaaagacgaaactatcgaacaacaagagactaagaccacgtttaccaaagaagaagttgacgcgctggtatccggtcttaaagctaacaacgagaaactcttgtctgaaaagaaagctgccgccgctgccgcgaaagaagccgcagatgcgaagctgaaagccgaacaggaacgcgcaaaacagaacggcgaacttgaggcattcgagaaaacgttgcgcagtcagtatgagccagtactcgccgataaagacggtaagattagcaaaatggctgagcgtatcctcggcgcggaacgtaaatcagttatcagccagttgtctggaatgttgattgatgagagcgcagcggatattatcgctatgatggtcaagaccgaatttgacggcgatgacgttgtgaccaagttcacaggtgcagacggtaatgtcatcaccaccgacgcagagcaatttaaaaagtatctgcgtgagcacaaagcattttcgcatctgattaaagcagatgcagcaaccggcggcggggcttccggtaacaaaaattctactggcggggccggtggtgcggacgtaatccagcaaaaacttaacgccaaatacggcaaacgaggataacagaatatgtctctgtcagatatgaaggtttataacgacgatatcgtcggtaccactatcgaactgcttggtcagaaaactgaccagtttaacgcagcctccggtggtgcaattgtactgtctaccgcttcatggcgcggtgacttctcccgtgagtctttctttaaccagattgcctccgctaaacgccgcgttgaccgttacgccgctatcgcgtctcaggcagctaccgcgctgactcagggcgagcatgtaggcgttaaagtcgctggcggcttcggaccggtactgttcgagcctgcgcaaatgacttggcttaacgaagacccggcaagcgcgattcgtgctatttccgaaggcttctctgacgcactgttagcggaccagctcaacaccgctgttggcgcagctgttgctgcggtatctggtcaggccgcgctggttaacgacgtatctgcaaccgctggcttgtccctgaacgtgctgaacaacagccacgctaaattcggcgaccagtctcagctgctgattaccgacatcatgactggtgctgcttatcacacgctggtagataaagcgctgactaacgcaaaccagctgttcgttgccggtaacgttatggttgtcgatgttctcggcaagcgttacgtaatctctgacattcctgcgctgtacggggccggtactccgaacaagactaaggtcctgtccgtagttgcaaacggcatcatcgttgataatgcttctgatattatcagcaacattgataccagcaacggtaacacccgcatccagaccacctggcaggcggattacagcttcggcctgaaactgaaaggctatagctgggatgtcgccaacggcggtaaatctccgctggacgcagaactgttcaccgcgaccaactgggacaaagctgttgccgagaacaagcacaccctcggtactctggcaatcgccgacgcggacaagtaaagtacgaggaggtaaatatatatgtctggtggtgacggtcgtggtcacaactctggtgctcacaacaccggtggtaacatcaacggtggtccgaccggtctgggtggtaacggtggtgcttctgacggttctggttggtcttctgaaaacaacccgtggggtggtggttctggttctggtgttcactggggtggtggttcaggtcacggtaacggtggtggtaactctaactctggtggtggttctaactcttctgttgctgctccgatggctttcggtttcccggctctggctgctccgggtgctggtaccctgggtatctctgtttctggtgaagctctgtctgctgctatcgctgacatcttcgctgctctgaaaggtccgttcaaattctctgcttggggtatcgctctgtacggtatcctgccgtctgaaatcgctaaagacgacccgaacatgatgtctaaaatcgttacctctctgccggctgaaaccgttaccaacgttcaggtttctaccctgccgctggaccaggctaccgtttctgttaccaaacgtgttaccgacgttgttaaagacacccgtcagcacatcgctgttgttgctggtgttccgatgtctgttccggttgttaacgctaaaccgacccgtaccccgggtgttttccacgcttctttcccgggtgttccgtctctgaccgtttctaccgttaaaggtctgccggtttctaccaccctgccgcgtggtatcaccgaagacaaaggtcgtaccgctgttccggctggtttcaccttcggtggtggttctcacgaagctgttatccgtttcccgaaagaatctggtcagaaaccggtttacgtttctgttaccgacgttctgaccccggctcaggttaaacagcgtcaggacgaagaaaaacgtctgcagcaggaatggaacgacgctcacccggttgaagttgctgaacgtaactacgaacaggctcgtgctgaactgaaccaggctaacaaagacgttgctcgtaaccaggaacgtcaggctaaagctgttcaggtttacaactctcgtaaatctgaactggacgctgctaacaaaaccctggctgacgctaaagctgaaatcaaacagttcgaacgtttcgctcgtgaaccgatggctgctggtcaccgtatgtggcagatggctggtctgaaagctcagcgtgctcagaccgacgttaacaacaaaaaagctgctttcgacgctgctgctaaagaaaaatctgacgctgacgttgctctgtcttctgctctggaacgtcgtaaacagaaagaaaacaaagaaaaagacgctaaagctaaactggacaaagaatctaaacgtaacaaaccgggtaaagctaccggtaaaggtaaaccggttaacaacaaatggctgaacaacgctggtaaagacctgggttctccggttccggaccgtatcgctaacaaactgcgtgacaaagaattcaaatctttcgacgacttccgtaaaaaattctgggaagaagtttctaaagacccggaactgtctaaacagttctctcgtaacaacaacgaccgtatgaaagttggtaaagctccgaaaacccgtacccaggacgtttctggtaaacgtacctctttcgaactgcaccacgaaaaaccgatctctcagaacggtggtgtttacgacatggacaacatctctgttgttaccccgaaacgtcacatcgacatccaccgtggtaaatgatacggttggagtaaaaacaaaggggctacggcccctttttactaggagaaattaaagtggaaattaaatacgtaccaatgccaattaccgttgagcagaagcgagaatataaccgtcaggggttccgtgtggtagatgctcgtttcgcgccagaaggtgccgtggtagaatcgactaaagaagagacaccacgccgccagcgccgggcgaaatcagaggaataatttatgccgctaatcgtggaagacgggtcgatagtacctaacgctgacagttacgttagtctggctgacgcccgcgcgttagcggctaattacggtcttgggttaccggcagacgataccgccgcagaggtggccctgcgcaacggcgctacttatgttgggcttgcggaacctcagatgtgcgggcgtcgcgtatccgctgaacagtctctggcgtacccacgtacaggaacaacactaaacggcttcaccgtagcggataatgttatcccgtcgcagttaatccgggcacaagtaatcgctgcgattacgtatggtgcgggtactgatgttcgggctaactcagatgggcgttccgtgcagactgagcgtgttgagggtgcggtaacagtgacctacttcaacaacggcagcagtggtgctacgaccgcgattaccgctgcggacgacgccttacgcccgttactgtgtggtggtcttaacaatggcttctcgtttaatgtgtaccggggttaaaaatggcgaagactaaatctgagatatttacccttatagggcaggagttacccgacaacacgacggggcttatcactccggccaagctgcgcggtgttcttacgcagagggctgactcacctatttacgccactcctggcgttaaagaggttgaagttctccgtgccgcgtccactgtaatacaagcaccatccgcagtgggcacagcattgcagttaactttcggtcccgcgcatggtagcgcatctgacccggtaatgattaatgcagcgggtctggttacgttcaacactgcgggcaactacaccgttcgcatcaagttacaggcggggcgcactggagcgagcgggacgtccgtcctgttatcgcgcattcttcttaacggcgcacagtacggctcgccagcagctactaaactggtaagtgctgatactacaatcccgattgaatctcgcgtcgttattaacacaaccgcaggccagacgtttgccgttcagattatgcgggatagtgccgggaccaacttcggcggcgtatatccgcaagttgctaccgtaaccgcatggggtacagcaccatccgcattactggttatttcgagactggaggccgcctgatgaataagttcacatgtggtgtagtttttggttttcttaccgcggtagtcttgcacagttacggtgttcttttgacgctgcaagaggtgctaaaatgagcgccgctttcagtaaacgtatgcaaggcgtgggtacgcgcctgctaaccaaattcggtagcacggtatctctgattcgcgctggttcaaaagtatgggatgaagttctcggtgagtacgtctggtctgcggatgaagtgttgccgttgaaggccgttccggttccggtaaacgcgggactggtaaacggtacgacgattcaggctggcgacatgattgttaaagccgattacaacgtcgttccgaagatggaagacaaggtgcaattcggcggcgagcaatggtccatcgtagctattgagaagaagatggttaacgatgacgtcgtggcgtactttattcaggtgagaaaatgagtttcgcgctcgatgtctctaagttcgtggaaaaggcgaagaagaaccctgagaaggtgatgcgtcaggtgtctatcaagctgttttccgctattataaaggcgagtccggtagacacgggccgctttcgtatgaactggatggcatctggcggtactcctgcttccgggattacggacgctacggataaatcaggaaacacagcaaccggaaacgctacgagtttcgtgctgaaagccgctgactggcatgagttcacgctgacaaataatctgccgtatgcgcaacggctggagtatggttggtcgcaacaggcgccagccggggttgtcaggactaatgtgtctcgcttccagcaactcattaacgaagaagccaacaaggtgaaatgatgggctactttgaggacttaacaaaagcgttcgatgttccgctggtagccttcggaaccgccaacggcatcaaggtcgcgcttgaaaacatcgacgcgccgacgtcaaccgatacgccatatctggcaagttacatgttactggcggataccgagcaagcagatttgttcttcacggaacaacgcgcgggtgtttatcaggtcgacattaactacgcatcggtgaaaggtagcgcgccaatcaataaaatggcagacttacttaacacggcattcaaagcaggtaagtcattttctcgtaacgacatctgcgccgaggttcaatcggttagcctggggccgctgattgtagaaaacggatgggccaaacgaccattgtcaattaactttattgcattcaccaagaggctgtgaatatggctacaactccttttaagggcgcgaataccgcgcaattctatgtggcggaagtcaccccgggcgtaacaccgactaacccggtctggtcaccgttgcgtaacactggcggtgttcctgctatcacccgcgacacgctgacctccaacgaactggacggcagccgtgaaactacatccatccgcaccggtaacaaacaggttagcggtgaatacgcgatcgagcttagctcgaaaagccaggatgactggctggctggtgctttaggctctacgtggcaatccggtgtttccctgtccagtctgtcgattaccgtcgcaccggcgggcaagacgttcacacgcgctaccggcagttttatcactgacggagttggggtaggcgacctgattgcatttaccgatttaacaggcgataacgcaaaaccatttattgttactgcagtaacggctacggttgttactggtgcgggcatccaacacaccctgaccaccgagacaaaaactagtaaggctaaaaccggcgacacgctggaaaccggtaacacgtgtaagacgttctctatccttacctggtacaaaggccagtgcggcggtactgacgcgtacacgttaaccaaaggcgtggaagtttctggttttaccatcgaacaggctgttaacgcgatggtaactggcagcttcccattcatcggtcgcagtcaggagattctcactacgccgccgaccggttccaacttctcatctgttacttttggtgatgagccgttctcttcggttgacgtttccgtgttcgatggctctacgccgttgcgttgtgatagccttaccatcaccaacgacaacagcgcgtccgcgcagttcgaactcggcaacactaacgtggcctttgtggaacgtagccgcgcggctaacaccttctccatctccggcaagctgtacgacatggctatgattcagaagtttatcaacgagcaacaggtagagattaactctattctggcgggggtaaacggggctatgtctttcagtttgaaacgtgcagaacttacggcggttacacctgagattggaggacctgagtcaatcactcagtctattgaaggccaggctactggcaaccagtaccagtcgtctattgttatccagcgtatcacctacgcataaaactaaggccccgtttggggccttagttttttttttcttacaaacctaattttaaagcaatgtctataacgttcgatttaacgtcacccggtatgatgtaggtgtcgtaatcttttacaccatcaacgccatacagataaccacggctgtccccctcaaacgtatagccgtcacgatgaaggcgaacgattcgcacgtcatgcccgacggcgacgataggggaaacttcactggcgaatcccccgtcggacactacaaaaacttcgttgccgtcgggcaatcttccggcaagatacttaccgaaataatcgtcaccgaataccggtttaatgaattgctcagaaatggcaatcatgaactgacgccgagacaacccgttaaggaaaccctctggcttttctttccgcgcccggtcgtcgtagccgtcgagaaactcgcggtaagcatcctggcctaacgcagccatagcaatattgaacatcggattcttgaaactggcgacacccttcgcaaagcccatttctaccagcgccctagcaagtgtgtctttcccgcagcccgcaggaccattaagaataattaccttagccattatttatcactcccatgtggttttaagtgtgtagagttcccgttacagtcgtattcagtaactgcgtgagtggttatgccgagttcgcggaaatgctttattaccgctggagagtcgtcgaatgcacacaagattctctccggcccaatagcacgcaacacctcttctttaattacgatgtcttttctgttgtcgtgtttgctgcgcatgattaactgataaaattcgacgcggtggcgctgcaaccacattctggtttctttttccgcgtcatcactacggcctgttaagataataacggcatagcgacgattaagggcgttacacagttcgatgttatctttaatgggtgcatcgtctttgcacgccatgttaaatggtttccacgcccaggtttcgccgtagttatctttcggcagcaggtgtaaacgatgagtaccatctgccaatgtcccgtctaaatcgaaaatcacaatatctttcatccaagcatctccggtgaaatagttaaacgtgcgacctcgccatattcggcgctataagtaattacgtttgcactgcggcccgacatccacccaccgcgggaggcatatgcatctttagccgcgagagtgcggtgttgctcaacaatcatgttacggctttctacaatcttttggtggtgcaggtgacccacgtgggcgtagctgtaaacactctcgccgaacgctttgcggaacttggcgatcataaccggttcgatagcatcgaagcgtgctttatggccgtggtgaaagaacagcgtagttttgccgtgttgcaccatcttgtaaacatccggcgacgtatcgacgaacacacgcggctcattgtcgtacagcgtactaaacatctcagctaaccaaatcattccgctttcgtcgtggttaccttgcacgataagcaagcgaacatttttatgtttaacgagagccatatcaatgacacggcggaccatacgaatcatgtagcgtacaagtttctgatagcgggtgtcagcgtcaagaacatgaccactggcaggtgtaacggcgtccagactatcgaaatgcgcaaggtcgcccagcagattaataactcctgttccggcatccggtgctttctggaacgctgcgtcgaaccagcgggagaacaggtcttccgcaatcttcatgtcccagtcgtcgccgctctcgtcagcccaggccagcataccgagatggaaatcagacacagtgtaaaggttgagtagcttgtcgtctcgtttggcgcgaacggctttaacaggtgcaactggtgtaatctccgacttcatgccttcgattacggctttcatcaattcaacctgacgttcggcatcggtgtcggtcttaacccattgcaacttggtgttgccaaactcatccaccagtgatgacgttcctttaatcttgtagccgtccggtacaaggtaactaacgtcacgcccgtggcctacacctttcttagccagcttcgctttacggatacgaataacgcggtcggagatgccgtatttacgggcgatgtcgatattcttcataccggcgttcaattcttcctgtaactgttcgtcggttattttcttcctggccatgcttattcctcgtgtttaggatttggcctatactagctcacttctctttgacattcgagttgcacgcccagattaagataaatacccacggcagcagaatccagccaagaaacaggttagccatgaatatcgctaacttcgctttatggctacgcatatgggccactaaaaacgggataaaataaactaaaacgataataattaagaagaacatagtaatacctgtcatggtgtagttcctgtttgagttaacattgttggtgtaagtgaatagtatcctattatgttggggtgtgcaagtaatgtgttagaattattttgcgcctagtgtcgcacacgaaaagcgggtggttcccgcctggcgcattaaccttaaccagtaacctcttaaccaaaggattaaataatgaaactttctgatttttattacgaagctgaggccgaaaaaggcgcgcgtatgccgatccccctgaaagatggtacggactcaggggaatggcttaatgttgtttctcctgaggcagacgttgccgttaaggccatgcgagcatttacgctggcgtaccgggcggcgttaggcagactgaaacagcttcgtgataaatgcgaagagacgaaagatttctcggaatacaacattaagatggaagacgcagcgacggaccttaaccgccagttagcacttgaactggttaacggttggagtctcgacgatgaatttaataaagagaacttgaatactcttttctcacagtataaacgactcgccgaacacgttgttgttttccataatggacagcttcgccaattgcaggaaaagtagacgcgttgctccagttcgcccgttggaacttcataacccgccacaaacggcgggaatttgacagtattgccgatgggcataaagctgcgctaattgctatgggggttatgcaagacgcgccggaagcaacgcaggacgccgggccagaatgcccccctgagctactaaccaccttcgagaagtaccgggaaatcaaatttacccgccgagtggatgacgacggcatcaagatgtacccgcgcgaacagttacgatggtcggatttagtggcgtacagcaccgtttcaggccagaatataggcatgtttgaatctgacatcatcatgagcttagacgctattttcgagggtagaaacgatggctgatgtagctagtttagttgtaaaagtatcggagcaaggcgcgaaagctacatcagaccgtcttgataacctttccaagtccgcaaaggtagccggagctgcggtagcgggcctcgcttccatcgtcgccgctaccgcgtacaaggccgcacaggaactggtagactcccaacggcaactggacaagatgtccgccagcctgaaaacactaacaggaagcacgcagggtgcaagacaggcattaagcatcctgcaagacttcgcgcgcgacaccccgtatggtcttgaacaggcggtagaaggattccgtaaacttgtggcgcttggtcttacaccgtcagaagaagcgttgcgctcctacggcaacaccgccgctgctatgggtaaagacctgaatcagatgattgaggccgttgcagacgccagtacatttgaattcgagcgccttaaagagttcggcatcaaggccaagcagaacaaaaacgatgttgaattcacgttccagggcactactacggtggttaagaagagcgctgccgatatcgagcaatacctgctcaacattggtaacgtaaacttcgcgggtgctatggcggaccaggccaacacactcaacggcgctatagccagcgccagcgattcctggtcgcagttaaaaatgacactggctaccagccttgatgttggtgcgcttgcaggacctatccggtacattgatgatttaatccaggaacttaacgcacaggtagcatccggcgaacttgccgccgagatgcgtatgtggggtgacatcgcatcagaagtaggaagcgcgatagagatgtcgttcgatgccgcttttggtttcgtcggtgacgcgataaacggattaaatgaactttgggattttagcagtaaaagtattaccgatagcggcgaacaaacggcgacaaccatcgcggaatcagccgccgatgcgctcgatttcatcgcggaagaatttaccgcgatggagcgcttctttgaagatatggttaaaggggcgcaggacgcaggccgtttagtgaaagcggccctcactccgggggaatcggtagatgtagcaaaaaacatcaacttccaacttggtatggccctggacacccagcgagatgtagcagacctgacgcgtaaaagtttccgtgagcaggtggaggcgcagcaaaatatcatcgcgcttaaacgagcggcatacgacatagacaaagaagccgctaaggaagaagggcttagtaaatttaaggtaactggtaccggtggtgaatccgaagatgatagcaccggcgtaaaagccgctaagaaagctgcggatgctttcgagcgccagaagaaagccgccgaggatttctactatcagtcgatccatcttaatgatgacgtattccagaaaatagaagccaaccaggaacagcagttatccaagctacaagagttttacggcaatcagcttcttagcgaccagcaatacgagaacgccaaaacccagattattctggaggcggacaccgcacgtcgggaagaacttgctaagcgggagaaagaacggcaggaaaagcagcagaaaggcgacgacttcattgctcagattatgggtcagaatgccactgagcttgagcttctagacatccaggaacagcagaaactggcggtagccgataagtaccgtgagcaggggcttattagtgagacgcagtatcaggccgcgcttaacgccatcaacgagcagtacgccacgaaacgtgccgacgcaacggcaaccgcctttggtaacatggcttcaaacatcgggtctgcgttgggcgaggcttctggtgcgtataaagcattcgctatcgtacaggccactatagccacgtacaccgcagctattgaggcgtacaagtcaacggcagctatccctgtagttggcccgttcctggcccctgtagccgctgccgctgccgttggtgcaggtatggcgcaggtttccgctatccggtccgcgcgtgaacagggcggacagttatccgcagggcaggcttccaccatcgcagaacgcggtaaaccagaagttattatgccggctggcgcatctcgtgttcgcacagcacagcagatgaaagaaattatggggcaaaacgggtcttcttccggcccgtctaatgttactatcgtaaacaacacgagttctcaaatcggcaacgtatccactgagcaagatgatgagggccgtttgcgaatcatcatcgaggagcaggtggctgcctctttgcagaacagcaacagcaagattagcaaggcccgcaaagccacaagaaatgcgccggggtttaaataatgaccgacttatatttcccacgtagccttaagcctattgtgtcgaaaggttactcaatgaccagacgtaacaacgtctggagtgtcgatttagccggtggcggggtgcgtcagggccgtgacacatattacgacgtgttccctgttagcgtaaccctgattacatccgcaatggggcgacaggcgtttctgtcattccttgaaaaagtagacggcggtgcgtcaagtttctggatggcgcacgacttcggcatgggtatcgaggattatcaggtaaccattacgtcaaccatcgcggaatccaccgaagacggcattaactggacgattactttcacggcaaccgctgagaaatcgccgttccaggaccttgagaaccagtgcctgattaacaatctgccggatttgtacggttgctatggtgacgggctggggtgtttccttaaagcctacggaactgcacaatcaacgtttccacgaatttgggacccgatgcaatgagccaggaatcagtagaagcagcctatcgctgtaagctggcgtctaacccggacggcgagatggactacatcacgttgcaaatcagccacccgttgctgtcaaagacctactatcttgtgcgcgggctacaggaacttacagcaacactggaaaccggcgaaacaatcacgttcgaacccaccccgatggaggcgtcgggggccgctaacaacagtgatatggaccagacgacgacgtttactctaccggatattctcaatcaactggacgatgagatggataaaatcccgatgagcaataccgagttgccgaaatttgtcttccgccgttacgtcagcaccgacctgtcttacccggctgacggcccggtcgtgtacgagttgcaggccattaaccaggagaagggagagttttctgcggacgtcggtacacctatgctgaaccaacgaagcactggtatactgatgacacctaaagagataccgttattacgcggcctgttgaccacatgaatattaacgactacacgggcataccttacgactttcgtaaacgtaattgctggcatcacgtgcgcattgtacgggcggatgctgggttagagacaccggcgttcgacgtcacaagcccaacggcaattaatgaagcgttcgacgaaggccatcgtgacacgaaggggcttacgaaaatagataagcctgaaaacttctgtgcggtgcttatggggtatcgccgtggtggtcgtatcgtgtggcacgcaggagtatacttcgacgggatggttagccattgcgagcttgcttctcgtcaggtacggcttgacaggctggcggacctcagagacacgtacacggagattgaattttggcgataatcctgcactacacgcgaaacgctgatggcgctttcgaccgtacaaaacacgtcgggatgccgatggagtttgtcgttaaccgtatcccggacggcgtgccggtgcgcgtctacctgggcgagattggcgatgatactgatgtcaccgacgacttcgacgcgcttaaagatgaagacgctgtgtaccacattattgagggtgcgggtagcggggcgctcggtgcggttagtaaggtgtttggttttatccttaagccaatcgccaagttgtttgggttgaacatgtccgcaaacgccaactacacggcgactaacaaccagacaacatcgcctaataacagtctcacagaccgctcaaacaaaccacgcccttacgagcgctcttatgacatctgcgggactgtgcagacaatccctaacgacctgatgcagacgtataaagcgttcaactccacgggtgctttgctggagtattcgtattatgacgcggggcgtgggcatctgcatattgaggctgatggcgtaacggaaggcgacaccctgataagcgacatcacaggttcttctgttgccgtatacgcgccgtatacttccccgaacaacaccgcatcgccgcaactacaaatcggcgacgtcgttgaccagaaactctatgtgacatactccaacgacgacgttgacggtattgtgctgaaagcaccaaacgacatcggagctaacccaagctccgacggcaccgccaaacgtatttcaaacaccggctacatttatgacccgtcgggtgactctgctttttctgagtttcttagcgtcggtgatgtcgcagtgttgagcaatttcgacgttgctgatgtcactaacctgaacggctcgtttgaagttttatacgtcgacgacttcgaagtaagattagcggtaaacagtgcgtctaactgggcagcgttgaccagcgggcagacgtacacgttaacagagcgttcagatacgtttatgggcccgagcaacacctatgacgtatcccttaccgactggtattacatggtgcgcggagaagttgaccgagtacttgctaacgttgccgggcagaacggcctctacaaatacgacggcggctataatcgcaccagcgtaacggtagaactccagtaccagatgattgactctcggcgcaacccattgagcgatatttacacagtacaggctacaattaccggtaatagcacggattacgtcggtacgtctatctacgggcaattgcctactgcatcgcgtttccgcgcccgtatgcgccgtataacgaattttgataaggactataacggtacagtaagcgacgagataaccttcatcaacctgtacgggcagtcgctggacacaaccccacactacggcaaccgaactaccgtgcattgcgcacgtaaacagacgccgcgtgccgccagtatcgacaacccagaactgcgcatgattgcgaccgagatgtgctacaaatatctaggtaatggggtattcgacccagtaatgacgcctaatacacaggcggtgcagtcgctaatcagactggcgcgtgacccggcggttggtaatctggagctgacaacggcaaacatggacaagttactcgccgtgcaggaagagattgaatcttattttggcagcgaattagccgggcaattctgctacacgttcgacgactacgacacgacgatgcaggacattgttcagaccatagctgaagccgtgttctgtactgcgtaccgtaaaggcgcggacattatgctgcgtttcgaccgtccggttgcagggcctgaaatggtgttcacccaccgtagtaagacgaccggtacggagaaatggacccgcacgttcaacgattctacgacctacgatagcctgtcgttctcgtacatcgacccggatacgaacgtacaggaaacgatttatatcccggaagaactcggtgcaaatacggaggaatacgaatcaaagggcgtgcgtaactaccaacaggcatactggctggcgtggcgtcgctaccaacgcaatgtgttaagtaaagttgtcgtagagttcgaagctactgaagagggtgcgctcgccacacccggcggcgtaatcagcgtggttaaaggttcacgtattgcgccacaggacggctatgttgttgccgttaatgggcttacgctgacgctgtcacagcccattacgtttacccccggcgatgaccactccatcattcttaagaaacgcgacggctcggtgcagagtatctctgttatcaaaggaagccacgaccgcgaagtgattatgctctccgcgccggaagaagcaatctacacggggaatagcgcactaaaaactgagttttcattcggcaacgaagcaaggcataatgctcagaagatagttgtttcttcaatcgaccctggcgacgaccgcacggtcaagattactggctacaactatgacgacggattctacaaatacgacggcgtcgcgccatacggcagcggtttctccgacggattcagcaatggttttaattaaagaggactctatatgtcaagcggatgcggtgacgttttaagcctggcggatttacaaaccgccaagaaacatcagattttcgaggccgaggttatcactggcaaatccggcggtgtcgccggtggtgccgatattgattacgcgacaaatcaggttactggacagacccagaagacgttacctgccgtgttgcgtgatgctggttttaaactggcagattttgatttcacgtcaggcggtacactatccgctaacgaccgaaacaccgcagttttgtggccgtcgtcctctggcggtgacggggattggtactattggttgggtgctctaccaaaaattatcccagcgtcatcctccccgcagtccaccggtggcgtggcagatggggcgtggcagcctgtcgggtcggtcatactgcggcagcaaatatctgatgtaaacggtgcaattctgtacccagatttacatgtggcgcgatggaaggacgaatacgacccgcgcgcatggggcgccgtgggcgacggcgtaactgatgatactcaatctatttttaatgtattagcagcttcccccaacaattggattatagacggcaggggtttgacttataaagtttcccaattacctgacattagtaaatttaagaatgctgcattcgtttacgagcgcgtagccgggcaaccgcttacttatgtagctgatggcttctttaacggctcactaactaaggtgacggataccccgttctacaacgcatggacgcaggataaaactttcgtctacgaccatgttatttacgccccgtttatggcgggcgaacgacatggtgttcaaaacttacatgtagcttgggttcgctctggagacgacgggcagacttggtcaatgcctgagtggttgactccaatccatgctgactataatgctagtgtttctacgaacagagttaactaccactgcatgagcatgggtacgtgcggcaaccgattatatgcagttatagaaacccgctacttatctaatatgcggatgaagaaggcagaactttggtcacgcccaatgccgtattttagacacccaaccggcggaataactattagttctggctccactactgctaccattgttatagaaaatcatggcctaaaagcaggagatgcggttaacttctctaatacatcggcaactggcgtatcgggtaatatgacggttgcgtctataattaaccgaaatacgttcactgttacgctctcaagccctgcgagttccaccataaacaatgcgggtgttacctggaacttcgcaacgcgattctgggacagcccgtgggaaattaccgaattgccgggggtagcatactccactaacgctgatttgtgtgtcacggagacacatagttttgcggttatagatgatactaactacactatcgctgtcggctatcacaacggcgatgtgtcccctcggcgtctcggcgtcttgtattttagtaacgtgtatgacaatccaggcgtattcgttcgtcgcactgtcgctcaggcatacgctgataacgcttctgagccgtgcgtgaaaagttatggaggtgtgctctaccttaccacacgcggcacattacctacttcccctggctctacactggcgatgagcaccgattcagggcaaaactggagctacttgcgatttccgaacaatgtacatcactccaatcttccgttcgctaaagtaggtgactatctctacatctttggtacagaacgtgccttcggcgagtgggaaggtggcgagcaagacagccgctatgaaggttcgtatccacggacctttatgtgcaaagttaatgtgtcgtcatggccctcatctttagatgatgttcagtggtttaatattaccgaccaaatataccagggtcatatcgttaacactgctgtcggcgtcggctcggtctgtgttaaagatggctggttgtactatatctttggtggggaagacttcttctctccctggagcatcggggataacagtgcgaagttatggtacaagcatgatgggcatccggctgacttatatagctaccggataaagattgaaggccacccgtatgtgtcacgtgatttcaaatacggagcaactcctaaccgtacactacctgtcgcaatgggtgtagatggtgtccgtcatgtagaagcacctttgacgtttgacaatgatataagcgtgtactccctgcgtgtaacggggttggaatacgatggcacacaacagtctgccgtgcgtgcacggtttgatggtgattacgggctgatttcaaaaacagtcccgactaaaactccatcgggtcaacgactgattgttagtggcggtgatggcgcatccagttccgacggtgcattgctgcaactgtacgggtcgaaccatgcaacgcctaacagggctattatgtatgcgtcaggaggcttctactcatacgacaatttccttccttacttagactcgcaagtgtctttaggttcggcaggtaataggtggactacggtgtacgcgaccaccggtacgataaacacgtctgatggtacacttaagacgaataaagaggaaattgagggacaactccttaccgcatgggaggatatacatgtaatatcttttaagtggcttgaaagcctagcaatcaagggtgacactgcaaggatacacttcggtgtgatagcccaagatgtgcgagacatcttggtcaaccatgggcttatggagaaagattctaccgattgtaaatatgctttcttgtgctacgacccaattgaagctgcgtatgatattgatgaagatggccagactgtacaagtatcccctcccggcggcagatggggggttagggcggaccagatgttcttcatagagattgcctatcagcgtaagaagatgcgcgagttcgagaagaggctggcagcactagaagataaataaaactaaggccccaaacggggccttttctctactcttcggataacttttccagtacaaacgccagttgcgcattagcggcgtctctttgctgccgtagtcgcagaacctcttcttctagttccttgatacgtttttgcaatgctggaatcggggctatgatgttcatttcttacctcttctcttcatataattaagcaattcttcctggaccgatttcttctcgtctgtacgcgcggcaacaacctcgtcaagagtgtctttagcgactatgtgataaaggaacaccgggcgctcgtggccagcctgtttctggcggaccgggcctatacgctcgacaacctgcaaatagtgctcaagattccagccttgcgaaataaacgccagatgatgcccgccgtcctgtaaattcaaaccatgcccggctgacgccgggtgcacgcataagatttcgatttcgccacggttccacgcttccatctgcttattacccttcgcacctttggcgaacgcctgcgcctgcgggaatcgcttaaggatgcgctccagttcatgcttaaactgataagccacaagtaacggtgcgccctgtaactcctcgacaatggactcgagcgcatccagtttcgtatcgtgcactttctcccagtctttcgttgcctcaccgtccggccctgacacatatacggcgccggatgcaatctgcaaacactttgacgtcttcgctgcggcgttagccgcttctacttccccgctctccagttccgcgaataacttctcctccatatcgatgtacgcctggcgtgctttcttcggcaggtctatttcaaccggtacgataatcggcgcttcgcaaccgaaccactcggcagcgtcaatcgtgagactaatgtctttcatcttctgatgaatttcattatctgcacccggtcgcgcatgatactctcgcgccatcgccgacttacctttctggacagagttaaaccatcggtcggtgaatgccgtgtatgaagaaccgaggcgctcgcctgcgtcgataaaccagttctgaccccacaagtctttgaggccgttcggtgacggcgtaccagtaaggttgatgaaacgcttaaccttaccgaatgccactttactaagcgcctttgcccgcttgctgccacctgaacggctacggaaagatttcagtttcgtgctttcatcggcaacaataaccgtaaaaggccagtcgtctttgccgtagtagtcaatcagccactcgataacttcgtagttagtgcacaccacgttagcatctgactccagcgccgcgatgcggcgtttctctgaacctgtcgcatctacgacacgcaggcacgggaatcgccatttctcttgttctgccggccatgtacctgatgcaacgcgcaacggggcgagaattaacacgcggtcgtcgtccgtaagttgcccgttgcggaacaggcggtttaaagtccacaggacgctgccagtcttcccggcgcccatgctcgcccaaatattacagcgatggtgctgcaacatgaacgaggtcatgagcttctggtattcgcgcctttgaaacttactcatttacggcccccataaacgcctttataaattcggcggctacttgcgggacgatggcattgccgtaaccgcgcaatcgtcccactctggcgggtatcccattagccagcgggaatgcgccgggttcaaccggccggaactttccatcacggcatccgagccagtcagcatctgaccagaagccgtggtgcgggttggttgactcgctttcaatccctgctctgttgagtagtccagcctgtcgaatgttctgtccctcccgtccgtgcgaatcactgtctctccactccctctgaagtcgttcgctgtcggtgtaggccagttcgtgcgcgccaaagaagagtcgttctcttttgtgcggtgcgccgacgctacaagctgggagtacagcaaacccgacggcgtagtcttctccttccaggtgagcttgtaaatcgcacatccacgattttgcaattgctgccgcaacctgctccccaaagatgactggagggcggcactcgctgatgaggtcgaggaagaccggcgcgaggtgtctcgggtcgaactgtccgagttgctttcccgccgcgctaaacggttggcaaggcgggcttcccgtccagagaggcgcatcttccggaactcccgcaagtctgagcgcgagaggccagccgccgatacccgcgaaaaaatgacactgggtgaacccgtcaaggtcttctggcttaacttcggtaatgcttctttcatctacaactccaaaaggtatgtgaccctgttttatcaactcacgcagccacgcggctgcgcctttatcccattcattgtaatagttcatttcgccaccagaactaactctttacgcccgaacgccgtaacgttaccggttacatcttcgataaccagtttaccgttcgactcgacgaacaccgtatcaacggcaacaggttgacgtgtcttaacgttgaaaatcatgtcacccggtacgatgtcacgtgctggtttgcggtcatattcgtgtttcatttctcaattccttatattgttggtgtatgactaactataatagttcgctattaggtcgtcaacctgtttaaacgaaccaacgacaaaaacattcgcaccacgtttacgcatacgctcgtgctcacgtaactggtgtgggtctggcttcgtgttttcgtctttcttaacctcgacgaacaagacgatgccgccgggtagaattaccagcaggtcgggagcgccggagcgcccctcataggaaagtttacgaacgaggccgccgatagcctcgaatcgctcttttgcgtatttctggatgcgcccctctttagtcatgggcgcagaatccaggtaatgaaagccccacctagaacggcgacaccgacaaacttaaagaacaggccgtaacagaacatcgcggctattcccgcaccgagtaacagcgcgagcatggttactatcgtccaaaatacaaacattgtcataatacgcacccctcacgtttcgtatgttcaataccgcagcgcgggcagattcgacagtcttcttcataaaaccagtaaattttcattccagcacccacagataaattgcgatgaacatgcccaatatggcaaccatcatgccgtattgaccctcgtgacagtaaacaccggcggcgaatccagccagtaccgcgataatcagtttacttggcataacgcttcatctccgcgccttctgctacaagagggaacccctcggcccactctggtaattcgcacatcaatcgttccagttctgcgacattgtattctggtaaatctggtgtctcgcagataatctcatcgtgaacatgaagcacaatcgggtagccgtttgcttcgacgttcagcagtgcattagccagcaaatcacggcacagcgcctgagtgcagttttccaccagtttaccagagtaggtgtactggaagccccactgacgggttaactggttttcgccctggtacttgatgcgcacgttggtagacaccctcccgtcttcgtctgtctctttcgacacgcttagcccaacacccggataagacataacgcggcccgacggcaacgtcatccgcaaccaccaaccggcgactttgttgccgttgttgtccgtttctacgttgcgcgaaaacttaactccccgcggccctgcggtgaactctttgcccggattgcggatagctgccatagctgcgtcttcaatatcccgccagaaagctactgtttccgggtgtgactcacgccacatacgcttgatagcgtcgcaggtacgccacactttcttatcaagaatataagatggtcggtcatcattttcacctggacgtggtggtcgcttggcttcctgaatacgcgcccactcatatccacgtgcggtagcagcccagatgtggtcagggaaagtcccgtccattgtttttgccatatcaacaaggtcaaggccgaggttcttggcgaactgtacgaatgcgccgacaccacccgcgtagccaagtccaagttcacatgccttaccaatctggcgtaagtctttacgttctttcttaatgtaatccggctccatgccgaacatcttgcctgcggttacgcagtaaatatccagcccggcacggaacgtatcaagcgcggtttcttcgccagccagccacgccaaaccgcggccttcaacgttcgagtagtcggcgacgacaaacttatgtccggcttccgggataatgcagctgcgaaccgtagatgccgttagcttggctacatcaaaacggcgatgtgctcggcccttaagtaatgctgaaatacctttatccagttcatcatcgtgatagtacccacgcgccaggttctgcggctggaagcctttaccagcaaatcgtaacgtacgtttagctccaccatactggatgcaaccgcgacggcggtcgtcagacgagcggcctaacagcagcgggttatatttcgttgacgcagtggatgccaccccgaggcgcatttctataatcgtgcgggcgtcgtccggtaaatcatcgtcagcaagcaggtcgttaagcgtagacttctgcgcgttgtggatgcgatgcgcaggcgccagttcacgcagaatcggcaggaagtccttacctgtaagcgagccgccgtatttacgtcgggcttcttcctgtaactgtgccttgtgtttctccacagcttcaattgcggcttccgccagcgcaacgtcgaccttaaacccgcggtcgttaattaactggtccagttccagtacacggtcttcgaactcggagttaccccaacgcggcaacttatggaacacttcacgcatcgcggtgatgtcgctaacggcgtacttgatgaacagcgcccactcatccgggtgcgtttcagcagtgtagcggcgaattttgtagttcttcggcgtcggtttagagaaacgctgaataagcgctttgcctcgtttgtctttcgcgttgtctgcagacacgccaagcacttcgcacaatgcgtcgagtgaacccggcagcgcgtgacgaaacgcccaaatcatcgtatcaatggtgttgcttacgggaatatcaaaaccccagcagtgcttcatgatgagtctgtcgaacattgagccgttgtgccacaccatcttaatacggctgtttggtttcaccagacggcgtaacgcgcggtgcaaatcacccggcatgtcgccgccgttggtgcaatcccatacctgtacaggctcgtcgtcaaaagcataggtacagataagcacttcggtagtctggtgttcggcataagcgtaggaaccgactttctttaaatcggctttggagaatgtttcaaagtccaggtataaatagctcatttctttttccttaaatccagtgccttcgttttgctgagtcttattttcatacaatcacggcaaatccacacatgcctgtacccggcgcggtactcatccgcgtaccacggaagtggcttcatatatcggtatacgtgcttacagaaaaacattattttcgacccttagtaaaaaggcccaatgaagggccttagttaaattgattcagttattaacggcgacgacgttcgcggcgcggtgcttcatcttcttcgtcgtcttccaggtcgttgacgcttgcagcgactttagaaccaccgaacgctttaccttcgcctacgtatttaatcgccagcaggttaaccccgagaactttatatttctggctgaaccagatttcgacgcttacgttagcgacgcagccgctgtaaacctgttcaccttcaatctgttcgccgtctacattgaagtcctgttctacctgagtctcgccttttttagaggttacaatcagtggctgtttctgtgccttcgctttgaagtagaagccttccgggaagtcttcaaacggattgtcacgctcggcaatgtctttaatcgcgcatttatccatgtgctttccttcgccgtagttggacttcatccacttctctgcggcggctgcgcctaacgcttcttcaactacagcgtaaacagtgtcgtagagcgcatcgatttgagcatggtcagacggcaagatgatagtcgcgctgtactggcctttagtgatcgagccatcatcgttttcacggtctttttcgcgttcgaatacgttaacccaagcagtgtttactttacgcagatttaatttaatacccatcttaatttctcgcttttcagtttactccgggaagctgcccggccagtgattagaactataatagctaactattcaggtgtcaaccctttattccaaatcttcttcactaacccgattccactcaggccgtttatcgtccaccgttgcaacacatggcgcacctggcttacgggtaataaacggctcaagcgctgccatctcatccgcagaaagaacttttgctgcctccgtaggggacatcaatacctcttttttgagaatgtcgccgtgtgacacttcaatcgcatcggcatctttccacgcacgattacccgggcgaccttctaccagtttgtaccctggcactttcttaccggaatgcaatgcggcggacatcgctttctcaaccttgtcgatgtgctggcgtaacagcggcaacttctcatactcaactacgagttgctccgtcgtcagttccagcacaaagtcgtcttcaagttcttccgccagtacagaattaaccgtctttgtacgcgcggcacactgttcagagaaccggcaccactggcaaccatcgaccgacggtttaaagtccgacgctttcaggttcttctttccacggaaataagcatcaagcgctaacagtgcccgtttctgtgcgaacttagcgaacagttccagaccttcgaccgagatatcccactccgacgcacaccccgcgtacggctggaagatgaccaggcgcactactgtgatgttataacgtctcttgagtcggcgataaacaccgagagcgtaaagcataagctgcttgttttctttcgcttcgacgcgatgccgtcctgttttcaggtcaccaataatgagcatgtgctcgtcggtgtttgccagttcctgtacggcaacaaggtcagcagttccgaacgtttcaacgccttcgtagcctgggtgcaacacctcagtaagattgacgcgcatttccagcttagcgtaagtcgctacgtcgataatcgctttgcagtagtcggtgtacttgcgcacctgctcaatcatgtccgccgtaatcagtaccgcgcctttcattgggctgattagcgccttaatctggcctttaccttcatccagcacgtaagcgccgacttcacgctctaatggcagagcagtgcctttgatgtactggttaaggtgcatctccgctatggtgtggcatgcagtccctgtaacggcggctttaccagacgtgttgggaatatctttctcacaggccagtgatgcactgcacgccagccactttttagcgccagacggcgacagtaaggcgtgcacatcgttattgccgccgcgttcctttaaaatcataccctgctctcccactggtcaattaaatgtcgtgtctggtgatggcaatgcatggcccacccgtacatcgactcgaagacataaaagtcaggtttggcgaaagtcgtgcgcttaatctgcgacacgtgacggcctatatctttaggccgtggtactttgcctaagtacgccatctcttccatctggtgcgagccagacggcgcacgtaacagccatagcgcctctgtgctatcccgcctgtctacggcgcggtagagttggtaaatcataattccgaccctcagttaaagcggcccgaaggccgcgggatagttattcttcttcgaaatacttgttcttgattgctgtcaggcgttccaggtattcagccaggtcttcgtctttaatcgcagcaatcttcatcttcttaccggtaaactcttccagcagttcgtcagaatcgtcgcacgcggcatcgcttgggccttcgttaatcgcatcgtcgatagcctgaatctggtcacgaagagactggtagtcgacttcttctttctcttctttctcttcttccggctctggcgttggttcctctactttagctttacgcggcttgcgtttgggcttctcttcttctgccggtttagtgtcaacgacgtcttcaccttctaccgggatttctttcgttacttctttcacaacagtaggctctattgttgcagtttcggcaacgacaacttgtttcgcactgttcgcagcaatcagttcatgtgcaactacgaaacgttccagtaatactaagaatttctctaacattatttattctcctctcgtttggtatgggctaactataatagtgaactattcacttgtcaatgggcttttctaaaataattaatatggtactattcacatatcaactgactaaggagtaattgacatgctaccatctgaactaagcatccgcgtagaacagcgccgtaaagaactcggcatctcccagcgccgtctggcgatcctcaccggcgtttcccagggcgctattaaccagcttgcgcttggggtgactcaggacgtccgcccggcgacgctgtttaaactggcggaagtgctggaagtagacgccaagtggctggcgttcggtgaaggggcttaacgcccctttctttttacctattccaaatcttcctcagtaaccactagcatttcattcggttcgtatattgtcttcggccttaatctatccactattctttcaggtatacgatatgttctcggtactacttcgccattaacatcgcagcctagcattagttcgccatctttcagcattttatcaagatgggtgttagtcacagaaaagtcaccggaacgggccactatctgctgctgggtaaaaccgcgacctgtatcatctgactgttgcaggtcttccagtgctgaaagtattgactccttccttacttcatccctgccgcggttaactttttcctttactttttgtttaccttcgttagttaacccttcttcccgctctttctcctcgtcagttttgaacggctcgaagccccacggcatcagaacaagcgccttgtgtggttccggcaggtcgaggtttacgattgtgccgtattcctctgtgctaccgaggaactccaccgcgcggtactctttcgctggcggtgcttcgcggaactgtaccgactcaagcaccattccaaccgttttctgttgggggccgtgcttaaatttcgagtggtatacgtttatctgacggtcggttgcacgttcgattgtcagttccacgtcgacacccgcatacagcgccccgctgccacgggctttctttccccccttcggtgtatggtgaacaacgcccaccgcggctttggttgcgtcgcgtacttctttcagtatggcgataactttacccatgccgattgtcgtcgacgaactgttctcgtcgaacttatcaatcgtcagggccagcgtctggttaagggtgtcgaatgcgaccataccaataggctcgccgttggcggtttcgcgcatcctgcggattagcgcgggaatttttttatcaccatgcgccgtgagtacctcacccatgtcgatgacatgcacataatctttaccttccctgccatatttagccgcgagtgcgtcaatacgtgtgcgtgtagctgcgccaccttcaccgtcgatatagaaatggtggcaacgctgggtgtctgcccccgcaaaccggtacccggcggcgctaaggtacatcacccccagcgtatagaatgatttatatgtgccggattccccgacgatgtcccagatgcaatccgatggcatgtacccttcaacgacgaaatcagcctttaccggttcaggtaactcgtcatcgtcttcaaggtcttccagtgtacaagttacaggctcctcgttctctgtgcggtgcagttcttcaatctcttcatccggtaaatcaggcagagccgcacgaatgctgttaatactgataggttgcttgtctacgttaagctcgtccggaaggccgcacatacgcagggccaaatgttgtcggcggttaagctcagtgcaagcgccgttgtttgtgtgctggcacacgaagcgcacctctttaccgtcaagcatgatgctggtggagcctttgcctgtatgcagatgttcattagggcatggcacttcataccctcggccggaagataaagcgtcaaggcccagctcggcttcgcagaaatgagctatatctgcgttaagcccgtgctcatcggcggcaagtgtcttagcctcgcgtttacgcagccccatctcttcggctttcttgatgtaccgctccgcacggataacacgcccttctgtaaccgttatcttagactctttatgtggcaggtagatgaggcggttgccgtcttccgtgcagtggtcgcgcagcgattcatctatttctaactcggcacaaatagcacgttgcaccatccacgcgtcgttagagttaaacggagtgcgagccggtacgaggacgcggaaagcgtaatcaccgtttttacacgcgtgctgatgtgacgccgttgtgtgcagaatattgaagaacggtgcgttcttgaatttgcgggtaaggtcgcggtactgagtacggttgagatggtcgaagtcaaacttaaccacactgtcttccagaatcgcgttcttacggcgaccgccaaccggcgcaatagctttctgcttaatcttggccgcgtcgtactcttccttagtccatgacgggtctacggacagacgcttcgatgtatcgcagacatactctacaaactgctccagtggcatttcacgggctaccgggtttttatcgaatgtgttacgcagcgttgcaaaaacaatattcatttctttttctccgcacgttctaaggcttcctgcatacggcgcattgcgcggttcatctttaccggtgcgaagaaatcagcgccatgtttctggcggcgtagctgtggaactattaactttgtcattgtataatccttgtgcttactttgatgatttgtactttagccccgacgttctggcgttggggtttcttttatttatcgcccgcaaaccacgcgtgcgcagaatcatagaaacgacatttacttaacacgtctactggcatcttaataatgcgtgtaggttccgacaaatgattaggcttacatatttctgcatagaatccgctgtcagtaatttctgacgcaaacttaaaccagtatttaactttaccgttttcaaagtaacaacccatacgtccaatcatttcacgttctccttaatccatgcttcaactttattacggtcaaatgtacctggtaaacggcgacccataaccttaatacaacaatcagggaatttaccactgcgcaaccagttattaattgtctgacgtgttaccccaatacgctcggctacttcattctgtgtcatgtaatgttgcatttctatatctcctgtttgtttggtgaagctgagtataggatagcgggaatgtaaaagcaaccaatccctgcaatatttaatctttacaaaaaagttattgaaagttcttgacacatgtttgtataatggttttgggacttgtatatattacggagttgacgaaccctccccgagggattcgtcaacccctcccagacagctgagatgcttgttttagggtttaaggataagtgtatctaaatctcatttaaagaagtaacccactgaaatatctactgtttcttaatgtgccgtagattcgcaaccgtaaaaatgtaacgattattgggcaggcttaaggcctaccctttagttaccaagtaataagaataaaggcacaaccttccctaaagaatcacaacggcaacgtaactaatctcttgcacaccccaacataataggatactattcacttatcgaaacgagacagaggagtgagggttatgtttaaacgtggtcagttggttaaatactccgacgataaacacggcataattgaattaaaatctgctttatttccaggaaagtacgtagttaccgtgcaaaatgtgagaggagtaaattcacaaatatacgtagcggaggagaacttaaaactcatcggcaacaattttaaatttaaagggtgaagtgatggaagaattatttgaagaactgaaacatcatgatttcgaggaaatatatttcgtagctgaacgctacgaggtgcatctggcggacggtataacggttattacatctaccagcgagcgaatgttaaatagcttacgagcaatacgaacggcatcgaatcatgatgcttgtgccgacgacgctgagggaggttgccgttaatgcgaatccgtataactgaccgcaggcttgtccgtataactgaccgcaggcttgtccgtataactgaccgcaggcttatagatttcggtatctcggtaggtgatgtttttccggcgttcagcatcaaccattatggttttatgattgagtacaaagggtcgttattgttcgtgtatcgggatgaatgtgaggttctggtatgagagaagcatttgaacggtgggctgtggtcgagggtctgccggttaacaagggttcaaagaaagagtacctgaacgttaagacgcgtctcgcgtggcgggcgtggaaagctggtgtgcaatccttgattgaaagaggtgtgaggtatgggtgagtggattaagtgtagtgagatgctgccgggtaatgggtatacggataaagagttcctggtgtatgaaacgttaaataacgcagttcagcacgactattacatagttcctgatgacgggagaaagcctttctggaatcactacgataagtacgtgacgcactggatgccgttacccgagccgccagaagtgtgatgttcaatagtttgggattttactgagtgacttacgctgctacacagcagcgtacaactttaacttagtgtcgtcaaaaggcgacactttcatcaaacgcaacaatctaagcggctattgcaggagatgcaacaatgattactaaagaacaggctgaacgactaatcacgttaatcgacacgatggttgatgctaaaaccgatttagcaacggcgacagaggaatccgctacctggtcgcttgaagaaagagaggcagaagcggaaagggagttactggcgttcatcgactctgtaacacaccaataaaatttacttgcacactaagatagaataggctactattcatttacacaaacgagaggggagacagaatatgaaagattatagcgaagtaactttaggtgagttgcaggacgagtacgaagatatgcgctacccgttcatctgcgacggggactacaacggcgtctataacggggtgagcgaagaatatgaacactaaaaacgaaatattcgagtacctgatcgaccagctacggcagcaggtaaataacagccggagcgaagacctggcgcatgaggtgcagtcacttaagaatcagttacgtgatgcgtcagaacatattaaggagttgcataaggcgttggctacagctacaggtgacataggcgcttatatagcagcagagcaatctggttgccgtaaggaagatactcagtacaacgcctggaggccgcattatggtgcacgacaacctgtgccggatgggactatggtatttatccggtatcgcaacggggtggagccgaaacacagtgtagcagcagaaaagcggtcgtggatttgggatggaacatacgcagacatagtggaatacaagattgacacacaggaatgtgaacatgactatcgtttggttctgtggtgtagcgacttacagcagtgctctaaatgcggggtgatcaaatgaccagcatattatttatctgggtactgtccgcgggccagatgcaactcacggcatcagaaacgttttattcgatggaggcgtgccagtctgcggcacgcgccgcagagaacgcacacttcctgtttcagggcgacaagcccaacgattcagaggtacgcgctatctgctcacctaagcgacttggtaaacaggagaaataatgtcgttagcaactgacatcctgaaacgaagcggccttgcgccgctgtcgccgagagctaaaacacagatatacaagcgccgccgtaatgcgctgtacccggagattcagaccagacgcaaagctatccgcgcctgtggattccagaacgggaaggccgtgaatctcggtgagttcaagacaaaggaacgcgccgctatcgctaataggctatttaattactggaaatcgctggggtacgatgatattccaacgaaaccgcagagacgacaatacatatggagacacaaataaaccgttattaggataattcctacccgtggtatcctccagttactgcatacttaatacgcacccggaggattcatcttggataaatttactgaaacagtgacggggtggcttctcgctgccgcactggtcggaggggttataggactacgacaacataagtccgttatctccggccctatcgacggcttctgctttattgcaacgggcttcaccagcgccgtatttggcgcacctcttgcggctcaatggtttggtattaccggtgagcgcgagatagctggcctcggattcatcattgccattctctggatgcctatctattcccgcctttctggcatcgtatcgggcggcgatattgcccgcccaggaggaccgcatgactgagttattctggtttgtcgtaatgctggcaatgggcgcttcgtccctgttcaacgtgtataatgaacgcgtggacgacgggctgttcgggcgtgttctctatatcctgactgctatcgtctgtgccgccggatgtattcacctgttacagggcagcatgtcgcctacgctgcctgagacattaatcacattagtcgcgctgcgccagattcgccaggcgtggctgtcatacggagggcataagcgtgtctcgaaatatttcagataatggattgcatttctgcgccgcgttcgagggattccgcggaactgcgtatcgcgctacgccgaacgagaagtacctgactattggttatggtcactacgggccagacgtaacaccaggtaagaccatcacaccaggacaaggcctcctgttactgaatcgcgatatggctaaggccgtagctgcggtcgatgcagcagcacaccattcgctgacacaggcacagttcgacgctgtgtgtgacctggtgtataacgcaggtgctggcgtgattgcgtctactacgggcacaggcaaggcactgcgttctggtgctattacgacgctgcgggctaagctggcgctgttcatcaaccagaacggcaaaccgttacttggcctgcgtcgccgtaccgcaggacgtctggcattgttcgacggtaaaccgtggcaggaggctgaggcaatcgggcgtgcggtgaaaggttgacacctaagactaatccgacgatacttaaatcacctcctgttccatccctctgctctccagttttatcccggccctgacccagccgggattttttttatctatcttccgcaatgactagttgactattactctcacaccaattatatttactccatcgacaacgagaacggagtagagaagatgaaaatcacagataccgaagcattcaaagatgcgcaactgatggcacgcatcgccgttagtaacctgagcaacagcattcctgcggacgcgttctggttcgccgcgatgcagacactgaaagcagcttatgcaggagagaagaaatgagcgaacaaggtcagataagccaaccgttacgcgtaggtcgtaaagtaagtcacactccgttcccgacacgcgaggaactgatgaaacgtaacagtttccctgggccggacaagaacaagtatctcaatcgcatgtggggagagaagaaatgactgaccgtgaatacgaaaagatgatggtagaggctgttaacggcggcgtagacatcggtcacgtgatgcacgtcctgaatactaaaatcgcagtagctgagcagatggttgagtcgctttacgggacacgccgtgaactgattaaccgcttcaacctgaacaagggtgataccaatgcctaaaatcacaatcgcatcactcgaacgccgtattatggtgctcgagtcagagaaacagacgttaggcgggcaactgtcgattaacggtgagtaccagttagccgcatttaaggttcttctcatgttgttgagaggagaagaggaaaagatgaacgcctgcgagcatgattaccgcctgcatttagttgatggggtgcatcgagccacatgcttaaaatgcggtaaagcgtatggagtcgcctaaaccagtagtaattgatggtgtcctgtggaaaccctactcggttaaccatatcgacgccgacgggaagaagtttagtttctacatttttgcaattagccgtgagcacgccgcctgtgtggtcgacgatatacgagaaacggcggggcttggtgatgagatagtggggtgattatgttcagtgacattaacgcggcaatcgaagaagcaatctggcgtcgttacaacggcgagcaacaacggcacttttgcctggtgcaacgcggtaacatggttgccgtagtgcaggaccgcgataacaaatatccgaatgcgatgtggacaacgaggaatttcttaggatgattaccagcattccaaacctgattaaagaatacggcacgatggctgagacatgccgacaaaccggcatcaacgaaatgacgattgccaagtacagcaaagacgttaactgcgagcgccatgtaatttataacaaccgtctgatgacgcacgttaagacaagcccggtgttattcacgcgcaggggtatcactaaaactgagcaacgtattgctaaagaggagagcggggaatgattagtattctggagttcatcgacaaccaagtttggtacgagccagagttaaataagtattcagttaatgggaaaatatttcggcgcaaaggccaggcggagcgttacgcagctaaactataccgtcagcttgtcaaggatggtttcttcaaatgagactactaatcatccctaacgcccgggccattcccgtagctaacgaccattacggcggcgacggtaaaagagcaccacgccacgacctatacaactgatacaagccctctaccgagggcttttctgtacatcctgcccaatcaccttatataatccctttagacgcgtagggcgcgtctgatgcgctctgatggtcagacgcatatgcaaggggattctatgaagctgaaactcaagcagccatcgccagaggtggtgcaagctgcacatgaagaagctgttagtgcaaaccgccgccgtaaacgaccgcgcggtaaacagagcctttatcaatcatcccgtaattccgccgcgttgtgggacccggactattgtgacgagttaatccggttcttcgaccgcacgtcatgggaggcaatgcctaccggggcacacggagacatgaaagccgttatcgcggataaacccccatcgctggcccgcttcgccttacacatcggcatcactatcccgattattaagctgtggctgcgcgaggttcctgcattcgctgaagcatgggaaacggcgcaggcgctggaagaggcctatttcactgagacaggagccgctggcatctctgctacgtttgctgccgctaagctgggccttagcaaagagaaaccagttgaatcgaccgaagaaacagcacctaccgagattattttcagtgttgcagagcctgtaggtaaaatcgtaacaacgaacatgggcgaggtagagga

SEQ ID NO: 8 - DNA, 151240 bp, synthetic construct
  misc_feature 1..151240: note = Efs3_ kvarM
  source 1..151240: mol_type = other DNA
agattttcaaaacccgagcttttcggaacccgcttataagggcgcacactgtttttctatcattctagcacaaacaggaagctagagggcacacaatagccctaggaagccataggaagcccttagagcgattttacatagatttatatataattatccataaataaatagaactatcctagaatgctttaaaatagcttaaaataaattgaaatatttaaaagtttatacttgcatttcatctctttacatggtatactatagatagttaaaagagagcttcattattcggacgggaaacaaaataaaaaagttgagtttaatgcttgacaaggtaaaatatacatggtaatataagagtgtggttagggttaaaccttacaggaaaacgagtacgaccacacaaacaaaaaaatttaaacaaatctattgacattaaacaataaagctgatatacttaacttgtaagataaataagaggagggaaacaaaatgacaattcaagaagttatcatatacggggcgcaatacggtactaccttaacagaggaacaagtaaaagcattctttgcagaacatcaaggaacaccaagcgcaatgcaattggctatttttgtaggggcgatggatgaaaaaggcaactttctaccaaagaaacaagcttaaacgttatttaatctaaaaaccaaggtgcaaggcaaaaaacaggaatgctattgcaccaaggtttgcgggactaggtggttaaaacttccctagggcagaacttcatagttaaaaatttaatcttgttattttaaacttttctattgacattaaacaataaacaagttataataaacatgtaaggtaaagagagggaggaaatgacatggaatacaacacactagacgaattattggacagtaaagaatttaaggacttcatggacgaactagaagacgatggattttttgaccaattcgaggacgaagaagacgggaacacactagcagacacgggacgttatccagaatagagagagaggggcttaacaatgaaagcaattataatcaaacaacttaaggacggttacaaaggcattctagcacgtaaggaaaacggttggacgaaagaggaactaatcaattttacagcgggcgtaagcaatacactatttgaccttatcaacgatttacagggcgggggctttattacagacaaggaagcggaagaaatcgaggaagtattttctaacactatcgacacactagaattttaactataataaaacagcatataaagcccgtagcgaggttttaacgggctttatatataaataccttaaggagggcttacaagtgcttacagtggaaaacaggggcgttaggtggctagtgagtaaagaagcatggcgggcgggctttgctatggaagtgctaggcttgccagattgtaaaattagtacagtattaaaagcgggctataaaattattatttaattatttaatcatatctattgacattaaacaataataatggtattctatatatgtaagataaatgaagggaattgataagaatgaaaaatctaatgaatgaaactatctatagtaatattacattaaacctaactaagaaggcgcaaggcattatatcccaatatgtagaccataacgagggctatccaagacaaaagaacagaggtcactactaccgctatacagttacatttatcaatggtgaaacgtttgaaagtaatagcagggcggacatcgctcactatatttcatctatgacagcggacgaactagaaaccatcatcaaggaagcacaagccgagcagtaagaaataggtatataccagttaaccccaccccgtggttttgtgaccgtatttaggggcggggctatcagggcaccctcgaccctcgggtacctattttttggactggaaattttttctagaaatttggaaagtcaacactaaaagtcaacaccttatctccaaccccaccccgttatttcctctaatctatttatctaataaaagaccccaccccgttgatgatgaggtctttttattgtgacgtactccatagttacattcctttattccaacctcccacatctttatgagtatcgaaaccacaatcggggcagtaacctgcttgttctgcatctgttgggtacatgctatagctataatagaaagcatacatccccatgttttcatgtgtacactctgattcctttttcttatacgggtaagggcacgcaggacaggtaaatgtgtactctcctgttgaaccaattaaacgttccccacattttgggcaaatatctgcaaccatcttagtcttcccccactataaatcttgctttagcctttaatggtgcgtagtccttttctgttagtctcacgtaagcaacacccggcactcccggagagcatacgtaagcaactacaccccagtctttaacttcacttactgtagcaaaacatcccccaaacacggcatcaaaatgcgggactatttgaacaacgtcatatacttctgtataatacttcatttattcttcctccgtatttaatgggtcttgtagatagaagtcggagattccccatttgtttacataagtgatttctccttctttactacctgtcacctgtcttaacttgtatgtgatttcttccccgtcttcacgagagttcccgtctttgtctattacgaacaatggagtcttctctgtgtctaatagttcgtaacgctcacctgttagcttgtgtatataaatcatgttatccctcctttagaacaatgcacatatagatacaatcaccatagttttcactgtcatatgtgatatagtctacttcatagtctagtaattgttctgggaaatcttttgagtgaaactccgtacgccatgactgttctgcgcaatagggttccccgtcaaagtctttaatatagattcggaaagagtcaccaactgataggatgtctctaacttgtctaagtgttaatttcaaatgtcttgcacctccggttctgtgatgtctaagacagctattacttgtacctgtcctactccttctatatataatggtgtaaacaaactagttaactcgactaggttatcatgtctaatcgtgatagcattaaacttataattacacccataaataacttcatagatgcccataaaaaccctcctgtaatttatacttaaagtatatcacttagagggttaattgtcaataccaagcaggcaaagattgttcataatcgaaagaccaaccactagagtttaaaaattctcctatctcgtttacactctttgctttcataatcttctttctagcatcgaggttttctttccttgttatactactatataaggtttctcctaaccttatgagaagttcttctttaaactttttgaaggtttctccttcgtaatagtctgcccattcccatgtaatactttgtgtgcctttaaatactttactgaaccctgatatggttatggtgtatttgattgtcattggtagttccttcatcgtcttatctcctatacccatgaaatcttcctgttttgttgtggacgaaatacctctactttacgtgtatgaatgtccctacctataatagcgtaaggactataatctattacttcatacaaacgtacagtgtaggggtgttcttcccgtataaagctactagcttctgcaatactgaaaaccttgttaacaatgcgtactgccttcattacacaccactgtacctttcttgctcttcatagatagccatgtcttcttgtagttcgacttctctgtctatacatttataacaggtttcaaaggtgtagtcgaagtcacaatctaattcactcactagtcttccacaactagcacaacgtacctcattttccattactttgcactcccaatatattgaacaaaataatttgagccttttttagctaaagtaaacatagctgtaacttctccttgttctattacttcatgagtaattaagtctactaagttaatactactcatatttgcaataaaagcctctccacaaggatgcccctctacaagtatatgtgctcctgatgctgaacgacctctgtaagagtctaggatacgaatgtgtcctttaaaatctaccttttcaattacttggtatttttcggggtagtgttcaatataagcatccccatattcaagtaaccgccaatcagttaaccctcttgctttatctggtacccaaatattgtccaatctttctaaataataggttactgccattgtttctcctccttgttaggtattactcccataggaatatatcgtttcttataacaaaaatgtcttctagcggagtattataatgcaactctacattatgattctctttcatgtaggtttttgcataatcaaataaatgctctggacacttaaaactaaatgaaccaccatctgcatctttgcaagctatatgctcttccatagtactattgacaaaccagtttacacactttggtggataacctagcataattcctagtgcataatcttttccgtgttttcctgataatttagaaaactcagctagttgttccaatttagaaacaacaagtatgccatttttgcctacagaagttgcaaaatgctcccgtacaacacgtttaagttctggtgtcccaataaagatggtatctcttagtcccaaattaaatgccacagtttcttctgctaaaataaccatgataatctctcctcttatacctaattactcttttgatagtttgcttcttctaattgtcctccactatttcgctttaaaattatatacaggtttgacaatcttttgaatatctactgtatctttgatgatttctttgatttcgtcagcattcttgtatgcttttggtgcttcgtctagtgtactttgaacaacagatgttgtatagataccagacattgtttgtttaaactcatctaagtcaagcagttcttttgctttagaacgagacaatacacgccctgctccatgaggtgcagaattattccaatcagtgtttccttttcctacaccaatgatagagccttctttcatgtttaaaggaataacaagtctaacaccctcctgtgcatctgtggcacctttacgaatagtgttggaggctacatcaatataattatgaatagagtcaaatgagtcaactacagtccaacccatattagaaacaatcttatcaatgatagttttacgattcatgtaagcataacgttgtgctagttgcatatcatttaaatagtcatccactgcggaaccttctaagtatggcaattgtggtttaacattgacagctttaaaattcttaatagcctcttgaatttctgactgtctgccttcttgcttaagtgtctcaatcatagttgctaaacctttgtcatcacgttcatggtataaatccgctttcttctggtgatattgggctactttaagtcctaaagaacgggaacctgtatgaactaataagtagtaattgttttcgtcatctttacttaattcgataaaatggtttccaccacctaaagtacctaaagacaaggtaacacgttcaataaatggttcttctgttgcacctttaaacgtcatagattctaacatgtgcttaatcgtattcggtacagtaggatgaagttcgtccaaattttctctaatgttaaacccagaaggaaccactctgttaatcactgcatccaatttagcccattcggtatctgtcgtgtcttctggcttctcaatttgagctaccataataccacaacctacatctacaccaacaatagagggtacaactcgtttaataccgtctggataatgaatcgttgtaccaactgtagagcctttaccataatgtgcatctggcataattctaacaatgccaccgtctgttaccggttcattaatcattgttgtaacctgaccgatagtgccttcatcgactgtattaataaacattttcgcatcggtatacttaccgttaagttcaattaagttattcatcagttttctcccccactaatactttcttcatcttttcatctagtctctgtataatctcttgttgttcctgagctagctttgcatggtgttcacgctgttttttatacttagcataagcaaatagttcttctgtagttagttcttctaatttacgtgtaaatggtgtagcttcaaattccattacaagtacctccttgttttttatacttaaagtatatcatgtaagataaaaagaagcaagcagtttttacactacttgctatatttttttaaacaaattcttctcttacttctccccaactttggtctgggtctggtaagctaaaaggtagcttatcctgttcttccttagataagctctgataacacttctcatgtactgcaatggttccagaactcccctgagcaacaggtaacacactaatcaattcccgcatagcttccctaaactttttatagtcttcatcttcatcgttatcgactaggacatacacgtcacattctgctttacgtgcatttgcaatgttttcctcactaggagcatcgtagaaattttttctttgcagttcaagatacttgactgctttaattagtcttttagcatagtttttagctatcgggtcaacatcaataccattttgtaaatattctactaattgatacttcgcatcccctgatgagataccgaatagagataagtaacttgtagataaaatatctccacttggaagtatcttgttagaaccaaaatggtgagaatctgccctaccaaactctgaatcacatatctcagagtggctattagggtttggagcaccgtctactgtatggtcttcacctctatagtccttatcttccatgacaccaccatactcattgtagtgccctaccgtttctccaattaactttccctgtctgacatgctttaaccgacaaagttccccaccattaaagcagtcacccacaatctgtgtattacatactggacaaatataaccaaaacaccccattagttctctcctcctttttcacttgggtctacaaacggaatatctattgcaccaaccgcttcataataaggcacaacccgatatagcgttcccggacgatgcttactagaatttttcatagcaccttctgctctaccttttgttgtatgaaccccttttacagtaatttcaccagtaactctgtgtttcatttctaatacatataatggcatcttacattccccctacaagtttgagaccttcgtttttaaaggatacttctctagctttttctatttgttctagtatacgcacagcttgtgaagcaccaccaaagccattgttaatattcacaacagaaataccagaagtgcaactagttagtgcagtatttaacgctgtgtaaccatctgctgaaataccgtaacctgttgaagttggtacagcaataataggtaaatcaattaaacctgcaagtactacaggtagtgctccctcaaagccttgtacagatactaccgcattactctttgtaatagcatctgtagaagccattagttttttcaagtcatttacaccaatatcatgaaacgacacagggacatatccatttaaaagtacggttaaataagcttcgtctacggtgtctctatcagctacacccgcagatgtaattgccacagataggtcactctctgtagggtttgcacgataaaacgctgtctgactagacttgcaatacacaaaagggcttccttctccccaattatctatccaatctggttcctctagttcctctgctttttctataatttccccccaagagagaacctgtgatgtttcaaaaggtagtgcatagaacacgtctaaaggtaattttgttaccatgatatttgtatctgcgggtacctctgcaatctgactggctagttcctgtgcagttttatttccaccaaatagtgtacgtaatttcattagttaatctcctctaaaaatttagttttgtctactggttctatcgttccatcttcctcgattccttgaactttgaatagtaagaactctggcatcgcacagacaacagcagggtcatatgctgtttccgggtcacatgccatctcaaacatgttagtgtctttgttatagaaaaaacataagtccccgattctttcatctgggtataaaaagtcagcaatgtaaaacgccatgtatttcatactagtttcctcctgttattttattgtatagtttagtaagaaatccaatctttttattgctaggttcagttaccaaccatgttattgttagtgatttaattcgtggactcaaagcattttgcagataagttacatagtcattctcttggacagatactgaataaccctttcctattaaaaatcggttaactgcctctacctcctgcttgttaatattaacgtcagagataacacaccagtattgccctagctccactgcttccttaatactaggtagtaccttatttttaataaaatctacggaattttggactaactcttcttcgatttcctgttctttttcaacagtcttattataagcctcctctgctgacatcattatgcaccaactccaatttcttcatctagctttaaggatttaatcttattactaaacatgttagcttgctcattataatgtaaagctaacaacatcttaatgttattttcaaactcagatgcttttgaatctacatatgcttcccgcactagtgaatacattgtgatgttatctttacagaatgcccaaagaggtgtatccaactcactttttagcacacgagttttaaacagatagtctggctctttactacggttctcaatctgcttttctgtaattttcaagtcttcttctcggattttcattacacgagtggtacatgtaaagtctccttcgattacttccgatggtctaacatctactcgtacaccaactaaatataaagaatcctctcttgaaatatatacaggttctatgtccacaatcttagtgaatgggcactcgtaaccattcttagcaaaccaatctgtaattaaggcttgtaactcatcttgcttatcttctggaatttcatctgttaggtagtagtcctctgcaacttctccaacttcttcatagaccatctcttgtgtacgttccaagaatgaatcaacatctacagggagataaaccggagccactcttccaactacaaaactattgattggttcttctggtagaaatcctagaatatcctctacgtgttcccagatttcttctacaaaagttttcccatttctaatggcatctacggctagtttacctgcatgaatagcctcttccttggtatcgaaataagcacaagctctccaaacttccacatctgtatcacttgcacacatccattttcctactaaagattcattactcattttttctttcctcccactttatccttatctagaccccatatatgtgcccatttacgacaaaagtgtttatcataatctaagtccataccggtagcaccttcgaagtctttaaactcttcataaaattccgattctttaaactcatcccactttttcaattcaaccatcctatacataagttggtcaaattgatagtctggtattttaattgcatctaattcataatacagataactgtgtagtagtaaagcacgctctgtcatatttataaaggacaggttatctagtatagtattatttacaacggtcacttgttactcccccggaattgaaattattacttctatatctaacacagccataatcttaaacaaggacggtaagctaattacagttaacccgttttcatatgtagaaatggctttttgtgtaatgcctgcctttgtagctaatgcacgttgagatagaccttgttcttctcgtgcactatgaatatatcctcgtaatgtatcagataaggcacgtgtatattcttctgtgtcatctttattaacacccagttcagcaactgtttcggttaagttgatttccatgttttctcccccttgcctttctatactcatagtatatcagatacctttcagtacgtcaacaactttaaataaaaaaatcctagtatttactaggattttttctcttttattgcatctgcgagcatctcactaaaacaggttcccccattatagaaggtaaacaaaaaattatacaggtctgattcaccctccacaggagtaagtaaagacacttcatcattatctaagatagtttgttcgaccgcatgataaaggtcatcccctactttaacgtagctatcataattctcttctaaaaaccactccatgtcactatcataataactaggtcgttctcccctactttgtgtaaacaagctaactgcttgatactgttctgcttctgtaagcttacgtaccttacctacacgtgtttccatttctgacattataatcgctcctgcattaattttattttgctttcaatgattcccttaacacactcccagtaccacattaggtgctgatattcattctcagagacttgtgttgttagaaatctacattgagcgggtattatttcatgctcatcgaaatacaataatatttggtttctatcgaatataactgttgttaattcccgttttgggcggtcactaatgtgcatctctaaaatggtatacaacctttgtatattatactcctcgtctaggtttatacttatcacaaataaacctcgctctttataacgattttcgcactccacaatcattgtatttactaactggttatgcttgatgtagtccttactttttacatgcacgaatactcactccttaaatatggtcttcatctttaaatgtttcataggaatagtgaacctgtgttctaacataaaagaccttattacagcttggacaagttgtttcccaaattgccccctcctccacattttctgaactatagattccagagtgatacaggtcttcctcgtctttcatagtttccttacaaaatggacaagtgggatacatttccttctcttctataatgtatcctttatacataataactccccctacttaaatgcttcgtctaaatcaagttcacgttttgcgatttcagtgatttcttcaatggcttcttggtattctcggatagttgtaatctctttaccatttcctcctaagacccaatgacgttgaatcatgtgtaaagcttttgtaaggttcgtttggtaaccgacaagcgcaacattctcgtttccttttttgtcgtaagtgatttctcctttgtcgttacgaactacacgttttacagttacgttgtctgcatcgctagtaatgcggtagtctaatactttcatgtttaacattatttgtctcttcctttcattcgttggtttcctgtacgaggtttaaatttacgtggtaaaacacgagtattgcgtttagcttcattgtatttacgtttaagccgaacctttctgtctgactgatgttcaaacatgtctgcaagagcggagcagtaatcaatctctgcacgtactttttctcccacatatctttctaaatagaatacatcaagagctactttactatagtcaatatcatatcgactaatagtaacaatgcgctcaactgtgtatctatcacaaatagagaatcgtaagtaaattattaactggtcaaatcttaagtcataatagagtggtttaagatagtccaacttaatacggttatctatttcgtataggtgttcttttgtatagtctaacagagcaataattcgattgtctgtctcattcatttctaacgtcataccttcgtcctttccggtgtgcattgatagagtctacaggtacatgtcttagctgaaagcttgacgtattagactcggataaaagccccttacctagacctgtccgctaacagcggataatattatctaggtaagggctaaggataaacacaccctatacataccgttaatgtgacacgcccggttcgttactgtcttaaaataaggtctgttggtagtactgagtagcgtttttcatccactgggtttaacccatctttgccgagaactgccactacaagtttgtcttcatcgtagcctgtaactaccaagttagcccccattagttgttcatttcttgcataaagtcctgccggtgaatagagaacccaatccccaatgttaaatacccctttaaggtacttaccacacattggacagtacttaataaatgttctagcctctgcggtcattgtcgtacgaacattcccataactgtgaaaactaaactgtgcacgcaatacattatggtctacacctataccaataccgcctgattcgtcctctaaattataaagtaattctccaccctcacaccaattacacatgttgctcctccttcgctttttggatttcactttgtaaaaaattaatgtaccttggattttctatattaaacatatcctgaacatatacggctcctagttctctacgatacgcatagtccacaccaatacgtctatagaactcatggttaacatgatacataaactgatggaatcttgtatgctgtcctcttaaatcatacagctcctgtaataggtcacagatttgtacaaattcttcctttgttccacttgccatgatttatctcctccttacctgttacctaaagtatatcaaaacccagagcatctgtcaacactctgggtaacttttttattgtacagataataaggaagctacgttaatgtaagtaatcaaacctttttctacgtcctgtacaattgggtactctgctttgtcttcatacatgatgttatctcgtacatatagcatctctgattcaacataacggaatatagcatctgaactacctgttgttgctaatcgtatccgtttcttatccgtagggtttgctatgactgcctgatttttacttagcttacataacaacttaaacattcttgtaatgttttcatcttctaaagccggagaagatgttgttttcttcttcaatcgttgttccatataaattggaattgcttgtgcagataacttcatcgtagtatcactatttaagaagtactctgtagtagttaaaacaacctttgattgttctaaaaacttaagctgtaaatagcatcgcaaatcatcttctgagaatgatttttggtattttgaatggtctgcatttatccattctacgatgctacttaagaaggttacaggtctcttaccagagtaagaaatactgatatagtcagacgtatttactacctcttttgcacaagagatttcatatatggtagccccctctaggtcgctatcttccccgataaaaatagtagttaagaagctacttggaacaaatcctacatggataaattcttgggtttctggtagatgtgactcaataaaactacctaaaagttctttccataagaactgctcgtccttgactaatgcttccttcttttgaagtttgtagaacagaaggtcaaacgcagtataccaatcttcggaaatttttagtttagttaattcttcatctactggaacatcaatagtagcagacgtgtcttcctcaacttccgtgctatctaaatcattgtcccataaatcaaatgttttacggagacaaaactctctccataatgtatcacttgggtcttctccatattgcaatagcatctgctttccaattgaagttagtgtaaccttacctcgactattgataccttcgttataatcttgaatacatcctttataccgcaaagaaagtaacatagtgttagttgctttatcttcgataagttttaatatttgtttatagccatactccatatagaaaacagggaagttcttttgctcaacaaaagcttcgtgctccacctctaacccacgtttttgtcttcctagtttatcaattatacgaagcgcctctaattctcgttcctcaatggttacaacatactggctaattttgttttcgtaagctaaagcggtgttcatctcttgcaaaatctgtttaaataaatcgtttgcatcttttgccttctgagtcttaaatgttctgattgtcgtatcatagaaacgttcgtgactcgaaatagcaaactgcccaatgtatcgcttaccttttaaatttaaacggttttcgttacgatttcctagagtaaacgttacgtagacagactcactagacttagaaaaataaatgtcttgaacaactatgccgatagtttcaagctcgtttatacgtttagtaaaatcactctcatattgtggtctgtttatatttttgcagtgttttctatagtgtactgccacagttttcgattcttttgccacatccaattacctctcttatctttcttcttttgcaacatatgcctctaatacaatggttctaataggttctatttcgtgtacttcatctctgaccttcttgattacaccttctcttagcagtccttctcctaacttatgcgaagcttctagcattcgtaagtttacaagttcatcactgtcaaatacactcacatctaaccttactctgtaaggtaatacttgttggtgtacacgggtgactgttaggggttcccctataagaggactcttcccaactcgagaaaatgcccagttatctagtttttggttaaaccgcttctttaatctgtctaacatgttttcacctccatgtatatagtatacatgttaagccttacaaaagtcaacaataaaataaaaaaacatacaactaagtatgttttttcggtacaaaatatttctcttgaatattaccgtctttatctacaacaacgccatttaactgtcctccataggcacaagcaccatcaataaagactgtacggtctcctaaataaatatcacagttattgcctctatgaaagttaactgtaggtgtatgccctacaataatagttttacttgtttcgttcttttggaatggatttggtctagtccaaagcatttcatgttcctctgctgttttccagtctggctgtctccatcttgggatacctccatgcacaaatagcacgttaccgaactcgtagtaaggttctaggagttccaaggtgtcttttacattagagttattaagaagctctgtacgcaacgctagggcgctaagagaagctgtcttagttcctagaatagaattagcagtctcttgacctccttgataataccacactgagtatatctcttgcaagtcctcataatctggttctaatcttaatgggaaactaaggaaatctaatagcatttggtcatggttccctttaattgctgtgccaccagaagccatatgttcataaacaaaacctagaacttcttttgattggagacctctgtctacataatctcctaaaagaaccaattcctgttcttcacaattccaattttttaataactccataaactcatcgtacataccatgtatatctgatactacgaaagctttctctttgctcattaatcgtcctctactttctcaaaatatcgaaagaacgcataccaatcatatcgttcagtaacctgcttactctcgtgcataaatacaaactcaacgtatttgtgtttaactgcatgagggtctactggttcccaaggaagcctgcgaggataatcataataaacttttgttggaatgacttctcgcattaacaatttagggtaccgctttttaggacggtacctctttcctaaaacatgttcgtatgtcggtctcattctattataccatgtttcgtataagttaagccggactcgttgaaatgcttttccttttcttcaatcaggtcaatacactctttaattgtgtatggtgtcccaaaagggtgtaaagttaattctggtgaatcgacacctacatttaataagttaggttcttgataagctatctcatgaatatgtccatgtaagtttactcggtttcctcggctaccaataatgagcggatagtgtgttaaatggatgatttttctttcctgctttagtattacgccaacatcactccaaaatactcgttcacgtaattcctcatcccgattaattgtttttaaaagcttggtactgtcgtggtttcctttaaccatgataatgataccgtttagcttacgaagaatctctagagtatcctttggtttctggttcatagcaaagtcccctagatggtacacagtgtcttccggacgaactcgtttgttccatgtcttgattaagtaatcgttcatttcgtccacatcagcaaacctacgtcttgtctctacaaagccatcttctccacaaatattgtgatggttgaagtgcatgtctgaaattacatatgttttcattctagcaaccctcccaattcaaagttatcgaaacactctgcattgtatacattttgaatggcattccgatagaactctacagtctctagactaactggggtgaagttgtgtacatctactcctacattaagtccgtcacgtttcaccttttgtttttcatgaatatgcccaaataagccaaaatagccatctttgattttatcttctgaataactcatatgggaaggctcgtggacaagaactagtttttggtctacaagagtgacaacttctccttttcgaacaaattcaaagtacttttcttgttccggagtaatgaatccacctttaccatcacgttcatagttaccaaataataaatgaattttacctttaagctgtttagctacttcgaagttaccgaaatctcctaaatggtaaacagtgtcttcttcatctacaacatcgttccaccgttctatcatagctaaatcagcatgttctacattatcaaaatacatacctcgcatagaatatttgaaagtacgttcttgtccaaagtgtgtgtcggacgtaaaccaaatcttactcatttacatcatctccaaacgttcataacattttttaattaccaaggcatcccacattgcattatgctttacaccctccattgtttcaccattaccaagaaggaacgcaaactcttcacgagaaatatcagggtcaacgcctttaaccttaaataacgtacagatgtcaaagggaatatagtacacgttactgggtatagagagcgcatccccaaatagatggttgaataacacccagtcgtatgaaagacagtctgaccatacttctacagaattaaactgcgatagccattcctgtagtttttgtgcaatatattctgtatccccgtagtactgattttcttcttctcgtaggttttctttccctactaaattatcaagcacatgcgcctgtaaccattcgtctacttgtgtttcatcgtaatcgtttaactctgcataaaatgatacaccattttcagctataattccaatactaattaatgtagtgtctttatgcaatcctgtaaactctgtgtcaaaaaagattttcatgtcttactcctctatgcagtttaattataattatgttgtgactattaatagaactaacaattgaagataatgaactgtttggtcaattgttaattgtgttttggggtctggtattatcgaaggaaaccatgtactttgtgctttgagatagtccattacaaaatgtggtaaccatagaacaagtaaaatgtgtgctaatgtaatagacaaaccaattaggtagcctgtcatagcaattgtaaaagtccaaatagttgcatggataaataacacatacaagtcttttgttttttctcttgcaatatattcactttgtagtgcgtaatctcctacagcatgtgcccctactaacataacaaacatagtaatatatggtgtcattatattctaccaccctcatctaatagtttctctaacggaatgaactctgttgtccgtctaagaacaacatctcctgattcctcaattgtatcaagccaacgtttactaccatcactcatacgaaacagtcttaaagggtatcccatttcatcatattgtatgatatttgttctttcgtatacgtaaggctctggcttgttttttaggaagtcgaaccaacccattcctacccctcctcagttaatttaactattatttttaccgggataatttctaagtccttgtattttctatcgtactcgttacgctcccgtaaaattcgttttaaagtatctcttctacttacagcagaatcatacatggtgtacgcttgcgcatctgagggactagaagaccacgcatataaagtcagccctgctacataatacatatacatgtcccattccatgtcgtatactcttataataaattgattgctcatttaatctacctcataaccattttccaccgcacggtaaaactttaatatattacagtattcaccaaaccagtcttggacgaaggtttcccagtttcctttgtagtaatcatcaatgacagagcggataacatattcctttgctctatcatttctggtacctcctgcattttcaataatctttgctataaagtaaggaactctctcttttttcataattagtcttccacctcttcataagtatctgcaaaaatatcaggtttacatggataaacttcaccttgaatgcctcgaataacatagtctccaacagacacgtgcatccaaccttcaagagtaagaatataaagttctccctctttaaaccggtaatttgcctttaacatccattctggcacatagtagtttccttctgacataaaatctccatcaaatttaaacgcctcaactactactggtttctttcggaactttcttccttcttcttctagttttttaacatcaacctgtactgtttctcctgcaaatctattataaacgtagtctttgcaccaacgtacattctctgcatgacttaaacaacaatcaaaatcaattttaaaatactctccattgtgtgttccctcagtacgatacttcatttcactgtttcccccttttctgcaactacaggtgtgccatctggatgcaatcttacagtcatcccaccagctctatccccatgaaaaactaagtattgcacttttgtttccgggtctgtatacaccgctatatctctagaatctgcattagtacttttaatagtatcttcatttgcaacagaagagacatcacatgcccctaaaaatagtaatggcaataacaacaacaattttttcattttatttcctcccatagttctgtaatgtcttcctagtcttcgtcattaatgacaccttcaatgtgttttaactcacgcatcagtttaagaaaagacttcgtatccagtgtaattgatgagtagttacgttcttcttgtatagtaatctctacaaccttgtcttcttcatcgaaacttcggcggtcttcttcatacgttaccttaacactactgcgagtgtcctcatcactatataatgaatagtatctatcagttcgtatttccattttaattacttccctccttttgttggtcttgttccgtttccttgtacttttgttcccctatacttaatagcacagtcagcgtgctgtagtctccaatagccattctttctttcaaaatgaccttgacctttctctacaaaggtaccgcacctgtaacaataccccggatacttattgcgcatagtagtctcccctttacacaagttctaacgaaatacttagtataccagaatatttatcttttacagcttcctctacttggttaactgcttcttccagtgaaatagttgtatttgtatcctcggaataagtcttagctaaaatccgtattgcatgaacttgggaaacctcttttagttcaacagaggtattgtcttcgtcatccacataagcttgctctttgtatatctctaaagctttgctaggactataggctgatatgagagcaaaataaggactagttacttcatagaacttaattcctgttaagttaaagaaaggtgttacgtagtccattacgcctttttgcatacgtaactcacttgaatgttctaggttgttatagtgctctttttctactacgacaacctcgactactttacctttttctacttcatttggggtacatagtctatctctagctccaagataactacacattagtgcatctttaactatcgttccggaagcagtattataccctgttttataaaacccatcttcccttactgcaacatataattttaacggctcactcatactagttttcctcctctgtaatagtatcatagaaaatcatcccaaccgactcccacgctacgcataaaacaagacttattacatagtaagtatcttttatgatactcatttttaaaactcagagtacttccgcactctgaacaatataacttcacttttttgtctgggtatccatcgttgagtatctcctgcttaaatctcttaattccttgtcgtctattcatctataacctcttttccactggcacagcaaatagccagaatcgctcatctattgctttgatttccgcttctgttagctgataagcagatttttcccaccaacataattcaaatttatcattaaaacagaaatcatttctgtcattaaatttcttgataagatataagtcaccaataataacttcatacaactgctctttcttgacctcgtagccgtttttcatactcaacacaatgttcatgcagtcaggagttgcatttaaccatttttgaaaatctgttttatcttcagggtattctactatttcccacgcttcaccaatttcaccaaataaattattgtgtaaatcatccttattttcctcaaaccactccgccacaaacttcggcacaactggcttctgcggttcgtctaactttttcattaccgcaataccggcatttataccatcgttataacaaaaggctcttatatcggttcctgacatcctatggctttctaattccttaatcgcttcttgtttattcatagctactccttctctaaattctctctcttggctaacaatcggaaattttcataaaaataacctaaagtttcgtcaccgatagccccatcatctgcatcagtgtaaaattcatctttaactccgttaactaaaagtaccccgtcatcatctattccttcaacaaaatatacctttgcttcatgtgtacctttacgaataactaaatccccaacattcacttcccatttaggtattggctctacttcatctggcaatttaattattgtaaagtgcgttttatactctgggaagttatcgtctaatggagtaccagaatatggtgcttcactaataggaaaatcccaccaaagaacatctcccatgtcttcatgccatttatctgctcgatatgctataaccctctgagagttgtcctgataatctttcacaggttcgattgataaccaagctcccataaactcttctgtattattagcaatccactttagtgctactgtttcttgtagacttccggtaaaaggttgggacttagttttataactaactagaatttccattatagtatcaaagtctgtatccgggctttctttccaataagtgagcaaatcttgcacttcttctggcaaggagtaacttattatagcctgctgtttttttaacgaacgaatagcattttgtaagtaagcttcttcgacatcccgacttttattaccatttaaaacccgctcaatctcatcaattgcatgttcaatgtgattcattattattcctcctttaaatccccaaattttctgtctaattcaacaccaaattcaaattcatcagctttcttcgataatttgcacatatcttcataatttttcttgaagttcttatgaataatcggagaacaataacctgtctctatccgtgctaatgaatacttgaccagtctagcaattttatactctaatgtttgataattaacaacaatatttaatttattttttgggttgtaccactcatgtgtatatggaggcattgtaaccctattctcaaaccctaaacctgtcaacagctttttgactgcttctgtattaacttctaatgtgtccatgtctacctccaccagttaggttctttaataacttgccacgctctttttagttgttcttcgttgaaatgtccaaaatgacaatcctctttaggaataccaagcttacgagctaacacactgtacagctctcccctacttatctgtctagacttccatacagggtcaaataaactgtgacatagttttttccatcgtttcataggtggtgtggctaaaatacctagtggttcttttggtctgttcttgtgagtccctacactagcaccacaacctgtacaataataacatttaccattaccgtaaactttcccatataatacttcattacttgtccaaataactttagctccacagtaagggcagttatctggtactaacattttatccatgatttgttcacctctcatgtatacagtatacctctatggtatcagtaagtcaacactttttttacaaaaaaagaacagcatttctgctgtcctaaaaatcacaccaatcatctttatcgtaagaatcatctgtgtagtgttctttacctttaatgttattaacattaacatgctcgtcttcctctggttgctcttctttgtttttcttaacgaagtagtaaccaatagagaaagctatacccccaagcaacagtataataagagcgataaagaatttagcaatgaagaatcccattacttgtcagtgtccacaattgcttgtccgtcaccgattgtagtagtaacccaaccgtgttccttacgagcttgtgcttcttcgtaacgaactaattcatccgtaacagattctgcaattttcttgttagcttctgcttgtgcattagctttgtctctaatagcttgggcttccgcttgggctttcaaagtaacttttgtagcctcagtttctgcttgtgttttttgagttttagcatctaactcagcttttttagcttcttgtcctgaacggataattgcatcaattgatttttgtgtttctgggtcaacgtcaggtacacctaccgttacgttttcaactaagaaacctttaccttcaactgaatcagagaaacgagctaacacttctccctcaacctcagaagacttacctgaaagaacatctaacaaactgtacttagaataaacttcacgagcagtcttttgtagacgagatttcaaccaacctttttcaatgtcctcagatgttacgttaccgaactctttgtacattttagttgcttgtttagggtctactttgtagtcatacttaatgttaactacagttttcttaccgtcagatgtagaaaccgcaacatctttagcttggatagtttgtaaacggattgggtattgtgttactttatcaatacctacccatttaacaccgggctgtaatgcttcggatttaacaccaccgttaggtgaaaaacgtacacctacataaccgttgtcgattcgttcgaagaaacggaaagcaccgattgtacctccaatcaataaaataactgcaaccactccggctacgactaggcgtttaaacgtcttctcggtcataaaaataattcctccaatatttagttttttatgtgtaagttttccccttacaaatagtagtataccttacactgtataacaagtcaacaactttttttattttcttgtggaaaataatttaatgggtgtatggtcttccccttcaagatacttaccatcttcccacaagaccactgagcctttctctaggcttctctgcacatcaatgatacgttgattccatgaaccacggaaaacaaggttagggttgaatttatcctgctcaaaacgaccatctactagtacatctacgtaagataataattcaagcttatcttcccagttttcagcgttagaatccgtaagctcttcaaaggtataacctgaccatgaccagattgttttacctgttagctctgatttaatacgtttagctaaaggcagtagaacttgtgtatttaagaaaggttctccacctaacaaagtaataccatcacaataatcttgtgaaatgtctttaaggatttggtcttctacttcttgggtatagtcttttccccaactaaagttttgtgcctttttattataacaccctaaacaattaaaagggcaaccggagacgtagatacttccacgtaccccgataccgtctaccattacaggaaacttgtaatcagcatatttacccttagacaatctttctgctgtccatgtcattgggtctttactcatctgtatttccttctttcttaacatgtaagccttcgtcataccctgattgggtaaacttagcttggcaaattgcacacttataggctttgtaccctagattattatacggaaccactttgtcttccccatcttcatcttggtgggtacacgctttttgtagcgcatttagtatttcgtttcgttgcttgattaatcgttctttctttgcaaggtgtctacactcttcatgtagaattgcagactctgcaatggctaaaagattttgtaaagaggaagctgtactcattaaattgccacctcgtaattaaatcttccgttatgtttgtagccttcaaccttaagttcagatagtgggcactcaaagaagttagtcatgttagcctcttcccaaggcaatactagcttaggttctgcgtttagaacttcctctgtcataggagcagttacttgttcgacagcttgtaccatatgacggtcgtagatatgtgcattgtcgatattccagaacattgtacccaactctaagccagataccttagacataactacatgtaacgcatgatactgcaatacgttaaatggcagtcctaagcacacatctgcactacgctgtttaacgtgtaagttcaacttaccaccctgtactgtccagtgagtagcccatacacaaggttctaatgccatttcatctaagtcttccacatcccatagagttgtcataattctacgagaacttcgattgtattttagttgatatagaatagtttctacctgattaaacttaacgtagcacttatagtcttttgtttcagggttaacatcaaccataatatcctcttcgggaaaaaagtcttccggagaagctacataaaattcattattcgtgtctagttgcactttacgttttttattgcgtaactgccaaccataagcttttccgattgtaccatcttcttgttcccattcgtcccaaatagttactccacgttcttgtaaccacttgacattgttagacattgcttgccaaatccactctaattctgtaaatgcccacttagagcctacaaacttactcttaagaattggcagtcccatgtctggtgtaatttcaaagcttacaccttcaattgcatatgcaggagcaggttccccatcttcatagtgtgctcgtacttcatcgggattttgcaaaatacccttttctttgatggctaacacaaggtcagcataaattttgtcaaaactcatgtgtgttctccttttctatgttcgtctaactatattgatagagtctgtatacccatttcttcgtacccactctgtataactgttgtgctcttcttgcgcaatcgcttttaaagaaccataccacttcttgacttcttcccgttttttacgtttgaatactaatgatttgtttttatctatgacgttgataatcttacttactccaccagtattatctataagcattaatcgtgaaacggtcggttttgagggaaacatctttttgcattccctacatagttcttctatttgcccacctaatgcacgcaaatcagatactctacgcccgcaacgtatacactcagttccataagcctgctcaaaatattgtgcattaatacgaggaaacttttgcgtaagtcttagattagttgaaggtgttttaactctttttcttagtactgttttgtttttcttaaccttaacactaactgggtcattaccatcaaaatcaaaagaaaagctaattgttccagaagggctaattgttggggtaactacattgcgttccactcggtctgctaatacccgaacatctgttatacgaggacgtgttttctttgtgaataatcgtcctcgtgtgtagtctataccttgcatattacaaacctagccatgaacgtactttgctgaaagggggtttcttttcaggttccttgtactcagagtttgtacgttttaatttatcattgtagttatctgcaagtgttaacaattcatcaggatttactgtttcacaataaaaagcaatctcttccccagttagctctctattttcttcaatcaatttatcaagagtcaaatcgcaatactcatcttcccagtcagctaagaagtacatacgttccatgacataatctgatgtttcatctaagaatataccgaatagaattgggtctttatctcgattatcttttgctacttgttgacctacttcatctgtatagtctgtaaacatgataactaagcggtcaaatttatcttgtacacgttcgattacaggaacaacttcatccggaatttcacgggggaaatctttgaggtcagctagtttaactgaacgattttccacattttcaataaagttttcaatatcttctgaatacacaaaagttgtaatgcccatatctctaatttctttttctaattggattgttctaatatgatggcgtaacaaagaaatctgtctatcttgctttgttttaattgccttttctagcatacgtaatgcgtttgcgtaataacggtctaggtcggcatcttgattttcctttttattttgttttactcgttcgaagaactctgtaggtgatagttcttctaatggtttcgttgttaagttttcagtcatgatacatcctcctaaaaaaatattccttacaggaaataatatatcacctgtaaggaataaagtcaacactatattaaaaaattgttgtaagcatttgactgtggtctaacgctaagacagcatccccagtaacacgcccatcacggtatagaatgattgtagtatcatcagttgagatgtctactttagcctcatgagaggtgatggtaaaccatacgtaatcactgtcagattcgtcttctttacgttcagcatctgaccgcatttgagctatatacatttgtgcaagattatgcccagaagggtctctattagggtctccaaacactgtagatggactaataccttcttcttgtccgtctaatgaaactgtttctaaaatactctcagcaagcatattaggggtatctgtggctcctaaaaaagcgttaggtaattcgtacacaccttcttgaactcggtgtagtaaaatagtagcacctacttctaattggttccttaatacaactaaagaaacgttaaatcctactttttcaatcatgttctttcctccatttttccatttcatttattttatcaggcaatgttcttcttgttaaacagcctgtagtacttacatgaagcctttgaactccattatttttgcctagaacttcgtctgctttcttatagagcatgtctgtatgttttggacaagctatctcattaaaagatgctccgttatctgctacacttacaatcccgtttgcacagaatcgactacgacaacctatacattcattcgctagcttcttcatgagcaacctcccactctgtggcttcccttaactgtagctgtctagcttcttctaaaggactgatataatcaggtagctcatctaccggtgtaaaacgttttgtcccgtcttcaagtataccataaaaatggtctgccggacgtgcaaaaactgtgttagcatttggtgaataagggttaggatacattcttcgatacaatactaactgctccccagtctctgtatgaagtacatcatcatattctagtgtagcataataagcacccttataatgacgaaaccacgttccggctctatgcttatattccattcctcttcccccctaaagaaaagctagcactaggctagctctttatttttacctttgattaatttaccactttcatcataccacgcatagatggcagttacaacatttgtttgatataaaacatctctaattgcaaaccagtagttaccagaaccgaaatctagtaagaaccaaaagaagttacttgcaaaccatccccaccatgaaaagtcaattcgcataatcattaagaattgagatacgattcctagcaagtaagcaataatgttaccccaatacatgatgttacccattagggaaccatctgtagtaaagccgattttatctccgtacataattaagacaattaaacctacaattgtgaatgctaaagtaaatactacccaaaaagcgttcatcttacctactttaatacgcccatcttcatcttgattggattcttttgtccactcttttaacccaataatgtgtgtaataccgtagtaaatacctgcaaaagccaaaccgaaattcccaaacatagtattaataatgatttcaccaacgttagagctaatacctaagatatttcccattttaggatagcggtctgctaaagataccacacaaggtacacctaagcagtacgctgtgatataaaataaccagttagttttatctgaccagtcggtgacaaacacccctacaaccagtcccagtactaccaaagtgattgcgtactgtttgcgccatttcccattagctagtgaaatattgtccataaatgttttcatattatttctcctccttgttagtccaaatttcgtcaacgtataattgcaacgtgtcaactgtagttccttctaggtacttttcgataattttcttgcaaagttcataacgagtttcataatcactcgcagttacttccacatatgggatatgattctccgcatataatttcttcaacaggttttggaagtcttgtctacgtttttcatcaccgattaaacgcataccatcgtctacccatttagtcgaattatctaacaaaataaccaaatcaaagcggtcattatcaatcttatcttgtacagatggatgaggttttccttcgtacgtaatacagaaggcttgtgtggctacgtagtctgtatccgaaatagtaaatctattagcattacgtcttgcaaatcgaacgtcttgatagtgaccgttagcaattgcttggtagtcactgtactgtaatgcactctcatctccacctaattcaagttcacagtagttgcgaccgtattcccaaacagtcgtagtagcaaagtagttacctagcttatctaccatcaaagttttaccactagactctcctcctgcaattacaattgtaggagccaatgcttcccggctagcacgaggtagatagtcccagtacttaatagggttgttacgtacttttgttgcactaatattaacattagaacgctcggggtctactaacgtagtaggacagccaaagtatttttggtacccttccgcatcctgtggttcacttgaaaagaatgttgcttcttcccaatcaaaacctctttcagccaacacacgattacctgttacagtctctttcacaaggtttgcccatgcttcccatccgttagggtactctggaatgtttgattcatctacgagtacaggaatgataacatctcgttgaacttgaaaagtcttttgaacaattcgtagtttgtctcgtgctgttagtggacgtttcatgttagaatccatgtataaacggtcgtctcgactatctgagtggcttaccactacaacaagagtctctacttgtgtgcttgctttttgaatcatatctacatgtcctttgtgtaagggataaaatttcccaactactactccgaactttttcataccttattcctccttttaggtattttttactataattaattataccacactttactagttattttcaatataaaaatagccataaattaaaccaattgttagtgcaatccacccgataacaattaataccgtagaaaggattcctttagacaatttggactcaacaaatttatcatatgcagtataagaaacgttaatagcactgtctttacctctgactgactgtaacccattttcactagcatccgcaagaaaagttaaatgtaacttcttaggtacgccataataggtaatacgtacatctgatgataagtacttagtagttatatacttgccatcgaacccagtaaacttgttaaagtcatatatatggtcgtgtactttaactttatcaacctgtttagtcttagagccatagtatacccattcccagtaagtttctgttttagtttgtgtattacctttctcgtctacataactaactgttctagtccgcatctcatagtgttcctcttccgcaacaactttcatatattccccaccaatacgaggaaacgttactggttttattgctatgaaatcactatgcgtataaaagataccttgttgtgtatctaacacgtaatcatacgtttctttatcatctgccggaatagcagtttcgtacatttgattagattttatccggttctcttctacttttccatgtacccatattcctagtaaactagttaaggtaacaattagcatagggataatgatgaaccggattctactatccacccgcatcatttgctaaacaggtctgtatgacctttaggctccacagggattgttaacaattcataatcttgtacttcatacccttgcagtgcaagtaacttacgatttaagaaagttctagtgaatcgtttataatctgaaatttgtcggttataagctttacgatgactagcaactcgattctctgtaatactgaactctttcattgcttgtttgtaattatcctgtgatttaagttctggatacttttcgactactgcatttaaagtcgttttagctgagtctactttaccagtttctgcttgctgtcttgctttaacaataagttctaacgtactcttttcatagttattatagctctcaatagcatctactaagttttggaacaggtctactcgtctgttttcctcagtatttaaatccccataagcttgctcaatagatacttcgtaactgatagctctattttctacatgttttactccaaaaaatgcaacaatacctaataataaaacccctactagtgaaacaataattgtattcgctttattcatgcgcttttcctcctaagaactgtttaagaatttctctccaattgacatattctgttgtatgccctttgtcatcaatgtaaacatctgcaccaagcttacggctgttatttccatatgctttcatcaaatctggatgattctcattgatgtagtgatagttaataccacattctgccaaaaaactttttgcttgttctaactcttcgccttcacgacatgtccatataagaatttgttttcctgacttgtataggcggttaattacttcttttgcatgtggttgtagccctacaatatttggaaattcacttcttacaatagtgtcatcaaagtcgatagctatgtatttgcactttgataaatctttcatttgcttctcctttcaaataaaaaaggtatacccttctttgctacaagaagaagtataccttatgagtatcaccaagtcaacactatcttacaaattatttgtaagaattttttatttctttaatttttcccatttgtacacccgtaaaactaatacctgtagacgtttctacgtaaggtaatgaggttacggacttactaactaaataatctctagcggatggttcattatcaatattatgctctgtaaactcgattccttcacctttaagcatattttttacaaatgagcaaccaccgcacccattcttagaataaactgttactttaaccatgtgttatttcctcctgtttaaaccattttgaacctgtaaatgctacaacatcgttagctaaataaagcatgtaagttaacattaatacatacacagcgtgaccatgaagagctgtttgaatccatagtgctactgacattaaaccttggaatgtccagaagtaatactgtgcacggaaccctttaacacacaatactgctccaactaaaccaatcattgcacttgtagcatctaagaatgcttgtggagaatgcaaaataactgtatccaacagatacaatgcaacccaaaatacaacaacaagtaccaatgttttaagcatatgtgctcgattcatcttacgaggtttcaaaccttcattccaacgtttagagaagatgattggaatatccaataaaataatatatgctgattgcatgatgatgtcactgtagttccctgttacacttgctactccaataagtagaattgcggaaataaacccaagtaaaccattaattgatttacccattgtaattgttacggtacaagtaaaaccaattattcctgcaatagtggcagttaaacctgttacagtaataccttgtccttgtaataagggtagaataagtcccgtaaacacttgaataaccattcccacaatccataaaattcttgcaggtttagaccatccagttagtccgtctctataatattcatatgtgaataattttttaatatgttccatcttgctgttctttttagcttccattaatttgttactcctccaatgtgtattaaatatctttacgctctatatcccagaaatgtgctacaacatgataaggtacatcaattccagatgactttgcatgattatagaacttcataactgcttgttgattgctttcttcttggtataattctttgtatgcgttaacggcttgtccctcagatatacagcctaattcaaataatttatctataatttgacttacgatttgctgtctatgttctgggttgttaacaaaatcaatctctgtaacatcgagaataatttttgggaaacctaagtctctttccatccaattttgatagttctcatgatgacgtttgaagtactcgtataattcggtaccttcttctactttttcaaattcacgagcacgagcattgattcgtctgatttcttcttcaaaagaacagtttaaaacaaccattaaatctggtgttttcttaggaagtggttctaactccttaagcattctctctagtaaacgatggtagacaccttgttccatttcgttcacatgtccttcttgtactaattggtctaagaagatactatcttcaaatatagaccggtctaaaataccgttatccacactcattgcttcttgaatcatttcaaagcgtttggataacatatctatttgaaaaagtagtccgtattttgatttgtcttggtaaaacaattcaagcattggattctcttctacaggttcataaactgcttttgtatctaataggtttgctaatatttctgtcattgatgatttacctacaccaataactccggctaacgtaattatcataaccaactcctcgggatatttattttttgacaatattaagagcctgactagcaggctctaataaaccttacatatgttttacacgtgcatctatttctttcttacgtccatgtgcattaggacgagcttgtggttgacctaaataaccacattgtcttttaacaacatcacatgttgcagggtcattattaccacattgcgggcattcataaccatctgatgtagggttaaactctccatcaaaaccgcattcatgacatttatcaattggggtgtttgttccaagataaccaactttatcgtagctgtagtcccaaacagcttctaacgccttaaggttgtgaactagtttagggtattctacataatggataaaaccaccggaagcatattttggaaactctttttcaaaatcaatcttttcaaaaggtgttggagctttgcgaacatcatagtggaagctatttgtatagtattctttatctgtgatattctcaataactccgtatttttctgtatccatgcgacagaatctatcagttaaactttcacttggtgttgagtagatagagaaccagattcccgtctcttttgtccattcatcctttttatcataaagcttacgtagaacatctaaagcaaactcttttgcctcttcatgatgtgggtctgttttatcttgccaatcaccaccatagaacatgctagcaacctcgtacagcccaatatagcccatagaaaccgttgcacggttatttatgaacaattgttttacatcgtcatcatcggttaaattagccccaaaagcaccatgtttgtacaagataggagcattctttggttgagcttcgtaagtacgttcgattcgataaaccaaagcatcatgtaataccttagctcgttcttcaaaaatttcccagaagacttctttatccccttctgattcaatagcaatacgtggtaagttaagagttactactcctaaattcatacgaccagagtttacttcgtttccatgttcatctttccatccttgtaagaatgaacgacaacccataggacatttaaatgaacctgttagctcaacaattttgtcataattcaaaatatcagggtacatacgtttagctgaacattctaatgctaactgttttacttcatagttagggtcttctggtttacggttaactccgtctttaatagtgaacaataatttagggaagattgctgtacgtccttctgtacctagaccttggatacgtactttaaaaatagctttttgaatttctctttcccaacgtccagtacctaaaccaaaaccaatagacgtgaaaggagtctgaccattcgatgtaaataacgtattaatttcatactctaggctttgcattgcatcgtaaatatctttgtttgttttctcgattgcatatgtttctggctcaggaatacgataacgtttagcatctgtcatatgtttttgataattcatttcagcataaggtgctaatacttcatcaatgcggtcaaacgaacaaccaccatattgactggaagccacattcgcaataatttgtgctgtttgtgctgtagctgtttgaatggaatgaggtgaaccgatttctgcattacccattttaaacccgttcttcaacatatattcaaagtcaatcaaacaacaattagtcattggacggtaaggttggtagtctaaatcgtgataatgaatatctccacgtaaatgtgcgttagctacatgaggagggagcattttaagaccctcaactttattaactgtacctgctgtaaggtctcgttctgttgcaaaggtatttgagtccttatttgcattctcattgacaatagttttgtccttttcttgtagcttacgtaatcttacattaatgtctgtatcacctgcacgttcagcatcacgtaaagaacgaaactcaatatagtttctagctacgtttttagcaaaagatttcattaattcctgctctacaatactttggagttttgcaatatcgacacgtcctgtatcgctgtaatgcttcactacaaagcgtttaacacgttcagctataatctcccctaaatctgttttagcgcccgtagcatccttctcagctcgtcctacggcacgtacaatccttccttcattaaacttgacagttcttccgtctcgtttaactacaaaaatctgctttgtcttaacatctacatcttgtgttgcttgcactcaaaattccgcctttcttacaatatctagtatacttagtatagcataacaatacttacagtacaagatgtaattgttaacaaaaaataaaagactacaaactaagttgtagcctttttcaacaaatattacaaattgattaattttttctcagattagctcacctaagaaatcttcaccatcatctggtttcttgtgcttatactcatccgttttgagcattaggtacttgttacctgtttctacttgtaacctctcaaaagctctacggtactcctcagcactagatgtagcatctagtaggaacttagcattaaggatggctaaaacagctagtagctcttctcgactaccggacatctgtaccttaactttaccatcctcagtcgtataagctccgattttattcttgattgccacagttacacctcttaatcttttaatttaattttaggcatagcttcaagaagtttattattgaactttccagaaataacagcttccccaagttcatttgttaccacggaaatccagtaaggagacttcggtttcaaacgattgttattaacatctaggaatgctctaaacaatcgagggaaagaggttactcctactaatttactagcaaggtcatgcgcaataactttcttagtgaaacgctctgcattgaatgagtctagcgtatacaacaagaaataaactccctgcaactgtgtgtttgacctaaaatctgttgaatcaataaacttttgatacgactgagcaaacttgacatattctttatagttacggaaacggaacgcaccatcacgtacaacatctgtttttcttcctgctgtactactataacctaacgcagtagaaatagtagaggacacccgtaatgccggatacgtagacatcaagttcaacagttgtttataactttggtatcctgattcggcatacttatggatgtagtcttcgaccttccatgatttacttgtactattcaattctgcaacatcaatgtcactgtcatcgaacgtataagtaatgggtaacccaagttcacgagctacagctaaacggtgttgtccgtcaataacttccatctttcgatttactttaatttcagtaagtactccacgtttcgcaattgagtcccgtaaagctttagaaattttaactggtctgtttccttttagttgtttgaatttagacaggtctgctgtttcatagacctgttttactgctttatcttgcttcttttctttagacacctgtcatctctcccttaattattttttgtattgaatgctttgacttacctcagtgattttcttaacctttttaaatacattaggataacatttttccaaggtatttcggtctacaccaatgcgttcataggcgctaataagtttgaatgttccgtattgagattcaacttttgttttcttaagttgaatcatttgttcaagaatttcttttctaagttcgtctctttgctcgtttaaagaatcaagcaactcctgaacacgtttgtattccttaaagttgcgctctaattctttttcttttacttctgtagttgttagtctcatgaccatctctccctttctttactatactcaaagtatatcattacatattataaaagtcaacacctatcttacaaaaaattgccaaaaaatatttggcaatcagtttttgtcatcaggttctaatagcttgtccgcaggcatatcaaaaatccgagctaatttagcttgattatttgctctgggttttttgattccatgctcccaataggatacggttgaccaatgtacacctagttttttagctacagaacgcaaggattcatgcttttcttcacgaacacgtttcagcaccaagggttttggcttgctttccacgattctcccctccattctatatataactacagccctaggaaaacctagggcaagtagattatttaagtgcttcttttacaaagtcgtattctggtttatttaacacagacaacatcatttcttctggggaagtaatttctccacctaacacttgtgttaagatgtttgtggagaacccagatactaaagctgttcctttttcgtcaaaacgtacaggtgtattatcatgacgagagtttacattccagaatactacagatggtagctcgtaacctgcctgttcgaacttaagttttgcttgttcatagttagtgtaacctgccacaccttggtcaaattccatatcggaaataataacgatttttgaaggtaactcattttgtggtgtgtggtttttcaccgcagtagataaaatcaagtcgaatactttttgtaaatttgtatttctagcattgtatgaacatttatcgtaagctttcatcttatccataagtgtacctgacaatggtaagtttactaaacgaggttgttcagaaaatacgatgaaatgacctttgaatgcaccacttaagcgttcagcagtgtagatagctaaaccttctgcaacttcccaaggggtaacattttctgtaccaccccatgtcatagaaccagaagtatccgcaactacaattgcattatcttcaatatctttcaacacatcgtccatagatttccatgttgcttctagtgaacggtctaatgttctgtagtaacttctgctaccataagcccgaattacttcatgaggtaacatgttctttgcgttcattgttacttccccagattctactttagaaagtaaatcttcatattcgtctggcatgtgtaattgcaaagctttacggtatttgaacaatgctttagaggatacttggttcaaatcaatcttatggtattccttgcttgctaaccgaacttcaattacatttaaataatcacgtaatttagcaatcattttacgataacgagttagacctgctttaccttcaaaacctaaatagttagcaatacgagcaccttgattacgtttcttgctatttggagaacttacattagctaaccatttacctagtaatgatacaggcttaccttctgacatgtttttaatatcagatgttagttggttcccgatgatacgtgcaccttctgtatccacaaagtgaatactacgcttgtgtgcgtactccatagtttcaaataagtctgtccaacgaccaacatatgccatgtactccattaaagtaacgattacttgcttgttttggttgcgaccatccactaagtacttgattgcttctaggtaagcggaacgttcacccaatccacctaaacggatattacgtaagtgtaccaaattgcgtaatgctaactctgggttttcatcgtaagctttagcaaacatgtttcgtacatctcctaaacgaccacgcatagcccctgcttgtgcaaagaagtctaagttagcgtttaaagttgatgtataagttttagctccattttctgtagagccaacagttgtttcttcttttaggttgtctaaaaatgacatctgacatctctcctttgtatggtaatgttttatctaacaccactataacatgtaatattatgtaagtcaacactttttgtaaataaaaaactcatccgattaagaatgagtttgtatgtaatatcaagaaccacaggcttaattaaattcaatagttttaatttgttagttgattgctgtagggttctttatgctctggcaacctaagaggttagagctatggcaaaataccaaaacctttttaatatgtaacaagaatctattttatacgttgctctaccaactgagctacaggaggaatcatcctcccggcaggactcgaacctgcgacccacggctccataggcaataaaaattgctgttagattctttatgttccggcacccattaaggatggaactatagctatgctaaaaccgttttatttatgtaacaagaacgcattaactttaagctttaccaattaagctataccaccaatggtggcagttggattcgaaccaacaactcacatttttcagatgtattagttttaaaagtttgctgtggcgttctttatgttccggctacctgttaggttggaactatgacatatgtcaaaacctttttatcttgtctttataatagcataaactattcaaactgtcaactattaatttaaatatattgaaacttatttaaaagctccaatatatttaacagtacccttgcatttacgtgcaaaagcttctagctctttacgagcacctaaacggtctggttgagaagactgtactgtaacttcttttggtacagtaatttcacgagttttcttaactgtctttccgttttttaacttttgttcgtactcttctgtacgagtagaagttgttgaaataattccgtaaaatttagacatgttatgtgacctccggtcattttattttaatggggagtgatggagttgcaccacccgagctttcgcaactgatttacagtcagccccgctactacttacggtataactccccgcataagtatgtatatatcaatacaatgtacaagaacttttagtgaggtagctctcatagtgtattaatggggtacattgtgtaacttcaactagtattgcctcacacgtgactagtcttatatacacaatgcctacatacaacccgatagaccacccttggtacgcatattaagaggcgcagggtgatacgaatatatggattgcaggattcgaacccgcaccctttggttggaagccgaagatactacccttatactaaatccacataatgttaataggcgggtacccgacagcgaagtatcattcctgtcttgtcattctcctattaactccataataccttgcctagagttgagctaggactcacaattaccgaaggtactaatcgggaaagcaggactcgaacctacgaccccacgctcccaaaacgtgtgcgctaccaactgcgctatttcccgttaacttatacatatattataacacaaacttacatgatgtcaacaactatttgtaagtttttttaatttatccattcgggacagtgtgctttaaccattcagccacccgcaggggtaacccgcaggacgggattcgaacccgtataccactgtcctattggataggcttgtgtacctgtcatcttccgattacacacacctagtctagttaccgtaccaatagatttgacaggaatctagggtaacgcccaatatggtgttaattcacctcgtattctgttacaggtttgcaaccctgaacaaggatgaccaatcctaatggagcatagcggactcgaaccgctgaccccctgcgtgcaaagcaggtgctctcccaactgagctaatgccccgtataaaacatctccgctgagattcgaactcagaatgcgggattagaaatcctgtggtttatccaattagcctacggagatatgattgtttacagataaggtactcctgtaaacaattcaattgcttcaatttcagtatgaaagttttcccattctaaacattcatagaaatcttttaagatatgcttgtctttcctgtaaacagtctcacctttatgggctttctcacagatttctctaacagcatccacattatacttaccaccagttttatactgctctaaaccagaatctaataaaactcgttgtacttcttcacttttatctcctgctttccaagaatcaaaagctttttcaaacagtgtgtcctccatgttttcaccttctacttccatgattgattgaataaatcttttccacttagaaggctccttgtgtttacctttacgaaaactcatgattagcctccattatctttaatgaaccgaggaggagggactcgaacccccaaacgcttttacacgtctatgacttttcaagagtcaattttttccagttatgatactccccgaaaaagaaattgattgactagtactgttagttgactagccaaccggaactacttaaaccgaactctttaaacagctttagtagtttatatttcaaatggaaggcatgggattcgaacccacacatgctgttatacatctacttggtttccaaccaagcctctttaccgtttgagtaaccttccgtcttgggagcaggcgggtttgtgtcaagtacacaatacctaatcttttgtgcatgttgttccctaggcttcatgcacaccctactatctgcatactaacagacctgccaattttctaacactttttctaatgcttcgtatggacacattactgtcttaccgtgaacatcatgtattctcaaaataatataatgctcatttatctcggaggtaacaaagtatatcttgtccttcactaaacctaaacttccgtttaaaccaatgaattttaaatacatcatgttacctcctaactatgtataacccatgaagcatcatggggggactgtagtatgcccaacctgcggggatgctccgctctgaatccgtagaaatcagccacaattatgtcactggtaaggatttgcaccttacatgcacgcttccattagttagtcggcaccttcgagatagggacatacagcttcaattttctaatggatttataggaatctagccttacagttgtttacccgacttgttctagactagcctgaatcttcccctgtgctatactgtgttaattagcgtttacctattccgccacagtgactatggagctgacgggactcgaacccgtgtcctaacgtagaaccatacaaaattctacgggcgtagttactagttttaatctacgttaaggttacaactaataactgaaattaccttaactgagtggtaaagcctctcctgagttatccacttttacctcagcgttgtcggttgatgagtcctctaggtagaaccgaccctagtctagaggggtaagtgtgtagctagtctaaaactaggctacagctaataattcttcgtttttagcagttatatttactgcgatgattaagtcatcactctgcccgctattcatatactccttacgccagtcgaaaccaaaacagccccaacataagaatttcttttgactaaccctacccttccggcagggtctaatcaaaagtatacaattaaaaaaatgaaaatgagttacggaaaatgtaacgtctccaccaccggactataagggtaagttgttccggtctttaacctaagtactttacttaaatctaacaggacagtcttcattacgtaaactacttaaccatgtaaaacgtaaaggtcaatttccgttgacctaatacaagaggagggattcgaaccctcacgcccatcacaggcatggcattctaagtgccacatgtctaccaattccaacactctcgcataataacagtcctacccacctactgttctgctagcatatagcttgcaggctttttatctgtgttataaaaaccagaaaggttatacaggtaacaggagtcgaacctgcatgtcacaagggacaatggattttaagtccacagcgtataccaattccgccatacccgcataatcactttttatgaaacaaggagaagtgtaaccttgggttattccgacatttgcagaactcgtaaccaacgagcgcatctaccctcagaaaggattttgtccctgccgacttcactgctttgtcaatgttagcctgcttgctaagatagatgtcttccttacaagaattactatacagcatcttgtaaggaaagtcaacacttacatataaatttatttaaaaaagttttgatgaatctaattgagagaaactttcgggtagagaacctagttcttccatgtactcttggtcaatctcgtaaacagttaactccgttacttcattttcaatagtaagtttcattgcttctgctgtttgtatactgtgtccttctacttgaagcttatcatcaagataaatgccttcccagtctcctgcaactacataatctgctttcaagatattacctactttcttctcaatttctgataaaaattattatccttgtaatcatcctcgtgggcatagaattttttcatgtcatatgtccaacaagtttcttctactcgtttatgatgtgtcaatgttacttcatcatcaaaacgaccttgatttaatttatgcctgtaatttctgttaaccattctttttatatctcgaacagttgaatctttcatacaaacatatcggtaatagggttttctgtaacttctactcattgtaagtcctccttaatagatacttacaatttagacaatactttcttcacaggaaccactccttattaataaaagctacctcccgaaaaacgtttcttcaccaaagtgtaagacgtaaactaacgacaggtcatagttttccaattaaggcaaataccagtgagaggatttgaacctctgacacccgccttatcaagacgatgctctaaccaactgagctacactggtgtgacccatgtgtcaggactttcacctgttctcggggtgccccgcctctctactaatctccccattcggtgcccctactagagtgactagagatagttagcaataaaaattatatatcatgaatcaaatttttactgcatcctatatacacgataccgtctacaggatttgaacctgtgacatccaccttgtaagggtggcgttctcccactgaactaagacggtgaaatatggaaccctaccagaggatttctttcggtattacaatcacctcggcatgaacaaagccagatattgaggtctggacttctcacgccccgggagtcgaacccagtatagacaaaccatattttatacggaagacaggattcgaacctgcgatataggagttttagtgcactcattatctcccacggtatccgctacgtattgccatcacgtcacttccgtatgttaaccgacagtaaaggaatcgaacctctatcactagattcgtagtctagcatcctatccaattgaacgaactgtcgctctaagctagcaattacgcagactgactatgggcaccttcgtcccgtcccctgtaagtgccctcctacaggttgtccgtggcaccgcaatgtactaaccgatgtccccacagggatttgaaccccgaaccccccgattaaaagtcgggtgctctagccgattgagctatgaagacagttgtgtttttcaagataaccctctcgaaaaaccgttactaatagaaaaactaagggtctcgactgacagatttgaactgcctgctcctcctaagaggcgtgttaccaaagccatacaccaactcttcgagaatatcccctacaggattcgaacctgtgaccccctgattaagagtcaggtgctaccaccaactgagctaaggagataagattaccaatagctagttaagccttacggaatcgaaccgccatgaggttatgaagctcacatagaccactagacacaaaactagcttattgataaaattctatatagataattgtatgcaatgttcgcactaactaaccagataaccagtcaatcattcaaaacattaatttgtgagtttccgctcacaatgctgattgagagaatcgaactcccattcccgggttacaaagccggagtaatagccgttatactaaatcagcgtaacccctcaatagaggggaattattatactaagttaccatacccgtaggtatttgtttgagcttgtttaaacataatgctcttgatagttaagtcgttgtacttttcatcgtcttcatcatcaaggtacacatcaacgttaacgttcttaccggaaataccgattgtttcgtctttaccaactgttaagtctttactgttgaaggatacatcaaagtagatgctatcttcttttgtacgactaccgaacgaaactctgtcaccaaataaatccaagcttcgagagttgattacaacaggttgtaacccaccttcaaattgaatagttactgtataatattgattttcaatattaaggatatttaaatcagcaatagcttcaccaaatgggataccaaagcttaattccaatgcaattgctcgtaagcagtcatagtttaacttaattctacggctaaacttaacaacactgtcaatttcaccatagtaagcttcgtctaacttatcttgcaagtaagtacgaatttcatctgcatcaggatattcgaaacgtaaatggtaatggaaacgtcccggacggttaagcataaagtcatttacacgacttaagctattaacagtaagagcgtagatacgtttacgttgtgataaaccatcgaataagctcaatagtttttcttgtggttcacgaccgtcacggtcattgaatactttttcaaattcatcgaacaggataagagactcttggtcaatactgtcaataaattctgcaatccccggataagcttctgtaattaagataacaggcatatcctcttcaatagctcgttgagataagatttgagtaaatagtgatttaccaatccctttgtctccacttaaaatgattcctaagctacgattaattgttttaaatgtgtgtagcactttttcaattttagctaaacggtcaccgtaaactttaggttctttcaattcaaaatcgtctgttactactagtgagaacccagacattggattgaatcgaactttataagtttgcgcaggcaacttatcataagttttaaggtcgtttgcataaatttcatagttactaccatagttgattactttcataaatattccccttattcgtgttttattagcatttgctaatggagaggggtggaattgaaccaccgacccctagggtttcaatctagtgctctaacctactgagctacctctccgtgtcaatttggacttatcccccacgtggttactaagataagtcctatgcctttgaagtgtggatactcaaaaatgagtacaggtactaaaaatctgatgacaagtcagatttatgtcataagcagaaggtgagattcgaactcacgttcaggggtttgcaatccctagccttaacccacttggctactcccgcattggcatccctctaggtttttatctgcatcgggactcacataaactgataagtgaaaacagggcactagtctgttttacacctgcgctatcagaacctagactcggcaacactgccttagatgactttactcttgtaaacacgtcacattcttcaacaattaccagtagagtgctacataccagtaattcgttcctgtgaaggatagtacactataactatcaccgctgtccaagaatacacgccgtgaaggattcgaacccccgtcttccgggttggagccggaaatgatagccactacaccaacagcgcaagattcggaggggagggactagcaaccctccgaaaaatgtaagataatgagagattaaaacatgccactattaaaagtggaataggtaattaaggattcgaaccttacaagcccttactgcttaccttgtaaacttatagtatcatgcgttgtaccgaaagtcaacactttttataaaaataatagggagaaatatttctccctaaaaatggactataccggaattgaaccgatgacctgtcagttatgagctgacggctctgacctactgagctaatagtccgtgtaataataccacgaaataaaccttagtaagtcatatagtcccagaaagggagacatatgaaactagtgttgaatgccataatcgtttaataaatgtgactgagagagtaataaatttcttaggcatgtccatatgcctcctttccaataatgatagttttaagatataaacagaataaataaaagagaaaataataatgaataatagcgcatgagagagtcgaactctcgattccggttcgaaagaccggtgtcttgaccgcttgaccaatgcgccataaacgagctatatgggacttgaacccatgaccttctccgtgacagggagacgagcactcctgactgctccaatagcccaatgtttccccaaccaccgccacctaagggattcgtacgtctacgtgagttttttggttatacattattgttcaagacaataaattgtacgagtggaataccaatttaccactctgcggttcctattgcggtaggtgggagtcgaacccactaaagcttggttatgagccaagtgcctaaaccgttcggcatctccgcagtaatacaagtctggttaaaaactcaaaacttaatagattaagggcttttcttcctgcttcatatacactcactgcattcggtcacatactcagagaggctgaaccatcgggagctacccaatagcttctctctgcctttaatgtatggtctagcacggtggctaacaacgttcacctaaacattcagcattaaaagtattattttacatataacccatatgtcttctgtaatattttcatccaacgctgacttaagctacttgtaccaaggtctcttgttaaacctgtatttctacagttctcgtcaaagggagtcttttgagttttccaaggtctgccaagcttctcacacttccacctaacttggattcttttccacaggaacgtctattgtatcccccaagagtcttgtaccttacaatccatgtatactccacataacgcttaactgatattagcttttactaatagttactcctatgttaccataagacctacctgcaacccaaagcactatcgcaccttcggttacatccagactcacgccacgttatcctagcaagctgttcaaactttctgcactaggttcaaaatctattaagttttcaatttttaaccactaacttgtggtgtaatactaatatagcataacattacaaagttgtaaacacctttttgtaagtttttttgatttttttgatggaaggtaagggggtcgaacccttacaccggatttctccgacctaactgattagcaatcagccctcttaaccatttgagtaaccttccaaaagcaaaaagggaacccctgtaattaaacaggggtaagagagatgtctctaaaagcctacaaccattataacatagaaacatagtttgtacagccgtaactgtacaactgtcaggacagggttcgaacctgtatcgcaaccttcaaagggtcgtgtcctacctgttagacgacctgacaaaaaggtggaacctccctaaatttggggaagagggaggttctcatgctattaacaaacacgaatttgctaaccaagtaatcttgactagcaactcacctagcaggacttgaacctacaagaactggttaacagccagtcatgataccgtttcatcataggtgaattttagttctatcaacattataacacaaaagctgatagaactagcaactttttttacaaacttaacaacttttttcttaactactgattcagcaacttactcaatagttaaagacttaaagaaagaggaagtaattgaggtatgtcaatcactaactaaagtatacaacatttttatcatcctgacaacaactaaatgcaaaaaagttcaaaaaagattataaatagttaaattatcagaatattcaaattaatgtcctattttaaatttttgacctccttatatacttaatactatatattaaatctatatatctaaattatataattattagactatatattattaatatatataagacttgcaaaaaattaaaataggacatttttctgacaattcacttttagataaaaagaaagagagcaaaatgccctcttaccgtgtttcaaagtattccttgattgtatactctctagcttctttagcttcctcagtttcatctttaggagctaaatacaatttagtaattgtagcgggtacctctaccatcttatagtcaataaaagtagcttgacgtagatttaagtatcggatacctgttgttctatcagtacctgtatgaacaggcaagaaagttaattctttacctctgacagaaccattagcttgtgttagtgcatcaactacagttccgcccatatagcgtggaaataggtaaaccttgtcagtacctactgtaatttctgcgaccttttcgtgtgttggatagttcacttataatttctcctttcagaatatgctataattacagtataagtataacacattctatggtttaaaaatgctgaacacgtaagtcacaaccgcaccgagaacaatcatgaagatgttttccacgatgtctcttttatggtcaaactctttgtcgtttacaccttcgagagcatcaatggtttcttccagttttgtaatctggtacgtaagatgtgaatatttctcttcatgaacagctaaccttttatcaagactgttaacgatgtccttcaattcactaactgcattattcagttctgtgttgtcctgtttaatgcccttctcagttagttctccatgttggagcttgtcttccaatcgttgcagtcttaatactaggtcacctacttggtaatcgttcatttgtgctccccctctcggttgtatagctcaatctcccggtcagttagaaaaccacatgtaaccgcctatgcccagaatacatccgacaaggtaaataattggagtatacagcccaatgaagagcataaccacgctaccaacactaagtccgtataatatcaaaagatacttatacgatgccaaaggacttaaatctgcttgcagttttttgtactgtatagctcgggtgacatagtaggatgctgagtaaacgaacaactgtagcaataacatagcaataaatgctagtcggtacattctatcgcctctcttctttcctagagctatctttaatatagtacaccaaagcctttataatcaggtgtgctagattaaatatgtaggctaaaaaatataaacggaagagtgagaaaaagtgaaggtacggaaaaaattattatacaaatcaatttttatcaccatctctgttatcatcatgatttgtgcaagcaagctgattgcagatatgctaggcttagaacaacactttacaacaacaatgcttgtaggaggttctttgtgggcttggatagctagtattgtctttgattcttatgagaagaggaaaaagaaagataatctacagcaacagcttcatgaagcactgcgtgatttaaaagagataaaagcgttaatcaaaaaataattaataaggggtggaggatatgtcccttacaagagaagaaataaagcaaaaaaggcagtatatttttagcaaagctcaaaagacgacaaatatacgaaaaggggataaacgcatagcaagtgctacacggatgtgtgcagtatgtggaagaccgttgtctagacttgttcttactaatggttctgcaatagttactacagcacatgtaagctgtaagatgtcagatttagtacgattgaacatgtgtgaagacatacggtcttgctatgcgtatacaagtaaaaagggggaggaatagccacatgagtatggcagaccgtattaaagaaaatgctgaacaaaagaaaatggaacgtacatccgaacaacgattacgtgacacatttaataatgcttctctcacgttaattaaccagttcatggctaaagttatggcaggttcaatagatatagatgacgttggggatttaacccgtctattccaaatctacatgcaaattaataatatcaatgcaggaatgcaagagggaactggtcaattacctgctcttagtgctacgcaaaaagatattattgcagataaggtaagcactgaaaaggctaccatagacggagaggaggaggaagttgtttcgttggaagagttagctaaattatcagacgaagaaattgataagatgctattggataaggaaatccaaatgaacaaagaaaacgaagcaacgttttaatgacaaataaagcacaacatattgctaaaatggcaaaagaaatgtatgggacggacaaaataacaactgcacagcttgcctacatcacagacatgttaactccgtccacatatttactaagaaaccactccgttcgtaatcatccgattacatttatgatttccggacgtgaccaacaaaaagcccaagcacatagaccttggcaagtaaaaattattaatgaccaacatcgaacaaaggcagttattaaatcacggcaattagggctttcagaaatgggtgtaggaaccatgctacactttgcagatacacatagttacgatgcagttaagtgtttgtataccttcccaacaaacgaacaaatgactaaattcgtacaaacacgtcttgaccccgtattgcaacgtggttattacagtacgattattgacccagaagtagactcattaaaggctaagaagattcgtaatagctttttatacttccgttcaagctctaaaccgggagctgtagagggggtcgatattgattacctatctatggatgagtacgaccgtgttcctgcattagccgaagcttctgcattggaatctatgtcatcttctccatataagattgttactcgttggtctaccccatcagctcctgatgtaggtatccatgctttgtttgaacagtctgaccaatactggtacctacacaaatgtgataagtgtaatcattataaccaaatgaactatgaagactatgtaccagaggcaccagtggaacgtagagggaacatcctttgtgtaaatcctaaaggggtagacccaattgctaaaacagttgtggatggctccttccaattcgtttgtcaaaaatgtggagagccattagaccgttggtacaatggtatatgggttcctaaatatccagaccgtactaaaaatggtctaggtattcgaggatacatgatttctcaaatgaatgctgtttgggtatctgctgaccaattaaaaacaaaagagctaacatcactatcgaaacaagcgttctataactatacgttgggttacccttatgctgaccaaaaacttactgttaatgccggtgacgtagaacgtaacagacgtggagacctcccagaatctcctagagaccgtggagattacaagtttatctctgtaggtattgactggggaaacagacactgggtgtccattcatggcgttagaacgaatggtcaagtagatttaattaaattgttctctgtaggtaaagctaacccgttaaaccctgatgcaattgatacagatattcagtcaattcgattacaattagcaccatatgaacctgatattatcgttgctgatgttggtgactctggtgataaagttgctaaactgattcagatttatggtaaagaccgtgtatttggttgtgtatacccatctacacctaaatctacaggtaacttagtgcctagttggaatgttcaaggtaacaaggtatctgctgataagctaatgcagaataaacgatacatctcaaacatgaaagatggagttattggtttctaccacaaaatggatagtgaactaatgctttacattgaacactggggaaatgtagtaattcgtgatgaagaggatgaaaaatctcctacaggattccgacaaaccatcggacgtaaaggtgatgaccactattcacaagctagtgtttattccatgttaggttatgaacatttgatgaacgtatttacaggggcagatgactacgggtttaactctgattggatttctactcaattgaaccctacacctcctgatatttttactcagtttacttaaaaaagcaaaatgtcctattttaatttttctacgtccttatatattaatactatatatctatatacctatatctagttagtaagtatatatagtataatatattatataagggagacaaaaatttaaaataggacatttttattaaattagctattgattgacaaaaaataatatgctattatactacttgtcaataatagcactagttattttttcttgtcataacaataaaggagacgtttacatgaatgacaatcaagaataccaagctcttgttgataatcttcttagctctgttccagaatttaaacctgtagaagctacagtcagtaaatcctttttagaaggtatgctaggcaagaagttagactacgggtacgttatatcagaaaatgaaaaattatcaaaagactattcacatattgtgaaggcttatggttttaactccttttatgacctatactgctatgctgatagttgtgattcactaaatgactatttaattaaaggtggtcaaaaagatttatcaaagttgaagccagttaaaagacgagtaatgagaaatggtaaaatgatgacgactactatctacgaagacagttccggagaagatgatgataaaaacccattagataaggacactcaaacagaggaaaatgttgagccaagaaatgctagagatttaagcaaaacaattattggagatgaccataatggtatagacccaaaacaaattgctaaacttaaaactgaggcaggtaatctaaatgggacattttcaactgattgttcttcatacttagttcttcaaggagaaaccggagaaattggtggtgtggcaggttatcgtaaagagggtagctatttatatttagctttctaccaatcagacgaccttacaagtggagtggcttatgtagcatttacacaactattgttacgtgctcgtaaacttggcttgggcgctaagattgatgctactgatgacccgttagcactagaattatttaaagaatacggacttaaaaaaagtggtagttgttatataatttccaagagttccctactggaagcgcttggggagccatgatttcaacttttgagttatttttaattttagccttctcaacaaccgtgtttatatgctataatctttttgtagctcaaacagtcaagacaatttttgatttgagaaaaaaggcacaagttgtgctaactgaaagagcaactgagctaacgaagaagttaacaaacatactgaaaggggatgtacaggagttgccagagaaagaaaacgtaattattaacgaacaaacactctctgacttgttagtcgaaaaagcaagcgatgccgactacaaattgttcattgagaaactgacagagattgtaaaggatttatattcaaattatcaatttcttcgtcaagacccacaacccgatgatttcatgtcaggttattttttagggttccaagtttttagagaggaataccctgtcgaatatgagtatttattccgattagctattgaccgtgggttagacgatattaaaatcaataaactctttgtcgaagctttacaaaacggagaggtattaccattaggagatgccattgtagaccctaacttgtccggatgcagttctatccttcaagcacaagaagtacgtgtaaacattgtattcgcacctaaagcatacatggagcgtaaagaagagctgattgaagaaaaaactgctgaaatggaaaagcagaagaaagagcaacaagaactagcaatccaaaaagacaacgtggttaaatctgcacgtcttgctgaggctgtcattaacgaattagtggatgaagtcgcagaaaaacacgaactacaagaactcgttaaacaaattaaagaaagcatgaggtatttctaaatggcaaaccctacaaccaaagtaacattaaaccaagcattaatcaaagaattgcgtgcacttcaaggaaaaagagagtccttgattgcaagcaatctacatgtaccagaacctcagtcagttatgattccaattcctaatgttttagtaacagatggtgacaaagaggtactaaaatttattaaaaatatcggtttaattagagctgataaatcttttgggttagatgtggcaattgaagcaggagaaaaagtaacccttacagatggacgttcttccactatcttggaatgtattttctattacacaggagatacaaaaattgatgaaattgagcaattcttagaacaaaactaatatttcctgattaaaaagaagctttttttacttgtgctatattaacactgcacaggaaaagagagcttctttttttgtgacttttttacaggaggttgcaagatggcaggagaagtatttagtagtttgattacaagtgttaaccctaatttgatgaacgcaggtagtcgtaacggtattgctattgaccgaattattctacatcacaacgcaacaacaaataaagatgttgctatgaacacatggttattaggtggtagcgcaggtacatctgctcactatgaatgtacaccaacagagattattggatgtgtcggtgaacagtactcagcattccatgccggaggaactggtggcgcagatattcctaagatttctaaccctaaccaacgttcaatcggtattgaaaatgtaaattcaagcggtgctcctaactggtcaatagaccctcgtacagttacaaattgtgctagattagtggcagacatttgtaaacgttatgggattccatgtgaccgacaacatgtcttaggacataacgaagtgactgcaacagcatgtcccggaggaatgaacgtagacgaagtagtacgtcaagcaaaacagtttatggcaggtggaaacagcagtacagctacagccactcgtcaagcattcttcgatgttgtgaacgtaaactctggtgcatttaatgtgcaaggatggttcatccctagcaagtctacaaaaggacaatctatttggttgtactttatggacaagaaaacgaataaagaaattgctcgtttccaaggtaaacgtgtagttcgtgaagacgttaagaaagtatatccatctaaccctaacggagcagatgttggttttaacgttgatggtgcaactccacaaagtcttatgggcaaagactattacttcttgttacgttacaacaacgataacaaagaagaacttttcgtaacagataaagtctttaaagcacctgcactagttaaccgtggttgcctagacgtaattagaggtgacaaaggtcaggttactttacatggatggcatttatcttccaaacgtagaaactctgacaaacacttcttgttcatcatggataagaaaacgaataaagaaattgtgcgttttgacgttacaaaatcttcattcaaagcttccccagatattcaaaaattgtatgacggtacaattgcacaacgaactaattgtagatttgcttttgctcatgcactggatgctaaatcccctgcacgtggtaaagacatctatattttaagtcgttactgctctgaccctgcgggtaacaacgggatttccgaccagttacaacttggtggaactcacaaattgtaacattacattgacctaccttctggtgggtcttttttattactgtaatataatgtaaaggaactgtaatactataggactaactttgtaacactaatttgctatattagttcctgtaagcaacacataaaactaaaacaacccaaaggagaacgacaacttgaagaaaacgacaattgcaacattaggacttttaggactaggactatcattaggattgggagctaaagctcacgcagacgaaatccaagaaaatggacaaacttactggcaagtagaatccggagacacattatcagctattggtaatcgttacggaattgattttaacttaattcaccaagcaaactcagacaaagtttcagatgctaacttgatttatgttggggacaaactattattaccattaaacggtgaagttcaagctcctgtagctcaaccagtgcaagaatcaccagttgtagaacaagcgcctgtagtagaagaaacacctgtagttgaacaggcaccagttgttcaagaaccagtagaacaagctcctgccgttacatctaactcagcaaaagaatggattgcacaaaaagaatctagcggttcttactcagcaactaacggacgttacattggacgttaccaattagatgcttcatacttaaacggtgactattcaccagaaaaccaagaacgtgtagcagatgcttatgttgcaggacgttatggttcatgggaaaatgcacaagctttctggttagctaacggttggtactaaaataataaatactaacagattaaaaaaagactctctttttagggggtctttttcttatgctatattataactgtaacttaaaaacaaacaggaagtgatagctatgagtaacattaacatggaaaccgcaattgcgaacatgtacgctctaaaagcacgaggtattacttactcaatgaactactcccgaacaggtgcagatggcacaggggattgctctggtactgtctatgattctttacgtaaggcaggggctagtgatgcaggttgggtacttaacacagatagtatgcacagttggctagaaaaaaatggttttaaactgattgcacaaaatcaggaatggtcagctaaacgtggagacgttgttatctttggtaaaaaaggtgcaagtggtggttccgcaggtcacgtggttatcttcattagtagtacacagattattcactgtacatggaaatccgcaacggctaacggtgtttacgtagataacgaagcaactacttgtccatatagcatgggttggtatgtgtatcgtttaaatggtggaagtactcctccaaaaccaaacactaagaaagtaaaagtacttaaacacgctaccaactggtctccatcaagtaaaggtgcaaaaatggcaagttttgtcaaaggtggtacatttgaagttaaacaacaacgaccaatttcttattcttactccaatcaagaatacttgattgtaaataaaggaacagtacttggatgggttctttcccaagacattgaaggtggatatggttcagatagagttgggggaagcaaacctaaactacctgccggatttacgaaggaagaagctacgtttattaatggtaatgctcctattactactcgtaagaataaaccaagcttatcttccccaacagctacaccattgtatccgggacaatctgtaagataccttggttggaaatctgctgagggatacatctggatttatgcaacagatggacgttacatccctgtacgacctgtaggtaaggaagcatggggtacatttaagtaacatgacttaagagggctaaatagccctcttttttgtgctatattaaattagtagacagtgatgaaaaattgttacagggctacctgtggtatacttaaactagtacaaatgcttgggaggtaagaatacgtggcatacttacaggacgatacatggcaagcagtaaaacagttagctaaacaaaacggttttgtaggagactggattctaattattcacctctactatgaaaacggtggaaacaatgtacaagttcatactgctatagataataaaaattaccgcatactacgaatcttagataacaaacaggttttattagttgatagagaaggaaacgttgctgtagaggactatgaagtagtcaatgatagtcagaaaggtttcttttatagtgatatgcacaaagtcgaactaacacttccggaaggttgtagcttcaacggtaaacaaagaataaaaatttatatatgaggtaggtgtaatcaagttgccaaaatggttagataaagtgttgggtgtagaagaagatactgacatcgttaaaagcgaagaagtctaccaaaccttgcttaaagaaattcaagcacagccgttaacagaaacggtagagaaaggtatgaatggtaaaccagtagcatacatgcaacctataattggtgacatgtcagtaaaccccggatttaagacaaaaccttctattagaaattctcaggatttacacaaaatgttgaagaagtttggtaataatatcattcttaattcaattattaatacacggtcaaatcaggtatctatgtattgtaaacctgcaagaaactctgagacaggtgtaggttacgaggttcggctgaaagatattgaacaagagccatccacacatgacattgcaaatattaaaagaattgaaagctttttagaaaataccgcagtattcaaagaccaaaatagggataattttactgctttttgtaagaagatggtacgtgcaacttatatgtatgaccaagttaactttgagaaggtattcgataaagatggtaattttatcaaatttgataccgtagaccccacaacaatcttcttagctactaacggtaaaggaaagattattgaaaagggagaacgatttgtacaagtactagacaatcgaatcgtagctaagtttaacgaacgtgaaatggcttttgctgttcgtaacccacgtgctgatattgaagtaggtcagtacggttatccagaactagaaattgccttgaagcagtttattgcacatgaaaacaccgagacgtttaatgaccgattcttctctcacggaggaacaacacgtggtatcttacatgttaaagcaggacaacaacaaagtcagcaagcattagatattttccgtagagaatggagaagttccttatcaggtattaatggttcatggcaaattccagtagtatccgcagaagacgttaagttcgttaacatgacaccatctgctaatgatatgcagtttgaaaaatggttgaactatttaattaacgtaatttctgcgttgtatgggattgaccctgctgaaattaacttcccgaataatgggggagcaactggttctaaaggtggttctttaaacgagggtaactcaaaagagaaaatgcaagcttcccaaaataaagggttacaaccattattacgctttattgaagatactgtaaatactttcattattgctgagtttggagacaagtaccaattccaatttagaggtggagacctaagtgctcaattagacaagattaagattcttgaagcagaagttaaagtgtttaaaacagttaatgaagcacgtgctgaaaaagggttggaaccaattaaaggtggagacgtaatcttagacggtgttctaattcaatccattggtcagttaatgcaacaagaacaatttaactatcaaaaacaacaggataagcttaacaggctcttagagctttctggtggcgaagcagatgattctaatggaattagcttccaagacaaacaacagggcttagatggaacctcagctagcgtaaatggcaaaggagagtcatctgttggtaaagatggacaaattaaaggtaagggcataactaacaccaattctgctaaacaaggtatgaaaggtgacaaacctaacgactggcaaaaataaatagaggggtaacaccctctatttacaattgtccaactgtttagtggtagttctgctatattaaaaacagatgtaagtttaggtggtgaatgaacaaagatgcaagagaagtataatattttcgttcccattgacgtagcaggttccgtagagaaatctgaacaggcaaacgatggtgaatggtacgtacagggttatgctacaacgcctgaccttgacttgcaaggagacattattttaccacagggaattgacatttcttactttgttactaaagggtgggtaaactacgaacataaacaagatgcagaatacattattggtgtaccaactgacaactgttatgtagaccttaataaaggtttgttcgtggaagctaaacttatgaaagaaagcaagtatgctcaatcaatgtggcagttagctaataccattcaaaaatcaggaatctcacgtcagttaggtttctcaattgaaggggcagttacaagtcgaaatgcaagagacaatcgtattattgagggtgtggctatcagaaacgtagcattaactacacatcctgctaacccacaagctacgtgggaaacacttgttaagtcttggacaacagggtatggaattactcctgagacacagacagatgcaggagcattacgtagagagatgtttaaagaagacatcacaaatctaacatatgcagtgaagacagtagctaagttgtatggtaaaaaacccgaagataaagagtttatattacgtgaagttgctaagagtttcgaccaagaaacctctgaaccagagttaagtgcatttatgttacaattaactagaggggtttccttacaggaagctaacaacttcattgaaagtagaaaggagctaaaatagtgtctaaaacaattaatgacattatcgaagatttcgattcaaaagtgaatgtacaggaagtatctaaatctattgaagatgaaaatgtagagcctgtacaggaagaacaaattgaaacaccagaagctgttgaagaaggtgtagaaaatgacaagccggaagaacagcctgttgaagctgaggaagttaaagaggatgttgaatcagaatccgaacctactgaatcagatgaaaaaccagaaacagaatccgaagtcgcagaagaagctactgaaccagaagtggaaaaagtagaaaaatctgataaagaatccgataaagaagatgaggaaaaaaaatcttctgatgacgaggacgacaaagaggataaaaaggataagaaagataaaaaagctgacaaagaagataaagatgaaaaagatgaagacaaagaagatgttaaaaaatctgatgagtccgaagacgtagaaaacgttgaaaaatctgttatttcttcccaagatattgtcggtggattcgaagctgtattcaaaaatatggcaaacctttttgaaactcaaaaatctttaactgatactattacagaattaaaatctgaaatcgtaagcttacgtgaatctcacacacaagctatcacaatgaatacagaagatgttaacaaatctattcttgtagataaagttgatggagtatcagtagaaggtaaagcagtaggatttgtttctaaatctgtagatgtagaagcagatgtgacttctgaacaagaagatgttgttgaagtagtagtagaaggtgccgaacaagaagaagctccggctaaatctgatgaagaacaattgtttgacagtgttcgtggaatccgtgatgacttaatgagcacatatactcgtgttgcaagtaacggacaagcccctcgtggtgagttagaagaaattcgtcaattatggggacgtattaaatcccaagacgaactagctcgtgcacaagcattcattgataaatacaaataaatttactaaaaggtaaatttttttaaggtgtactgctatattatagtcagaaccaatgagagacctgacatttcccccctgaacctccacagggtcaggtctcatctttgagaggaataaaaatgaaaggtgatttatatataatgccagaagacaaaaaacaagaagctaaattaaatcccgttcaggaacaagtaatcaaaggatttacaactggttatggtattactcctgacacgcaaactgatgcggcggctttaagacgagaatttctagatgaccaaattactatgcttacatgggcagaaggagatttgtcattctatcgtgacatcacaaaacgccctgctacatctacagtagctaaatatgacgtatacctagcacacggtaaagtaggacatacacgtttcgttcgtgaaatcggtgtagctccaatttctgacccaagcttacgtcaaaaaactgttaacatgaaatacgtttctgatactaagaacatgagtatcgcaactggtttagttaacaacattgaagacccaatgcaaatcttaacagacgatgctatctctgttgttgctaaaacaatcgaatgggcttctttctacggagatgctgacttatctgaaaacccagaacgtgactccggtctagaatttgacggtttagttaaattaattgacaaacataacgttattgatgctaaaggtgaaagcttaacagaagcattacttaaccaagcttccgtattaatcggtaaaggttatggtactccaactgatgcttacatgccaatcggtgtacaagctgacttcgtgaaccaacaacttgacaaacaagttcaagttatccgtgacaacggtcaaaatgtaacaatgggattcaacgttcaagggtttaactctgcacgtggtttcattaaattacatggttcaacagtaatggaattagaacaaatcttggatgaataccaaatggttagtcctaatgctccacaaaaagctactgttcaagcaactgtagaaactgacaagaaaggtacattccgtccagaagacattgctactcctgctgagtacaaagtagttgtagtatctgacgatgcagaatctgctccatctgacgtggctactgctacaattgctaacgctactgacggtgttaaattagcaatcactatcaacagcatgtatcaagctcgtcctcaatacgtagctatctaccgtaaaggacatcaaacaggattgttctaccaaatcgcacgtgtacctgcaagtaaagcagaaaacaacgtaatcactttctacgatttgaaccaacaaattcctgaaactgctgacgtattcgtaggtgaattgactccatctgtagttcacttgttcgaattactaccaatgatgcgtttaccattagctcaaatgaacgcttctgtaacattcgcagttctatggtatggtgctttagctcttcgtgcacctaagaaatgggcacgaatcaagaacgttaaatacattccatctggaaacgtaattaacgaacgctaagaggaggtaaatatatatgtcagatacaatgatcgttgttgctacaccaacaccaggtttctcatacgcttcaggtttaacatacggtggtggtgctttcgctggtgctccagctaacggtccatcagaaggtcaaatcttcttccaaacagttttaccagcttaccaatcaccaaacttatgtatcggtcaattagcttggatgacagattacatcaacaaaaacggtgttggtaacccaaaaacatgggaagttatctcacaaaacgttttaatcttctgttcagctgatacagctttagttttaaacccacgtatcgctgtttacgatggtttccacaaaacaaaatgggctccagctaaattcaacttcaaaacacaatcacaagaaaaattctcaggtaacgttacaacaccaatcgctgctttcggtcactacttatggggtgaaggtaaaccacgtacagttgatttatcatcagttggtttaaaaatccaagctaaccaaatcgatccagttatgatcgctgttaaaaacaacgctgctggtacataccaaatctcaggtaacttcaaccgtaacacattcatcgatggtgatatcccaggtttatacttaggtaacatcacaatgaaaacagaaggtacattaaaaatcgatgctaaaggtaactggaactacaacggtgttgttcgtgctttcaacgatacatacgatgctaacccatcaacacaccgttcaaaatcagctgaagatttaacaacattattacgtttaacacaaggtacaccatacgaaatccgtatcccaggtgaattaaaagtttcaggttcaggtaaaaaataatcttagttcaactaagaaaaattgaatagaaaacggaatagggaacggtctaactgttccctatttttattataacgaattaaatggaggaatacaaatgttaaaatctacagtattacaaaataaaaaagttgcaacatcttttggagaagctgaatttaaccatttaggagaaagtcataacttgccagaggaacatcaaaaagctttagctgaaaaggtgccttacttgacacacattcctgataagaaagaaaaacctaaagaggaaaaagaagtaaaagaagaaaaaccaaaagctaaaaaagcacctgctaaagctaaaacagccaaaaaagataaagagtaggagggcatcatatgtacccagattacggttatgatgatggtggaaaccaagatgtataccaaccatatgcacatggtaacccaaaacatattgacattgcagacctagataagattactcctgctgattacggttggactcccgacacgttaaaggcttacatgtttggggtagctgtagttaaccctgaaacaggtgaaccattaggagatacattttatgaacatgtaattgatacagcaattgctaaagctgaaaagaaactggatattgcgattttacctcgtttaattcaaggggaacatcacgatttccaccaatctgactttaactcttacttatacacgcatgtatttaaacgaccactaattcaagctgaaaagctacaattagaaattaacggacgaggaatctaccgttaccctgcaaactggtggaaagtatataccctagcggggcatatccaaatgtacccaacagcaatgatgcaaacaggtacacaatttgcctatgattttgcattctctggctacccacaattagcaggtatgccaccttcatctggtcaagtagatgctccacaaatgattcatattgactacgtagcgggtatgttacctcgtaagaatcgtggatacaacgctgagtgggagtgccctgctgatttagagcaattagtaatcaaatatgctattaaggaaatcttccaacaatggggacgtttgattattggtgccggtattgcaggaaaatccttgtcaattgacggtgtaactgaaagtatacaaacaacacaatctgctatgtatggtggtgcatctgccgacattaaacagattgacgaagatattgacagactagaacgtgacttagcttcctacttcggaatgaacctaggaattatttaaggagggatgactcatggctaatgaaccaacacgtttcagcagttcaggttctacaggtaaccctaagcaatacatgaatgtaagtagactagagtttgaaacaaaaggtatggatacctttgtaatgaaccgtggtataaacattctgtgggaacgagcttggctttgtacatgccgaaatccgatgactcttgctcctgactctaattgccctatttgtaggggtagaggtattgcatatcaacctgctgttaaggatataatgattatccaaagtcaagaaaaaggtgtatcaaatcaagatttagggttgttcgattctggtacagctattggtacaactccaattgactctaaaattactttccgagacagaattactgtcccagatgtggaaatataccaaagtttcatttttaatgtaaatagtcgtagattagagacaggtatgtttttaagctatgatgttaaacggctagaggatgtgtatggtgacaaagggcaagtccttgtggagggtaaagactttacgatggactatagcacgaatactttttatcctaaacaacatttgttaaacacgaacatctctatcaacatggcagtaacattacgttatctggttattgatttactcaaagaaagtcgttaccagtacacgaaatttggtgtaaaagaaccgctgtttgagaaccttcctagaaagcttctattgaagcgtgaggacatctttgttgatagtgaaccctttgtattagaagtagatacgaagtctcgtctagaggcactagagaaggaaaaagaagtaacagaatctaagatggtagaccctaaacgtacaggttcgagtgcgggagggttctttggaggtaaactaaatggctaagaaaggacaacgacctgcactgttcaccagtcctaaagaaatgttaggtaatctgacacgagcaatggtagatgagattctatctgatgcacaagaccaagcgttacgtgcaggtgccgatgtccaaagaatgcctaattatttacaggtaacagaatcaagaatggctaagagcggtgtaattgatttaaaaccgttcttcgctcgttctagtaagaagaagtacaacaaaaaaggtgaatggtacttatatattcctattcaaattaagacaagaaagatgtctagaagattgtatgacgatttaaggtcttttcctacaaatggtcgtcctgtaacagttaagatggactatctttatgatagaagaaaacaaagtcccgctgtacaaagtatcaactatagccctaagtccaaaaatgttacaattataccaagagagtggggagaaggtacacggaatacatatgtgacattccgtacagtaaatgccaattctccggctaacagttggataatcaaccgtagtaaagtgaactcggacgatatgagtaaaacaatgttagctaatatcgacaggttaatgaagtggaaattgaagaatttaggagggtaaaagatgataccaagtttagacacttacttgtataaagaatttgaagaaagactgagaattatcttagaagagtgctatattatagacgaagctttgaaggagatagattcccaagctttagagacatttaaaaatacttattgttcaattgacggtaaggctccaaagaaagaaatcgaaatgtcgtattctttcccacaggagaagcagaactttaatgctcgttatgtgattacactaggtgggagtgatgaggagaataagtcaatgggtggtgtacagggaggctatacttaccgagaaggtgatatagttaatgaagctgttcaacttgtccgtaatggaaaagatttaattctgaacacaacaaagcctgtagctgattttttgaatagcccagatattagtttttcagaaagcgaccatttcagaatcgaaaacaacaagcctgtatttgattattccggtaatgaacacttagaaggtaaatcttttaatattgtttatactgtgaaagagtctgatgaggatgtagcaggtgtttacaaagggtaccaatcctccgataccgtaaacattgtcggaattagtacaaatatggacactgcccgctgtctagatgccatcgcaagattaattcttattacgatgcgtgacagcttagatgagaaaacaggatacatgctacagacgttacactttggagacatgcaacctgtaattgaatcaggtgagacagtagtatttggtagaccttgtacaatcgggtataaagtaactaattctattagttttgatttaaaccgacaaatacgagaaattattaccaaaaggaggatgaaagcctaatggcaaaagaaacaacaaagactaaacaagagagtccaaaggaacaacctaaaaaggttccaaagcctaaagggtacgttcatgtagatacatttttgggctatgcacaagtactttacggattaagtaagtatcaagtagcaggcttcaaagcattcatggcagggagagagtatcagcacgatgatgccgactttgttccgtttttggaaaagtatataggaaaggaagttaaataataaatggctgtagaacaattcccaagaaaaaaagtgtcccgtccacatactgaaattactgtagatacttctggtatcggtggtgcatctaacagttctgaaaaaacattaatgttagtaggttctgctaaaggtggtaaaccaaatacagtttatcgtttccgtaactaccaacaagctaaagctacattacgtagtggtgaactattggatgctattgaattagcatggaacgcttctgatgtgaacactgcatccgcaggtgacattttagcattgcgtgtagaaaatgctactaacgcaacaatcaaaaaaggtggtttaaccatcgcatctactatttatggtttagatgcaaacgaaatgcaagttgctttggaagacaatagtttaacaaatactaaacgtctgacaattgcatttgcaaaagacggatacaacaaagtattcgataacttaggtaaaatcttctctatcaagtataaaggagaacaagcacaagcttccttcactattacagaagatagcattactaagaaggcaaataaacttattctaagcgcaggtgctgaggttgaagaccaaactcctgtaatggaatatagcttaggacaaggtgtttactctgatacaaacgtattagtaagtgcaatcaacagtttacctgactgggaagctaaactattccctatcggagacaaaaacgtccctactgaaacatttgataaagtagaaaaagctgatgttaaaacaggtgagaaatatgttgaagctctaggcggagacattgctaaacaattggaatacaatgactatgtaacagtagaaattgaccgtgcaactccaattcaagactttgcgttaactaacctttctggtggtacagatggaacaatcccagaatcttgggctgacaaattccctctactagctaatgaaggtggttactacttagtaccattgacagacaagcaagctgtccattcagaagctttagcattcgttaaagaccgtacagacaatggagaccctatgcgtatcgttgttggtggtggaacgaatgaaacagttgaagaaagcatcgcacgtgctacaaacttacgtgacccaagagcttctgtagtaggattctctggtactcgtaaaatggatgacggacgtttgcttaaattaccgggctacatgatggcttcacaaattgcaggtattgcaagtgggcttgaaatcggtgaagcaattacgtttaaacacttcacagtaacaagtgtagaccgtatctacgaaagtggtcagttagacatgcttaacgaaagtggtgttatcgctgttgagtatgtacgtaaccgtaccttaactgcattccgtatcgtgcaagacgttacaacttacaacgataaaacagacccagttaagaacgaaatgtctgtaggtgaagcaaacgacttcttagtatccgaattgaagattgaattagataacaacttcattggaactaaagttgtagatacaagcgcaagcttgattaaaaacttcatccaatcattcctagataagaaaaaacgtgctcgtgaaatccaagattacacaccagaagaagtacaagttgttcttgaaggggatgtagcatctatcagcttgactgtaatgccaatccgtagcttgaacaagattactgtacaactagtgtacaaacaacaaatcttgacagcataacaggtcgggggcttttagccccctataccttactaaaaataatctaaaataggagtgaaacatagatggctagcgttggaaatcaaacagtccacacaggtaacacagtttacttgatgattggtaacaaaattatcggacgtgcacaatctgcatctggtgaacgtcaatatggtacacaaggtgtatacgaaattggtagtatcatgccacaagaacacgtatacttgaaatatgaaggtacaatcaaccttgaacgtatgcgtatgaagaaagaagacttagcaagcttaggtattactgctctaggtgaagatattcttcaacgtgacattatcgacatcgtaatgatggataacttgactaaagaaatcgttgttgcttaccgtggatgctctgctgtatcttacagtgaatcattcacagctaacgaaatcactagtgagtccactcagttcacgtacctaacatcagctaaagttaagtaagtagtgtaaaatagaccctaaaaaatggggtctattttttttagttttggtattgacaaattatacatgtatctatataataggtattgtagttggtatacattttcgaacttaatctttcttatctttatcttacacatgacctagcaggagtgctaggtctattttttttgctctcatagaggcaactaactagtgtgctataataagtatagaatgctatattaacttatgaaagacataggaggaataagtaatgactgaaaaagaaaacaaggttgatttccctcagcttaacatgactcgtgaacagcttatcgaaaagattaaccgtggggaaaatctaacagacgaagaaattaatttgttaaaatatcataatgcagaagcagagcataaagaacttaaccgaattattccgggagttaacaatgtattctcaaaacattatgatttaaaagagtttggtatggaatttgatattaaaattaaagcaccaaacgtggtacaacaaggtaaaattcaagcaatgcgtgaggcttacttagaaggtatgggtatggcagtaagtaactttattttccaatgctaccatacactagctactatccgtgtttgtggtgtagaagtacctaaagagctagaaaaagatgaagacatctataacatctacgtcttaaacattatcgggaaggattttgcggagtggttaaactcctttcgctactaatctcgaaagtttagggggtataaaaaccctcgtcagaaatacatatagccgaaacatgtgggctattatgaaaaaatttaatgtattacctagtgaccctgcatggcaaaatctaactcatgagcaagtagaatggattttgtataacatggaaagagatgttgaagaagaacaacgcagagctaaaggtcttgctctcgaaggtgaatacgaggacttggatgcttcttggtatgatgtacctcatgaagagtttaaccctgtacgtgaaggtcatgatgaagctgagattgctcgtaagcttaatgaaatcactacagaagaggacatggctaaacttaaagctcgttgggaagctagtcaggaagtcgatgcaatccgtgccgaaggtggtacaacgattgaggaagacacaatcaatgaacttattgctaacaatgtacagaaagctattgaagaagctaaacgtattgagaaacatggtggtaataagtggggagacaaaaccccgattgaattagaggaagagcgtaagaatctagaatttaaatctcagcttaagcaagatgatattcaagatgcaattgctctgttcaatggagaaaaagatattgaaccaacatcagtagacgatgattttgtaatataggagggtagggttttaccctaccttttctttgtaaaggaagtgtggaaatggctaacaactatcggttttacgttgatgcaatgactggggatgccattgcaaaattagaagaagttaataagttgatggataaaattgactctaagagtgcaaaaggtacccagaagtttttccatacaactcaaagagaaatagacgaagcagtagccgatatgcaacgtttaattcgaatgaaaaaggaactagataagaacttcgaaaaacaaagttctatggcagaagctacaggtagcatgacagattttaaacgtgcacgtgcaaacctagaacagttacaaagtgagttccaaaaaacacaaaacgagttccaaaagttagcaagcatgaaagctaacccgaactttacgaataaaacagctttgaaagaacaaagagcttacagagaagaattgaccgagcaggaaaaagctttacaagcaatcaagaaagctcaacaagaattaaatcgagtaaactctcgtgtaaatcatagagcacaccaagctacctctacaggtagaatgacctacaatcaatctgaaagcatgaagaaggatttaggtggtgttgggctatactcagatactcaacgagaaaataaagaacgacaagctcaactaagagaccaataccgtagaagacaagaggagctatcacaagtacgttctgatacaaacttagatagacaggttcgtaagaatagagaaacatctatcttagaagaaatcaaaggtatcgaacaagagattgaagctcgtaagaaatttaatcagaccttgaatgatactattgagaacttaaagtcaaaaacggaacagttaaacaatagtaacgttaaagtagaggcggataggaactccactgcgggcgttatagcttctcgtgccccatctatagccatcgcaggtttaggctctgctgtggcggcaatagggggcttatacgctaagggagctactgcgaatgcaggtatgcgtgattcaaccatctctttaggacaacgtacaggtaacggagacttccgtgctattcgtaaagaagcccaaatgatgggtattgaaaagcaacttgggtataaaggagctgatatgcttcaattccaagaagatgcgttaagtaatatcgggtttaccaataaagaagacctaacagctaatactagagctttagcggaaggttcacgtgcagttcctgttgattctgaaaccttaagcgggtttatgaacgaccaaatgcgtagaggcgctgtgagcggtaaagaccaaattaaagcgattcaggaaggtttcttaggagctatccaaaaatctggtatggtaggtcgtgaaaaagagcagttaaatgctttgaaaacattaagtgaccaatcatttagtggacgtaacggtagtaatgaggaacttaaacaacaaatggctatgcttacactgttgaacaaaactggttctcgtgccgtccaaggtgaacagggtgccgagttaatgactagtttatcagcgggtattcaaggtagtgtttggaacaacaaggcttctttactactaggtaagggtagtcaataccaaggtttaagtggtatgtatgacttagcaggtaaacaagaagagggagctacccctgaaaatctgcaaaagattattggtagtgtacaaaaagctgttcctaatgatgaaaaaggtcagaaatatgtccttaaaagtgctatgcacgaactatttggtacaaatgcaactaatgaccaagtagatggtatcatgaaggcttacggtaatggtaatctaaatgaagaaaatatcaataagattatgaatgaaagcgaatctactggtaaagataaatacaagaagaatgcagaagattatactaactcgaaagagggtatggctaatcgttccgaagcagtaactgagaaacaagcttccggtatcaacgactatggtgatgctctacgaggaattaattctaaattaggaggaatccctccggctatgtatgctttaggtgcaggtatgggtgccctagcaactgccttgattacttcgggaactatgggtggtctctctagctttgttaagaacttgacgagagggacattctctgccggagctacaactgctacaacagccggagcaactagtgcaggtggttcattctttaaaggtgtaggacaagcctttaaatcaggtaaggctactggtggatggtcagcaggtcttaagagtgcaggtactacagctaaagacttagcaggtgctaatattgccggagctgaaactattgcaggagctacgaaagcaggttctgtagcaagtaaatttggtaaagtagcaggtaaagtagcgttacctattgccttagtcggttcagcaattgatattgcaagctccgatgacaaggtaaaatctgttggtgagaatgccggaggactagcaggtggatttgccggagctaaattaggtgctttagcaggtacagctattttaccgggtgttggtactgttatcgggggtgcattaggtgctcttggaggtagcttaatcggtaataaagccggtggtggtttagtagacggtgttcgtaagttctttggtggagaggaagcctatgcagacgaagtagatacaggtacttccgcaggtgggcaagaaacgcttaaaggacaagagaacaagtctggtaaacaagaagaacgagacatgacgaataaacgtgtcctttctgaaaaaacacgtgctgagaataacgctgaggaagcaactaatttatctatctactcaaaattacttgatagagcacaacgaatcctaaatcaagctagaaatcaaaatggtatctttggtaactccaagggtgctaacagttctagtgatagtggcggtatcggtgacgaccctgcaagtaaggattttggcggagactgggaaaaagccattcgtcaagcttctaaacaacttggggtagacgttacagaccaagatgtagacacattgcttaaattaattcaagcagagtctagtggagatgaaaaagctgtccaacaaatcattgatgagaacaactttaacggttctggtggtgccaaagggcttctacaatacatccaatctacgttcgatgcttataaagtaaatggacacgatgacatcatgagtggttatgaccaattactagcgttctttaacaatagcaactggcaaaaagacttaaatgcttggaataaccgttaccaaaatggtagtacgggttggggtccaacgggtagtaagacccatgcgatgggtggacatatcacttctccggaacatgctttgcttggtgaggtgccgggacaagatgaatatgttattaacccacatcaacctacagctcctagattactggcagaagcttctcgtaaaactgcacagaaattccgtttgtttggtaatggttctggggacgaatggtcttcccgtataggtggaattaacttatccggtggaggtagttcagcacaagcaccaacattaaacaatacaaatgacgttaaagttagcgtaaccgtacaaggtggcggaacttctgaaagtattgctaatgaaattggtaataaaacagcaagtaagattcttcaatcagccgatgatgcaatgagtttctttacaaaagaaatgaaacgagtttaagaaaactagggggactcgttccccctttatttattgaaggaggtaaactatggcggtagaattacgttatcctagatttaacctagcgttttatacagaaaaagacgaatatcatattacgtatgatgcacagacaggtgaatctaatacttctgtagtaaacaaagataatgattcggaagtttctaataactttatgatagaatccgttatcagtttaacaacaaaaaattcaatggaagatgacagtgctgtcttttcttttgttctagccggagatgtatactgggatagaattttaaaagccaatgatgcagttgtattacggctttaccctgatataaccagtgacctacctgttaacccagttttattagttgggttaatctcagaagtacgacttgaaggagactatggggagaactctaagatgtatcgtattacaggtcaatcatttgctaaggctttaatgcaatttgacctaggtgttattcaagaagttagtgttgtattaactgatattggttggttacctgatgatgcccaagagggggttaagatgacaggtagaagtgccagtcagctagcagaaggtatgatgaaccgtttcttacaatatatgaaatttgactttaacggagaaggcttagagcgctttttagaatgggaattagacagttggacagaagcagagcgtttgatagataataccccgtatattaactatgagggttccctaaaacaattgttagacgacatcacagctaaaccatttaatgaactgttctttgatgctacaccgggaaacaaatgtcgaatgattatgcgtagaaccccgtttgataaagcagactgggagaatttaactacgtatactgtaacatctaaagaagttatttctgagtcagtagcaacaaatgatacagaagcctactctatctttaatatttctataaataacctttatggtacagactctatgatgctcggttctaaaccacaggtattccctgctttagttaataagtacggatacaaaaaactagaggttgataacaaatacttgcagggtgcaattgtagataacagtgataatgcagatagtgcggatacaaatactgacggtgatacagaaacgaacgaagacaccactacagaaagacgtacaactagaaaaaaagatacgaatgaatctagtgcattcgacacgacttacggtacagtaatgaactatctacgtggttacccattagacatcttaagagtgaaacgtggtaatgttcgagctaaaatacttcaagtagacagacgtattacaggaacaatggcagataaaatcattgaccagtatattacaacacagagcttgacaaaagaacagttcacagatataactggtattaatgaaaagaatgctagcaagggaaatggtaaggaaaaacctacgtataaaaaacttgtgaagttcttggaagattacaaggatgaagcagagaacaatgagactaccacaatcaagaatgaacttatgaatgagttcaaattaacagataaccaagcaacatctattgctagtgagtttgtggctaataaaagcttgcgtaaaactcaatatgacgaaatcatgaaaaacaatcctagtgatagtacaacggtatctggttctgatacaaaatacgtaaaagaatttacgaaacgtttagctaactggtactgcgaaaatcctaacttctatagtggagatattgtagttaagggtagtccagaatatcgtttaggcggacgactattcgttatagacgaacagaacaacgaattgtgggaatactatattgaatctgtagagcatactttttcttacacgcaaggatatacgacaaccctaggggtaactcgtggtcttaaaaacggaggtaaagaccgattcacacacctttgggacaagtcagaagacttctcaggaggtatgttgggtgaaaagaccttagaagctttactagaagagcaagaaaagaaaaacaatgagaacaatagtagttctggttctagtggtggttcaagcggagttaacccatctaatattccgggtggtacagtagcaatgaaagctgtaaactggggacgttctcactccaaaacagaatcttcctttaggtctgcgtatgactggggaggtgggcgtacaggtagagacccatttgaaagctcacctattgctacagactgttcgtcatttgtatggtggtgtttcaaacatgcaggtgtagaattgaatggtggagcaactgggatgactacatggagtatcattgcggatacgaaacttgaaacaatagctacccgtggtcaaaagaactctgctatctttgataagatgaaagcaggagatattatctggttccgtaactgtgaacatattggaatttactgtggtgaaggaaaaatggttgcatgtaatggttcaggtaacatgaatgaaagtcctacagcaggtattattgtgtcagatatgacaagtggatactggtgggatacattcgatggagatgtaaaaagatacaattaacctcgttaatagcgaggttttttgttgtaaaaaaacaaaactagtatgtgtgctataatattaagtagagacacatacaagagaaaggatggtatcaacttggcaggaggacgtagatttcaggcagggttaggttccgaacataaaagattatacaaagaaggacaacaaattaatactttgttactagcccaagttatccaagttaattataaatacaatacagttgatttactagcattacagcataaagaagttttccaaaactcctatgccaatgaaggtagattttctgctcgtttaccaatggaatttggtggacgaaaccttgcaggacaaccatatggtcaagtaaaccctattgccgttggtactgttgtcctagtaggttttattaactctgataaagacatgccgattgttattagtgtatacaataacaacgatgtaaataaacaattatcccgtacacgttttgctaatgcagaccctacagatatggctttagcgggacaaatgtatcaaaaatttagtttgtacccatctttaacttacgatagtattgatggggatggtaaccgagtagttacattctctggtaaatcatttattgcattcgatacaaaagacatgcaaaactctccaatgacagatgctagttacggttctcgttatgaagacttaggaacatcttactataacgatggagaactaattgaaccgatgaaaggtcgagcacctaatgtgttgttcaagcaccaaggtattcttgacgatgataataaacccgatacacataatttcatgattcacattaacccagatggaacataccgtacatctatgatggatacggaacaagactggcggacaatgtttgagatgacaccggagggtaaaatccgtttacgtagacaaggggatactgtacgtctaaacgatggttttgaaattggtgaactaggtattaatgaagaaggtatcgtttacttacgtaatggggacatggacttagaagttcgtgaagatggtatctactcccaaggtaaactaatcacagaaaatatcaatcttgatgatatttatgaaaaattagctaatgttacttttgaaattaataagacaaatgagtccttacaaattttaactgagaaatcagagctacaagatggtaagattgtaaatctagaaacagagattacaattgtagccggaaaagtagaatctaaagtaagtgcaacagaagtacaagacatgattgatagctctattgtagacatgacggatgctattaaaaaagcccaagaagatgcagatagagcaaatcaagttatttctgatatggctagtgataatcgcttggctcctagtgagaagctagatttactaaaagagtgggacatcatcaagaatgagtacccaacttatttagcacaagctgaactatacgaagtagatagtacaacttatactgctaagtataaagctttagaaacatttgttactcctttattggaagacatggaagctactagtgtagtagatggttctattatgcgtaaaacatttagtgcatattacacagaacgaatcaatttactaaatgcaatcactaaagggttaaaagatggtttagaagaggcaatgaagaaagcttctcaggcttctgtagatgctacacaagctttagctgattctgcacaggcacaaattgatgcaaacaatgcaaaacaattgattgcagatattgctagtgacggtaagctgactgcttctgaaaagtaccaattgaaaaaagaatgggatgttattgttaaggagtatcctacaacaattgcccaagcaacaaagtacaaagtaaatacagataactatactgctaagtataaagctttagaaacatttgtcactcctttgtttgcgaatatggatgaaacaagcgtagttaacggggaacaactacgtgcagtattttctgattactatgctgtaaagattactttattaaaagaaatcacagatattgctcgtgatgaattgactgattatggtaaccgtattactgtagcagaaacaaaaatcacacaaacatccgaagctattacgttaatggcttccagagtggaaactgttgaaaatgatgttaaaacaaacacagcgcaattgaaagtgcaagcagacttaattagtcagaaagtaactgctagtgaagtaaaagatgctattgataatgcaattgataacatgtctattggtggttctaacttgtttgtaatcaaaacgcaaacagcaggactattgaatgaaaataatggtactgtaggaacagccgtagataaatctgtagtatctaactatatcaaggtaacagctaaaatgccttatgtagcttctttatatggaaacacagggacaaacagtattatcattgcatggtatgacacaagcaaaacgtttatctctggtcaagctgtagctgattctggtgatttccataaaacttatgttgcaccagaaaacgcagtatatgctcgtttaagctataaaaaagctgacactgttaaaatgaaatttgaagtaggtacgaagccaactgattacagcccgtcatgggatgatattaaaggtgaccagactgctttagaggaatacattaaacaggtagaggaacaagctaaacaagcacaacaagaagcagaaaacgctaagaatgaagcagaaaacgcaaatagtgctattgctgatatgtctaatgacaatatgttaacagcaaatgagaaacaacaaattttactacaatgggaagaaattaaaacggaatatccaattaatttagaccaagcaactaaatttggtgtttctgctacgcagtatacaacagcgtacaatgctctaaaaacatatttagacccattattagcagatatgacaacaacttctgtaattgttggttctactatgcgcagtacatttaatacttactacgaccgtagaacaacattgcttaatcgtgtagctgaactagctaaacaagtagctgaccaagctaaggatacagcagacaaagtagacgatgacttaaacaacattggtgggtacaactacatcggattctcttccggagaccatatgtatcctcgcttgatgattaagaatgttggttattactatgttccttctacaacaagtgcagaatttgtagatgatatggtttgtttaaaacctaaaacagctacagctacaagtgttcaatatgacatcggtaactctaatgttagtgtggctaacgttggacttgctaactatcgaatgaaagaagttaaaacaggtcaatggctgactgcttctgcaaatttaaaagttgtgggaacaggtactgcttatctaactatttttacactggaaaatggttcatggaaagcttcatacagcgatagaattagtgcaagtcaaggcgtaacccgtgtagttgctcaaagacaagttacagatgcaactacaggtattttagttcgagttgatggaagtaacataaccgaagttcatttcggaaatacgcagttagaagttggtatccgacctactccttggaagaaatcagatattgacattcaagaagacatcaacaatgttgcagatgacattaaagattacatcggtgctcgttcagataacctaattacaaacggttttggtgagttagggaacaatacgaatattggtggtatctttgatggtgctgataggattgtaggtaaaggttccttccgtcaagaagaaggaaacaaatcactattattcagtgaacacattgttattgacaataagaaagtttataactttgattactacatgcacacattaaaaggtgttggtagaagttacgcaatgattgccccgtatgacgtagacgggaaacgtatcacatttccttctctcgggggacgaaactacaactctattacccctgttaaatttacaaaactagcaaaaccacttaaagtcggagatacagaggtttttgtagaagatgctagtctatggaacggacaggcaccgcaagactaccaacgtagtattatcatgtggggttataaaaactcgttcggctatacttatcccgatggaacgtatagtcagctaatgcagatgaagacatatgatattggtgcagttgacaccacagctaacaagattacgttaaacaagccatgggcagttgcaaacccaaatagttcagatgggattttcccagtagggcatacacttagcccaacttctgacggttccacatatctatatttgaatggtcacgtaaatatacaagtacctactacgtacaccaagtacagccatttgattagtggctcttctgagtttgctaatacaacgcttatcccagtagaaacaggttctatccaacttggattcttgttgaaccgtgatacaacaggtgaaaaatcttggctaaacggtttacgtctacgtgattatacagatacgtataagctaaacgatgacgttagagaaacacaagaaaatgtggataaagcccaagcagatgcagataaagctaaccagtcaattgctgatttatctaatgataatttagttactcctaacgagaaactagatttgaaaaaagagtgggaaattattgttgctgaaaaacctaagaatgatgctcaggcagataaattcggagtaagtaaagtagcttacggtactgcgtatactgctctagatacgtatttaaaacccatcttagcaagcacaacaacgaactctgcgattgttggacaaactatgcgggatacgtttaaggcgtattacacggctcgtacagacctgttaaacgctattgcatctaaagctaaggaattggctgataatgcacaagataccgcagataatatagctgtcggtactcgtaaccttttaatcggaacacaggacttttccaaaggtaaatatccgggtaatgctaacgttaccattacagatgaaaagctgtttggaaatgcagtaatgaagaacgattacactacaggtaccggatattcagatatgtaccaaatgacgacctcaattattccaacaggaactcagtatacactatcgttttatgcaaaggcagacctagaaggaactaaaatgtcttgttacttctacaacccaaatactacgacaagtagtgtaaacagtcaaggtggcaaacttagttctagtgacggtcgtactgtatttgttttaagtgcagaatggactaaatactgggtaacttggacacagacacaggcagacaagcctaagtcagtaattattggtcgtaagactggtggggaggaacctaactctgctttctatatgtcttctcctatgatggtagaggggaacaaaccacaaacgtggatgaaagccccagaagacattgaaacagctataaacggtaaagaaggtgcttgggtttactccccaacagcaccaacaaatccggctgttggtttagtctgggtagactcttctaaaactccgaaccaaccaaaacgttgggttggtggagaaactggatgggttgccttaaccccagaagaagtaaaagatttaccttggggtgaagatggttctagtcttgctgactgggtagcacaagcagagcaaaagatttcttctgatgcaatcattagtactgtactaggttctgaggactttaccggtatttttgactccaaagcaaatacagaagacttaaataaccttgcttcttacgatgacttagatgctatgcaagctgagtatgaacgtctgttaaaagaagggattgcaggaattgacttctcaccatatgtaactaacacagagctagaacaattgaaagatagcttcactttctctgttcaacaagccggtggggttaatatgttgaaaaactctctaggattctctgggacagacttctggcaagcctcttctggtatagatactactcagaatgaacagttgtctaaattaggatttggttccggatttatgataaaccgagttcaaaatgcaacactagctcagacaatcgaattaccagaagcaaaacaaggtttgcagtatgctttatccttctacatgaacgtagctacttttggagatgtcactgatttccaatgtggggcacatatctacgaagaaggtgtgttgaagtatactgttggggtaacagatgctacacaagaaatcccaagtgactatcacttgtataaacttgtatttgaaccagagtctccgaatactgtcattgaattatttgttacaaatggtgcacaggcaactgtaatcatttcaggggttatgtacaatattggtaacattgcgttgaaatggcaaccatacccaagtgaaatctataacacgaacgttaagattgatattaatggtattactgttaaaaacaatcagacagatggttatacaatgattactccgcaagagttttcaggttacgcaagggttaacggggagatggaacgtatctttaccctaaatggtcaggtaacagaggttaagatgttacaagcagagaagcgtattacaatggaacctatttccgtgtttgcgatgaactctaaagaaaccaatacaattggttgggcgtttgttgcttccggagaggttgcacattctgccatagcatctagtacacaatagaaagagggagccttatctgtaaggctctcttttgttgtgttgtgctataattatattatgagaaacaaaacaagaggtgagaaaataaatggctttaagcggtagtacatacacagcttttgcacggcataggcttgtgttagaatggagagcctcccagaatgttgcgggcaactactctgatgtaagtatttggttatacttgcagtctatggattcctatggtgctttatatgctcctgctgttggacaagcacaggtaacagctaatggagttaagcaaaccgaaaatgcaacatcacaattgaatgcttatcagaaaaaactattgctagccaaagtttggcgtgtaaatcataacgcagatggtagcaagtctttttctatatctgctagttactttgtaaacgtaacctattcaggtgtttactacggaacaatctcgataccgtcattctcggtttcattaaataaaattccacgtaaaagttcgttaaaccctgtgccagatttaaatattcctaataaactaggggtaagtattacccgacaaagttctagttttacacataatttaactgtttgggtagccaatagaacaaaccctacattagataatgactcccattgggtgtatttaaacagtattgagaacgtaggtacaagtggtacattcacatttagtgtagcaaacttcacagaaatgttcaagaggatgggtacaagtaccgaatgggtaggcaaggtgaagctctggacgaatggtttaagcgagtcagtgccgagccaacaacgaaccttccgaataaaacctccaatgaacgcacaggcttctgggggtaagttaaaagtaaaagcaggagaaaagattactgttagtctaagtaacttccaatctgacggtaactttaaatatacaggtgtttttgattatcgaggggtatccataccagtagcaacaaatgtacatgcaaactctatgactcttacattaacccaagcaaacgtggattctatcttgaaagaatctccggatgatgcaggaacatgggggcaagtacgagtaacaagttactacaatggtgtacaatatcgaactccttggactggacagcatattgattgtaccattcctaaagaagattacttacctgtaataaacggaacaccgacttatactgacttaagtgccgaagctactaacgttaccggaagtaaccaagtagcattacaaagtaagtctaatatccgtgtgactattccggctaactttgccacaggtcaaggattctcaacaattaaaaccgtgcaagcttcattaggtggggctacaaaaactgctaactataatgcttctggttttaacattgatattggtgctccaaatgaaggtactgcttcttcattagttgttactgttctagacggtcgaggatttagtacatcttggacaaaaacagttcaagtatatccatatagcaatccagatgttaactatacgattgcccgtagaaacaactttgaagtagatacagaattagctgtttcaagtagttgggcgcctgttactatcggtggtgtaaacaaaaatgcaattacgtcagtaacctacgcaactaaacgttcaggtacaagtacatggggagaagaaacaccagtaactttctccacagatggggctaaagttattgtcccaacaaccgttgttcagttacctaatgagtacagttggaatttcagactaactatcaaagataagtttggtagcttctctaaagaagcaaatatttctgccggaaaacctattatgtttattgatgctgttcgtgaatctgtaggttttggtaacctgacaggtacaggagaaaatagaaaccttaatggtgtaattgaaattgaggcggaacgctaccatactacaggtaaaactggtatccaaatgaataacagtgatatttctggtttgaatggaatatatttctcaaatgacgtaatggataacgatggtgaaggattgcattttatcaagtcagggaaagacgttaactcttccaataaaaaagactacgattatatgtatatgagagacggcggattctatgttaaccatgatggtactccaatctttaaagttactgataacggtcgtatgtattatcctgcctctcatttgtggtctggtggttggtatatgtctggtacacaaaatataaccccatcgaaaccaatgtcagagtgtagaaatggatgggtactcatgtgggctaagtatcaaaatagcacacagacatggaatgatgttgtacaggtatatttaggtaaggacttagtaacaacacatagtggactaggtgtaagattactatttggtggttatggtaacgttgttatccataaatatttaacgattactgatacagaggttagaggtaatgcttcaaacaccaatgctagtttaaacgctgacagagctattttagttcgtgttcacgaatggtaaacgaggtggaaacgatgaaaatatacgtagcagttgacgaatataacgtattgactggatggagtagtagttacgaagaaaatctaattgagacagagattgacgaaaatcacccacttattgtctctaatgatttttttggtaattataaactcatagacggtaaattagttaaagatacatctattgaattgttaaatttaaaagacatgttaaaggtagaattagaccaacaatgctcagaagctattattagcggttttagctacccattaacggatacagaaacacttcacgtctcttattcacgaaataaacaacaatactttgaagagattaagtctcttttcgaacgtaaaattgttactcgtattaactgggagtttactactgatgatggagctactattactaaagagctaaatgaaatagaatttttaaccttgtacacttttgctagtttggttaaaacagcaaaaatgactaagcttaaagaaaaactatatccactagttgataaacaaacaaataaagaagacctgttgagtattacatgggattctattcctgatgaaccattaccagaaaaacctgttattgatttaaatggtgatggtgaaataagtcaagaagagttcgatgctttggttaaggaaaacaaagaactaaagcaaaaagtagagtttaacgaattggctttaatggatgcaattaacatgctatcgagcatgagtacaggttaattttaaggaggtgataacatgtatccacacttagcaatgctctatgcaacgtatgtcatgaaagaccctaaaacatggacgatggacaaagttcctgctatgattcgagaagatgtacaaagaattgtagatgaaatgacaaaaaaagaacaagcacccgagtagtctttctaacactaggggtttccattggtttagtcgcaggactagctattgggttcttcctataatgctcggggagaggaagagggtggcttaggctgtcctcttttttcttagttaattgtactatattaatggacgaaaggacgtgataagtgtgggacaatcagatggaatgggtggaacattaaaaagaattgctattcaagttggagacgacccaaacacaggttggtatagatttcaagttaacccaactcaatataaatacagcaaaccacaccgtgtaacaatctttaaaacaaagtctaacattatcactgaggactttggtaaagatattgagaccattcaattctccggtacaactggatttagaaaagactctagaggaatgaacggtgctgatagattaagagaactatctaatttgatagatgattatgcaaatcaaggcggtaatggtaaccgaccgaaagtagaaatgaagttctataattttactgatgaccaatattttgtggttcatttagccccagaaggtctcactatagaacgttctgcggaacagccattactatttacttatacattaagcttagttgtattaagaaaagcgggagagcctgctgaacgtgaccaagtaaacccagaaattgggaacaaaaatccaagtgtaggagacaaggataaagaaacaagaagtggcataattcaaactcctgcacaaatactacatgaacagtataaaaattctgtgttgccaaatatagcagtaaaccctagtggtacatcaggtgcctataactacggtttagttgaactaaaaagattaattggttacggaggtggtcagtaatggcaactgtatatcaatctgcggacttgcttagattctttcgttacttaaatgtaaacgtgcaaggagatgtcgttagtaatgtcatagacgaccaacctaactttatttctagattttacacaccgcacacaagagtgaataaaatatctaataccttattggatattgtgaaagacaataacattagtgaaacaaacaaagagttatccaaggattcactaacctataagttcttgaagagtggactacgattaacagctcctgacatttaccagttagctcaaatcgtagtacttgaatcttttgctttgatttatgcaattgaagaaaaacctgaaatgttcaaaatgattaatgaatcagatgtgaaacaaacacgggagaacgtaaaatatcttgtagactacttaggggagaaaaaagattatactgatattgtaatggatttacattctatggatattgcccttggttacatccaagaacagattccattaattcaaggagggttaccagtaaatggcacgatataaaaaacatacaatcgtttatggagaaaccatgcaatctattgctcaaatggaaacaggttcagtaaacgactggataaaaattgctgagtataactccttggtttatccatacatagtagatactatgcaggagaaaatggctaatattgaacatttagcaacaccgggggatactttggtaattcctgtcgaagctaacctactagacatggacgtaagtaatctaaatcaaagagacatggattttctattaagtttatctctaggtcgtgatttagacatgacaagtgagacagaatactatgaaaatcatggtacaagtgatgaagtgttctcattaacccataacgggcacggagaccttaagacggctaatggagcagataatataaggcaagcaactatctctcgtctaatgaccgctaaggggtctttaatgctacatccagaatatggtagcaacctacacctactttttggtaaaacaactattgaacaaatgaaattgattagcttagaagtatgtgaaactgtattaaaagacactcgggtagctgagtgtgtattggttagtcattatatcgaagaagaccattatgtaggaaactaccgagcaaccatacaatcaacaaaagaccagttcgagtttgtagtacaaaatgatagtgtgggcgcaattgttatagaatagaaaggagtatccctgtgagactaaagaagatttcagaaattttaggtaggctaattgacgtaaccatgattaatactcatgagttaaacgacttctctgtagggtctacaatccgttccatttacgaagctgtatcaatggaacttgaacaatactacatcttaggaagagaaaatattttatggggtatcgaacagggggtactcaatgcttttgattttagaaaacgtgaagctaaacgggcttatggtatggttaccctagaatttcataccgtaacgcaaacccctgtttatgtgccgacaggtacgacctttgactctagcttgtctggtgcacctagtaacttgacatttcaaaccatgcaagactatgtgattcctgccggagttgttactgctaaagtagaggtttactgtacaacagttggttcccaaggtaacattgccaaaggaagaataaatcgggttattaacaacatctctaacctgaaaaaagtgtataatgaatatgacatacttacaggtactgacgaagaaagtatcgaatctgtaaagaaacgtttccatgctttcgtagaatctcgtggtagagctacaatcaaagcattagattatggtacacgacaagtcgaagaagtatctggtgtgtatatcaaagaggaagttggttatgtacgtatttacgctcatgacttaaacggagatttgaaagacgaaacattagctaagattaaaacagctattgaagattatcgtcctgcgggaattaaattagacgtgttccctgtagtcaaattaacagtaccgattgacgtaacaatcacaattagtaataaaaacagaattaacactgcattagaagaacgaatcgaattaactattagaaactacttaaacagtcgtacagtatcagaaacattggtaaaagctgatttacttcaagctatcatgaatattgatgacaacttaatctatgactgtgaaattaataatctgagtggtaacttggatattagagacgaggagattattcgtgcaggagacgtaacgatagaattaatctaggaggtaacattgtgagtaattttttcagaaatatacacccactcttgcgaagaagtaaacgtccggagaagtatgacgatacgaacttcgctgtgttgaatgcgttaaattacgaattaacacaggcagagcaagaaaccattgctagtaaaatacaatcctccttagagtctgctacagatacgtacctagacacttggggagattggttcggggtgtaccgtaaggacggttgggacgatgaatattatcgtgcacgtatcatacgggaactacttcttaagcgtggtacaattcctgctatcattgatgcgttattggatttccttaacgacaatgatgcagtcatccaaatctacgaaccttggagaaacattttctatacaaataaatcaaaattaaacggtgacgaccatttaatgggttactactatcgttttgcaattattgatatttcaattgatagaccgtttcctcctgaaattgtagagattattaaggctttcaaacctgcgggagttttattctatctaagattagacacaagtttaaataagaataaaacaactgtagaaagtccatatgtatatctagacgtgacgaataagacagaattagagttctttaatggtttatattatgacctacgaggtaatattaacctgtctgaccaacgtacacaagttgtagagaacaatatcttccatacgaataactctatgttaaacggggaagatgtacttgcaggagcatttgaccacggaagaggttacattcacttagcaagtacaacattgcttgattacacaccaaaacctactgactctatgagtgacttaaaaacagctctaggagagtcaggtgctgacatgtataatcagacaaaagaaaaggatggaagaacagcttctattcaagtacctgcaacaaggaatgtccatacgttatactcaaatagtatagattttggtgactatgattatagcggaaaccctaatgtagctgtaaccgatgcagatacgttcaaattaggaacaggtggaactcttacctataataacggggagtacactgttttgatggatgggacagctagattaagtaaatataataccgatggtaaaaacagtgtatacttagaagataaggtaacttatacaatttcttgtgaaatgtatgttggttctgattataccggaaatgttgaccagatatttgctaactatgcgtatcttgatggaggctatactgtactgcaaacaacaagactccctgcggatgctcctagagatacttggataacagtaaaaggaacatctactatgaactatcaagggagagtacctaaagtattgtactttagttggcaaacaattgctagtgatgttaaccctactggtacacttaaaatgcgaaatatgaaaattgagcgtggagaaattaatactccttaccaacctaatttattagtagagccattccaattatctaatgttcctttaaatgataatttaggagacccaaacgtatctttcccaattaacacacaaaattcctacttagtgtatgatggcaccataaaagaaaattggcaagctaacacggtgtataccttaacattaaagggtaagaaattaaatacacagagttggaaaccgtatattgatactaaaaatacttccacgcttagtaaacctcttttaactcctgtggaggggttaccgaatgtttggcgcagtacatttatggtctcccaaaatgatatagacaccggacgggttcaaaaacagttaagtatctaccaagcacctagtgcaacaaggggtacagcttcaattgaatgggtgaaacttgaaaaaggtgctattgctacaccacctatcgaacagtatgcctacacaggtactcttgtttcaggtacaccttctaaaaaccctaaagattatacatggggaagtttatctcctgttttaggtaaaaaagcctatatggtgtttgatattaagacatttatcgaagaaaattatgctatagaatttgaaaaacttattactgacctaggagaagaccaagcattaaatactgtgtttgaaaactttaacatctccacagcacttaaggctttagtaagtccaagttcaccaattaatttttcagttgaactatacgatttttctacgagtgcatggcacaaactaaacacggatagcttagacctacgtatgcgtacattcaacttagtagcaaaccgtatcacagactatctaaatgattacaaactattatttgttcgttatgtgtttgataacgaaactgataaagatgtaacagttgaactagacatgttaaatgtattgttcaactatcgtttaggtgacggatatagtttagggctacaaagtactgtagaatgtttaagtgaaattccgttaactggtattaccctttctagtgatagtgttgaagttgctattggtgaaacagcgaaagttactgctactcctgttcctgccaatgcaactaacaaaagtttagaatgggaaatagcagaccctaagattgctactgtagatacttctggtaatattacaggagtagctattggggaaaccacattaaccgtgtatggtgaagacaaaaccattagtgctacttgcagtgtgtctgtaaaagctagacataccctatactcaaacagcaccgacttcggtgattatgattatagtggaaatcctaacttgctaagcaatgtaaccaatgatagttggacggctgagggtgctatgaaggtgaccgcagtagatgattacctagagttagtaaaagatactgctggacgttttggtactgcaaagatttataatataccagcattgcgctcagactcacaatatactacttctttagaattttatcttaagtcaggcacctctgttgaggatttaaaaaaatgtaatattgctatcgaagcaactaatacaagtgggcaagtttattatagtgttatttatatgaataatataccgaagatggatgaatgggttgatttaacaagtacttttactacaaacacctatacagataatcttaccgactggaagtttagggtgtatgtccatccagatgtttccgcttctatgagaattagaaatagcattaagattgaaaaaggttcgacggctacagcatatcaacctaacttacttgatgacccttactggttgggtaaagttcctttgggtgagaatattgctaataaagatattcagttcccaatcaaaaccagtgaatatctcgcatatattgctagaatgatagaaccttttattgtaggagaaacttatacaatcaccataaaagcaacaaaacccgctagtcaaacatttatggtttataacagtggggaaggaactacttactatggaaacctaaaaccagttgagggattgacaaacgtatggtctctaacatttacaccaaataatgtttcgtcaagtaatcctagcgatttacgtatttttcaatatccatcatcaactaaaggcgatgttcaaattgactggttaaaaatcgaaaaaggtgacactagaactcctaacattgattcctatgcttatcgtggtacagttttaactacatccgaagaatcaccaaaagaccctaatgcgtatacatggtctagtatctaaataggaatagcagaataatatgctataatataaatagggcacgatgctgtgccctattttttaattgaatgctatattatctaatgaaaccatagaagaaaagaggttataaagtggctattgcaactaataattcccgagtgtatgcttcattacaacttaaaaataaaaaagatagcatgtacttagttatcggtaaaacctcaccttggacaaatgaagatgccccacctgctacagaccctaatacttcaacattacaagaagttgttggttacaaaaaagtaagtaaagcatctctatgtcgtgaatacgttgcagatgacgagaacaagtacccagtgattagctacggtactcgtaaatttactttaataccagatgaggatgcttataaagaaaaagcatggatggtatatatcgaatctgaaatcgtaggtgacgaattacctttaggtacatttagacaagtaggacttcacactgacctagtaccaaaaacaggtgtagataaagatgcgttactacctacagaagtaacaaatgcaggtattttacaattctttgaaaacagacaacaacaaaacagaactgccgatgtaacaatccgagaaaaatttatcgttacaatggaaaacggcaaaacattaaaagcgtaagagaggatgacaagcattggcaaaagaaattacaaatgatgatttaaagaaagcgccctaccttgaccgctttgaccctaacaagaatagaacacgagtgctattcaaaccggataaacctcttcaacaagcagaacttaatgaactacaagcaatgcaagattatgcgttatccaatgtagcagagtccgtgttcagtgatggggacatccaaacaggtatggagtatattcttcaaggaactacgcttactgttaaaaaaggtaaagtattccttggtggtaaaatgcgtaactttaacgagcaaagtattgagattaccggtacaggtactgagtatattggtgttaaacttgttcaaaaggtaattaccgcagaagatgacccaaccttgttagaccaaacaagtggcgttcctagccatttctcagaaggtgcagaccgtctagaggaaacagttgtactaggagtaaacgatgatgaagcttcaaacatttatcgttttgagaacggtcaattatatattaacccagatacaccagaaatggacaaaatcaataaagtattagcagaacgtacttatgatgaatccggttcttatcgtgtacgtggatttgatatgtatacagaagtacacccaacagaccctaataacaaaatccaattagttattgactctggacgtgcatatgtactaggttttaaagtagacaaacctacaactactcgtattgatattgataaatctcgtgatttagaaacaatcaataacgaaggtttctactacagtaacgaaactcgtttaaacaaactaggtaacgcacctgtatctagcgtagaccgtgtaacagcccaagtggaagttgcaaaagaacaagtgtctcgtggagttgttggtggaggtactgattaccttaaaaatacttcggtaacaaaagttgttcgtgtatggacggaaggttccggagcgcacgaatatagacagggagaagatttccaattagttaatggtcaagctatctcatgggcacctacagggcaagaaccacctgccggaggtacctactttgtacaatacgtttacaacaaaacaatgattgaaaacactgattataaagtaactgttaaaggtgaaggagataaccgtgaatggtatattgactttaacgaaatgacaggttctaaaccagtagacgaatcattagttaacgtagattacaaatacttcttagctcgtaaagacttaattgtgttagaccataacggaaactttactgttcataaaggacagcctaacgcaatgcgtttagtagattctcctaaccatattgacccattgacactgaatattggtacagtgcttgtttacccagattcgagcacggcagaagctaagcaatggacaatcactcggttaacgatggaagagctacaaaaattatctgtacgtgtagacaatatggaatacaaccaagcggtattctatcttgaccaacctgcgatggcaggagaaaacccaatctatttacgtggggtattctcagatgcgtttatctctcttgataaatacgatacaagtcatccagatgctacaattgcctttgactttgatacagcagaaatcacactgccttatgcagagattaataaaactgtaccatccattatcgaaggttctagtgaagcacatgtatggggacggttagtaactgcaccatttaccgaagaagtcggaattagacaaccatttgctacagaagcaatgaatgttaacccatacaatacgttcaataagcaaggtgttctaacactaaatcctagtgcagataactggattgaagaagaacgtatcactatcaccaaagaagaaacatctacaatgactattcgtcaatggtggagacacggtggagcttcttggacaaatgatgaaatgaaccttgtatctaacgtagacctagacaacggtatgaattggagcgacctaaaagacgactaccgtaagtctggattgtctggtactacactgtctagtggtggacaacaaacaaaagagtctatgattgagttcatgagacaaattgacgttgaaatctacgctgagaacttagagccaaatgcaaacaacttagttgtgtcatttgatggactacgtgtccctgtaacaccatcttctggttaccgtaaaggttcacaagagggtactggtatggcaaatgctgatggtacgttcaaaggtgtattcaagattcctgcgggtgtacgctgtggtactcgtgaagtatctattcgaaatgatacgaacttagcaagtacaacgttcactgcacaaggaacaatgaaaactactgaggacatcatcatccgtactcacgtaacaattaacctagttgacccgttggcacaatcattcagcttcaataccaaccgtattgctacaagcttcgatgtgttcttcgcttctaaggatagcagtacaaacattatctgtcaagtacgtggtatctcagaaggtggtcaaccaaacaaaacggtttatgcagaacgtgtattaaaaccttctgaaatcaatgtatctgacgatgctagtgtagcaactaagattacatttgatgacccattgatgtgtaaagcaggtcaagaatactgtttagtgttcattactgactctgataaatacacaatgtggattgctacaatgggacaaaacagaattgatgacccaacgcaaagtgtgaactctaacccttacttagaaggtgtgctttacagttcatctaatgcgagtgcatggtctattcaccaaatgtctgacttgaaatttactgtttacacagctaaatttaacgaagaagctgtcttggagttcgatgtaatgagaaacatcaacgtagaccgtgtggttcttatgtccacatatttaactcctgcgaatacaggatgtaaatgggacatgaagattgttcttaacaatgaaccttccggaacaaccgtcaacgacaaaccttgggttccaattgcgaactatgtagacttagatgttaaccagattgctcgtgaggttaaacttcgtgcaacgtttaaagcaaaccaatatatttctccaatgcttgcattagacgatattatgtttgccggtttcttaactgccttgaagggtagctacgtatctcgtacaattgatttatccgaggctccatacaacactgttaagatgtcttacgaacagtttactcctgccggaaccactgttgttgcaaaatacagtactgacgaaggtaaaacatggaagacattcactactcagcctacaacaacacaacgtacgcaagatttcgttcgtgtagactacgttgagaagattaatacgggtggaacatttaaatccattaagttccgtcttgacatgtcaacccagaactcattcctccgcccgagggtgagacgcttaatgacgaatatgaccgacaaatagaagatgtaactgtaatgtaacatttctatgcctcttactgtggtatacttattgtatacgaaatagtaggaggttttttaatggttaaagcattacaattagcaggtactacatttggtaaatggtacgtaaaagaacgagatacttctaaaaaaggtagagcatactggatttgtgaatgctcttgtggaagaacagttcaatctattccgagcggtactcttactacaggctcatctgtgatgtgtaaacaatgtgcaaatgagaaatctttagtgggtaagacttttggtaggttgaccgtcattaaggattcaggtgaacgagcaactaatggtagtatcctttgggagtgtaaatgttcctgtgggaagacaagccttgtcaggggttcagagttgacagggggtcgcacaaagagttgtggttgttactccacggatgtactcaaaaaagtagccactaagcatggattgtctaaagtgaacggaaaacccacaaaattattccgggcatgggcttcgatgaaacaacggtgttacaacaagaaccatgcgagttataaggattacggtggaagaggtataaccatatgttctgaatggcgtgaagactttgaagcttttcataattgggctatgactaacggattttccgatgacttgtctattgatagaattgacaatgacaaaggctattcaccagataactgtcgatgggtagatgctaaaacccagattcgaaatagacgaaatacagttacttatgagtggcaaggaaaagagtatactcgagctgagttaagtaggttgacaggtataaatgagcaaaccattgcttcaagattgaacaaaggtttttcccttgaagaagccctttcttcaaaaataggcacttctgtattacttatgacctataaaggggagactaaacctgtcaaacaatggtgtaaagaactaggattgaactatgcaactgtacgtaacagacattataagggttggactgatgaagaagctttgactggtatacgtaataaatagtcaaccaagttgaatagcctctatatgctatactaggcatataggggttattttttatgtaaaggagacttattgatatgccagaatcatttagacaaaaatcatcaggagctttaatttttagacctacagtttctgagaaaatccattctaaccagatgaaagctcttgctaaagataaagagaaattgaacagagacatacaagaggttaataatttaaaacaagaattgactaaggaattagaagaaattagagaattaaaaaacaagttaaaaggataaaatgtcctattttaattttttgacctccttatatatttaatattatatatttaactatttatctaagttataagtatttatatattatatatttatatataagggaaccaaaaatggaaaataggacattgacatacacttacagtactggtacaatagtattgtaaggtgtgagacattattaggaggacttatgagactagtaatagatgtaatgcacactcagattagatttgatgaaaacgaaggtagtcttcgtagcactatacatagagtaatgcacgaagaacttggagtaaaagcagatggctatcaatttagtcctgcatataaatcaggttactgggatggtattattgatttttataataaagacaacgatacatttcctacaggtctagtacctaaagtagaggaaatcctaggaagactacaaactgctatgggtagtagaggttacatgtttcaatttgagattattgatgacagacctgacaaattcatggaagttgaagaaatggactcagaaattaaattgaatggtgacaatggagaaataattactctacgtgactatcaatatgattctgtaaaaagtattattgagaagcaaacaggtattatcaatgttgctactaatggtggtaaaacagagattgcttctggtttaatacagcaaatcctacctgctttagaatcgggagaaaggattgcattctttacaaacagctcctctatcttcactcaatctatcgaccgtattgaaaaacgattaggcattaaagtaggtgcctttggagcaggtaaaaaggatattcaacaagttacatttgtgatgattccaacaattacctctgctatttcagcagacccagaagctaaacttaaacttacaccgaaagagcgtatgtacaaaaagttagctaaagagattgctcctaagttccttacaggatttaatcaaaaaggactacttgaaggttacatccgtaacttccaagtgaaaacaaaagctgatttacagttgaaacatgaattggaagaggcttactacagttgtggaaccaacaaacaggtagtgatgaaaatgcgtagttatcaagctgagtatgaaaaggtagtcgagaaaaagaacgggaaggtcttgaagaaatacaacgaagcaaaagagtttttagaatctgttgctgttatgattgtagatgaggcacaccatactagttctgatacttggtaccaagcactaactgcttgttctaatgctcagtatcgtatggctttaacaggttctattgacatgaaaaaccatgtgttatggcaaagaatgcaagccatttttggttccattactaccaaggtatcaaatgacaccttaatcagtttaggtcactctgcaaaacctaaaattaccattttcccaattattgcccctacagacatcgaaaactccaattacatggatgcttacaagatggggatagtggacaatgtatacagaaactctttgattgctaaacttacaaagaaaatgtatgagagtggcagtggtgtactggtaattattaatcgtattgaacacggggaaacgattagtgagttattagatgcagaaggtgtaccacattacttcattcacggggagcttgataatgacttacgtgatgaaaagttacaagaaatgcgtgacggacatttgaaggtgatgatttcctcaacaattattgatgagggggttgacatctccggtattgataccttaatattaggtgcaggtggtaagtccttacgtcaaaccttgcaacgggtaggtcgtggcttacgtaagaaaaagacaggtgaaaacaaggtatctgtttttgatttttacgacttgacaaataaacacttgaagaaacattcggaagagagaagaaaaatctatgagaaagaacaatttgagattgttgacatccctcttccaacgaaataaacgaggaggtacaagatgacaagtcaatgcttaacaaatgaaattcgagcacaatatagtctaggcaacggaattgttgagttcgttgaaagattagctaaaaaagcacagcaatggggagaaacatttgctacccctatacgtaaaacaactgtagctgaggagatgggacgtgacacacgtactgttactcggtatctaggacaacttgaagagttgggtcttgttagtacagaagcaaaacgtggtagaaatggaggaactgttgtcgtgtttaatactgatattttaaattttgaaccaactgataacccgattacttcggagacaaaggaagctaaggagattcgtgaacgtgtcttcccaaaagcaccaactccgaaacctaaaagacggtaccgtacaaaattagagattgcagaagctcgcattttagaacaaaagcaaaaaagctttgaagaacgcttaaacgacttacttgaacgtaccttcttggatagagacttttttgataatttcgaagaacctcgtttgtatttccaagggtatttaattgcacaaatgtacaatgcttatgcagttattttcccaaagaatagacacgagttctttaaagatattgatgtgaaaaaatcagaggaaggtttacgtagtatgaacaaagctaaatcatacaacgtgttacctgctcgttttgtaggaaccccacagtacaacaaatttgttgaagtagctagatactgtaatgagaataatattaacccattatcttatctaactgttcaatttgagcgtgcggagcatttagccgacattggtaaagctcgtgtaggggctattccttatgtaaacactttactgtgtgaagaagctcgtaaagcttattctgacaatgtaatgttttatcgtaaaatgcgtaatagctttaacttattcggtatgagtagtagttctgttccgtataaaggggctaaatatgagattattgtagctctacgtactgcgtacgaactagatagaacaacaagagatacgtttaactacttattagatgaattagttagtggtgcacaacaatcagtgaaacaagcaactttgttaggttattacaatactactttaaatgctttatcagaaagtgagttagtagacgaagaccaacaattaattagagatttcttaaaagagcaagtattgttatattcacgtaagaactcattgagcagtactatctatgctttagctttcccattacaaattaacgctgttaattcagttgcgaccctaaaaggtcttgacaaagagatgtattacacttatattggtaacatgtacaaggttacagatgttaacgatgatgaatacaacagtttcacggaacgtggtcgaacaattgatttctcttacaatgctaatgatactttctttagtacaatgcgattaattgcagattgtaagggtctaggagttccggcaggtaaactaggaagcgccttacaaaaattcggtgaagaaaaagttccgttagatacttttggtatgttagatattgaacgtatctacgataaattgattgattcagatgagttagccaaagaccgatatattcaagacaaagatgcaaccatgatgagtatggttgtaactgacgaggggtagggagaaaagcagaatgagtcaaattcacaaacaaaccatttataaagccattagtgaacctttgttcgcaaaggatgtttttagtcgattaccaattgaagattttaaagaggatggatacgacatgattgtatccaccttaaatctttattatcgtacacatgatgctccactagaggaacaaacgttgttaactcttgtggaagacaaaatgttgaaacaaaataaaagtttagaagcacagcaagttgcttttaacttagtaagtgacctttataaattagaggaagcagaaacagattcagaagcaatcagtgaaagtgttcagaattacgtacgtaagaccttaacacgtgaagctatcatggaagctgtaacgaatgatggagcattaggttctgaccaaaacattcagagccttatggagtctttgcgtggaatcatgacaatcgacacaggcggacatggagcagaacttttagatttctttgctgatattgataagaaaaaagaacatctacgtaatttacaacaaaacaaatatccaacaggttttatggctattgatgctatctctgatggtggtttagcccgtggtgaggttggtatggttattgcacctacaggtggtggtaaaactacttgggcagtaaaccaagctagaaattatgttgtacgaggtttaaacgtattgtacgttcctctggaagaaaaaattgaccgtatgattgttcgttttgagcaacttctatctcaacaaagtaagaacagtatcctagttgatggggagttaaacgaacagttatatgaacaaattcaacaagcctatggtgcatgtaaagaacaattaaactgggggaacttatggattcgtaagtacaaaccacaagaattaactcccagtggtttgtcccaattgatttctgatgtaatgattcgtaaaggacaacaaattgacgtagttatcattgattatcctgatttgatgaagaatccccattcaagtggtggtaacggagagtcggatgcgggcggtaaactatatgaagatattcgttcaattgcccaagaatatgattttgtttgttggactctatctcagttgaaccgtgctagttatggtcaagaagtgaagaatgccggagcaattgagggttcaaaacgtaaaatgaatgcggtagaattaatcttcacacttaaccaaacaccagaagagttccaaagtgggtttattcgtgcttacgtagacaagttacgtaataacagtggtgtagcttatgataaaatgttgtactttaaagttattccggaaacaatgacaattcgtgatgagacccaagaagaacgaatggctcatgcgaacttgttagaacaaacaatggaagtagctagggataactacaagaaggaaaacaattttacaccaaaggatgcccaaagtaaaattaacaatttaaacgcacagctagcgggaggtctaaaataatgaaacacattattaacttttctgattttcatatgcacttttttaaggacttctctaagccagatgctatttatgggactgaccgagcaaaagaacaaataaaggttcttgaagaattaatgaattacgctcgtgaggttaaaggagacgttttatttaatggagacctgtttcataagcgagtttctattgatgtcagaatattcaatatgatgttcgaggtatttagttcatatccagatgtaccaatcattatggttagtggtaaccacgataaggtaacgaatgctctagcctctgacagcgccctagaagcgtttaacgctttacccaatgtaactgtcatctctacaatggaaaagcttgtacgggacgaatacacgctctatggagtaagctacggggaagaagtagatgaaatgaaggaatggattgcagaggaagctaaaaagctagaccctaacacaatcaatattctttgtgctcatatcggtgttgatggttcttctactggacagtattctcatacacttagtggggctttcaaggtagctgacttatatcctgataattttgatattgttacgcttggtcactatcataaacgacaattcttaggtggactatctaatgtattttatgtaggtaacaccttacagacctcttttgctgatgaaggtcaagctaaaggctttatggatattaccttagatggtaaagaatggagtatggaatttgtcaaagcaaactataccccatttatgactgtaacagcagatacagtaccagaagacttaagtggagcatttattcagtttgttggtaacgttactgaaaccgaagctgttaaaaagcttaaagaagacaatgacttgtctaacttacgaattaaagtgcagaaggactattatgtacctccacgtattgagattacagcaggttctaccccagaagaagttgtacgagcattcactgataagaaataccctgacttacaggataaggctttagaatgtttacgtatagctacggaggtgtagaattgaaaacaaccttagaacgtaatagacaagaacatattgattatatactcaatgtaaacaaagaagttggtattatgcaagatgacccattcgttttatcttatttaaactctatttctctagacgaattatacgaattgagtgaacttgctgaacaaatgtataaagaatacaccgaagttaaacttttagataaagcacttaaagagatagaagaaattggtgtaactgcttttaaagaaaaacatggaatttaacaagattttaagcccagaacattctgggcttttttggcatacacccttgacatgtaagtgcttgtaatgtatacttatgttagtaacagacatacacttacaggaggtaaaaatgttaaagtttaaacgtgtaagcgcaaagaactatctctctattggagaagtatctatcgacttagataatcgaggtcttgtcttaatcgagggaattaatgacacgaacgaaacgtttcagagtaacggttcaggtaaaagtacgttgctttcaactgtcacttatgcactatatggcactacacctagtggtttaaaagcggatgctgtaattaacagacaggtaaaaaagaacatgtctgttattttagagtttgaaaaagacggcattccatacagaattgaacgttatcgtaaacatagtaaatttaaaaatacaacgaagttatttcagggagatactgatttaacacaaaaatctgtagctgatacagacaaaaaaatcttagacattttcgggattgactaccttacatatgcaaatagcatcatgtatggacaaggaaacgtagaaatatttgctactgccacagataaaggtaagaagcagatattagaaaatctggctgatattggtgtataccgatatgcacaggatgtagcaaaagaaaaagaaaaagaagctaatgccttagtagaagaacttggtagacaacatatgaccaaggtagctgaaatcgaaacattaaaacaggtttattctagtgcattagagcaatatgctaatacagaaagaatgattgttgctcggaaacaagagtatgaagaagccagagtaaaatacaccgaggcagaagacatgctcactcaaatggaacaagaagtaacaccaaagattgaacaactaactaaagagttggaagcttgtgcagttccagaagatagctttgcaatatcagaggaattgcgagaacagcaggctaacctgtttaagttaaatcaagcaaaaactactacacaacaagctattaataaagcacaagtagatttgagtaacactgagcaagctacaaattgtcagttatgtggtgcacctttagatgcggaacatcggcaaaaagagatgttacgattgcaacaagaaattcaggagaaacaagctttcattacacaattggattcagcaattgttgcttactctgatttggaacagaaagctaaagaaaaacaggcaagggtacagcaagaagttaacgaagttgttacaaaacaacgcaatatacagtcagctattaatgaactaaacaatcgtttacgtacggctgaaaatgctgtagcacttacacggaacaatgtaactaatctatcaggagccttagctcacttagagggcattccgaaaccagaatatgacacggaagcggaagctcgtattaaagcagaaatggaagacattactaaacgaaaagaattagcagaacaagaagcaagacaataccatattttagcactagaagtcttctcaaataaagggattcgttcggaggtattagacctagtaacaccattcttaaatgaacgagctaatcactatttgtctactttatccggttctgatattgaaattagatttagtacacagacagaaaatgcagacggaagtctaaaagataaatttgatttagaggtaattaacggttctggtggagacacctaccaagcaaactctgagggtgagaaaaagagaattgacctagctatttcttttgccatccaagacttggtacaatcaaaagcaaacattgctgtgaacctaggcttatacgatgaatgttttgatggcttagattctatcggttgtgaaaatgtgattaagattttgaaagaaagacagaaaaacattagcagtatctttgttattacacataatgacaatctcaaaccattgttcgaaaatgtagttactatgcaaaaaacagaaggaaactccttcttagttgaaaagaagtaaggatggtaattacatgaaattatattcagtagataaagggcgtaaccttggaacggtactcgtcccaacaaatgtaggatacacacaacgtttagacttcccgcttgacacattgtttgattggtacccatgttgcccaagatatgattacaagtacagtgatacacgagataagatgtacattgtaatgattgaggaaaatgaaaagcttccgttacgttacaatgttccgtctacaaaaaaacgtgttaagtcaaaaacagcttgctttattacagatacttggtataatcaagaagtagctaatgacaacaagaagttatttagctttgctgaaaactatgacattgtaactcctaacaaagagaattatactctggaagacataaacaagagtattgaacgtgtacaggacattttagacatgctgtatacagttcaagaaaaacaagtagaaaaagacttgattgttcgagttggcactttggaaaaagaagctcctgattcagaagaattgaaggcagtgcatcaggaaattaaagaatacatgcagttagaccgagagggaaaagcttcacatgtattaagcttattgccccaacatgccgaagagttatatgcaaactttggagaagtttacacaatgttaaatctaatgaagaaagtagtgtaggaaatgttctcagaccttctaacaaatgaactaggcataccaaaagacattgaacacgaattgcgatataactgtccgttctgtgaaccaaaccatgactataaactatatgtcaaggttagtgatgatagtacgaatggattgtggatttgttttaagtgtggtcgtaaaggtaaccctatatcgtttgtaatggaatactttggtgtctcttttgaagaagcattagagattctagagggttatggttacagattccagaataagaactacattccaaaagatgattcattaacggatgaagagtacttattgttactacttgatactgtagggaaacctaagacggtagaggaggaagaagaagaaaaactcacgccccctcctttaccacaaggattccaactattatctcaaaatctatacaatccggaagcatacccatttttagtttattgtcataaacgaggttttactttaaatgacattatccgacacaatattgggtatgtactagacagcacagtcaatcttccatcaggaagacagattaggttgaagaaccatttagtatttcttacacatggtgacgatggacagtatcagtattggaatacacgtgcgattgctgatagttatataaagtcctttaatgcacctagtaaggacggagagtactccaagaagaatactatattcaatcttaacattgcatgtaaaactccacaagtagtcattactgagggagttcctgatgcactaactttaggagaatctggtgtaggtacatttggtaaacaggttacagatgcgcagattaatttaatacttaagagtgttgctcctgagcaaccaatttatgtgtatctagataaggatgcaaagaatgagataaaaaaacttgcagagcgtttgtatgaacgacataaagaaacttatattgttataagccctacagacaaagacccgaacagtattggtaaagagagtgcttgggaaattattaagaaccattctgtaaaggcagacggtgtaggtataatcaaattgatgttataggaggtacgtatgagtaacattaagtatgaagtacattgggtgcatcaccaattaggggtagataaaacacatggtgtatttggaacactagataaagctattgagtccatctatgattggtggacacagaatgactacaatccaccatatgttcgtatgtggacagtagatggtgtaactacattggactatgggtttcaccacatgttttataaaatcaaagaaataaaggagactaatgaattgaatccagtagttaagtttactaagagtgagggagccattgccccaaaacgaggacgagaagctgatgtagcacacgacttgtttacagacaaggatgctgtaattttaccgggaagactgggagcaacagtagttactacaggaattagaacagcttttgaccctaatttatatggtctgtttatcaacccacgtggtggcatgatgaaatacccattaactctaggtaatacacaaggtgttgttgaaggagaataccgtggggatgttgggcttcctcttaagaatactttctctttacaattcggagaatatactaacgctactcgtgttttagttattaccgaagacggtaagcttgtaggaaaaccagttaaagaagtacgtgaaagctatccagaatttgataagctttatgaagaacagctaactaaactaggtaatgagctagatttaatctatgacaatatatttactggtgtttctgaaacccatgttgttgcaggaactatctttattccaaaaggtactcgtttatgtcaagcattcttgcttccacgttacgctactaattttgttgaagtagacgaattagacgaaacagaacgtggtgaaggtgcatatggttcgtctggtgttaaataatggctagtcgtataccggatttaaagatgccacttctttatcttgtaggaagtgcttctattggtactcgtgagcgtggctgtgatgtaacagttaccttacgagacttttatgtagacacccctgatgacaagttagagcaactaataactttgacgtacaaagaagacaaaattgaaaattttacacgacttagtgcagataaatgttcatttcgtgttatactaggagagtaggcaatgaaagaatcaccaagtgtaaaacttacagaaactcatacagttactcttgtaaacactgacgtacttaaaataggacaggttattggctttagagttaacagtcctaagcaagtaggtgcagaagtagtagatgtttattccgaagctgtcggggttattgaacgtatctggtcagaacgaattgaggtcttaaacctgattacaggtggtcgtacagacctatgggcaaatacgttcgattggagagaaattgaaatactgtcagatgcggaacatctgttggaggcatataagaatggaatttgctgagtatttcaataaaatgcaagagcactatgcaaaaggtgaaactgttgaggtagaaaagcttgttaaaagcgatggttcaaaactagttacctatgctgagtttgaggatgctttagctactgtagcacaggttaccacacttgctattgaagaagcattccaagcacaggaagctaagtttggtcttgtactaaaaacattaagagaacaaaaagttatctcagaagatactgaaaaagctattcttgctgagtttaataatataaatgaacttatggaggacgacattaatgagtaaaaaagcaaaacgtgtaggatttatttctgaggaagatatgagaacatggacagagtatttagctacaggacatgttcatgataaaaaccatgcaaaacagttagaacgtttaagtaaacgtgatattagcttaggggacgtagctactgtcgtagatttcatgtcaagacgtaatgatggttatatcactgctctaatcgaacaaaactctgttaatgaaaaattacttaataaattgggtgtaacagatgaaatgcgtaatgaagcgaaagccgaatacgaagttgaattgaaacaagcacaggaagaaattaaaaagttacaagaagagctagctgaaaaactacaaaagggtgagtaatatgagcacacatgaggaattacgtgaacttggtttagttgacgaacaaggtagcttaaagatagaagctagaaaaacaatggaaattccgttacaagctttagccgatttattaaacgataaggtatccagtgattctggggtatacgtaagcgactgctttcaaagtgttatgattcgagaggaaagaccttatcgagtagttaaggggttgcatgatattcctacgttggtattttcgggaacagtttacccattggatagactaacctgttatccagacattcataatattaattatcaggatgtaagtttatttaaacctgttaaagaggagcatgtagaccaaataattttcatggtacaaaacctttataatttgaacaatagaaacaacaatttgtatatgcagtttaagagataccaatgtggaaaagttacctatgaagaaataatgaacacacttaagtctaatatggagttctggtctgtacctaattatgtagaatcattagttgaagagtattatgtgaacccacatctattcgatgttaaaacacctgtagaacaactaattgaacaagtagaacttattgagtctagacgtaaacgtgttaaagaaagggatgacgagagtacccatgactgattacagtgcagtaggaagaaagtcaaagtctaaaggtgctcggtttgaactagaaacagctaaaaatttatctaagtggtggggacatgactttcaccgtgtccccgcttctggtggcttacattggaaagggagtaacaatgttgttggagatattgtagctcctatagaggcaggatttccttttgttgttgaatgtaaaaaccgtgaagaatggactatagagaacttatttctcaataataaagaaataaaaaattggtgggcacaggttgttggtgatgctaaagaatctggtaagattcctatgcttatctttacccgtaatcgtgctaaaacttttgtgatgatggcttacaacgaagacctcatcaaagaaatcgaagaccgtggttatcctcttatggtctctaatgtagagtatgtagacgggtataaagatacccattgttataagacatttactactgtgttagaagctattacaagctttaaacctcgtaagagccaaggggaagaacatctactccattattttaacccaaaagagtatgattggcaaaaatctggtcttgtccgagaaacaaaaaagatggaagaagcaaaacaacttgatgttgaggagtctttggacttacttgttaattcctatttagaaggagaaaaataatggcagaaagaaactttccagaagctattaaaacttactattcttacttacgtgttcctgatttaaaagaacaagtatccagtatctctattgattttgtagagaactggacaggtcaagaagaacggtatgtacttgatacgctcacttctgaaattaagcctcgtttatacagcttagaaacagcgtatatcattgagggcttttcactaccggaaaaagaagttgacgtaaacgtagatgaattgagtaaagaagtagccgagttctttaaaaaagcatctacagacttgaaagaagcaattgaggcatctaatgacaatcaaccaagtcattcagaagatactgaaccgattaacgattgaccaattagaagtcactcctgcgatggtagacgttgttctcgaatatctacccgcaggattgcttttaacagccaataacgagggttgggatgcggtagagcctgacctgcaagaagtggttatttccaatttggaaaaaatgagaggagcatctaaatgattgaatcaagtaatgtaaatcatccaaaacactatacacagggaggtacagaagtaattgacgttattgaatacctaacttctaagtatcccccatcaatccgttactcattaggtaatgtgattaaatatgtttgtcgtgcaccgtacaaaggaaaagaggaagaagacttaaataagggtcattggtacttgaatcgcagtcaatcagatattactgcaagcgtaagtaaaactacgtgctctattcctacttttgacatggaagctttcatccaagatactgcaaaaggctatcgtgaagaacagcaaccattctttaaatccattatgtacatgttggatgatacagaaggaactcctgtgttccgaatactaaaccttgttgagcgtgaccttaaggctcttaaaattgcatagttactactaggtagtacagagttttactccttttgcttgtaaggcgttcctgtcagttatgttataatagagataggaaaactaaatagcaaaaggagtttaattatgagtagcacacctcgagtaaagcggttaaatatctataataccgaccgacactttaatataaacttaatgaaacgtgaagacattgcgaataaaattaaagtgaatcggttaaacgaaaaagaaattgagaaagagatggatgaactaagcgaagtatcggttgtcacaccagtgtggacaatgaacatgaagaatgaaaagtcctatctattataccaagaaaagtatacaaatgatacattgatacagaaattattcaaacatgcaggttctgtttcttattatacagatacaattgtaccttattatgttattgaacagattgctaaaaatctaacaagtgaagtaatttatccaacaaaacctaaatatgaaaatagagagattgaaaatattcagctagcatttacggcttgtcctgtaaccattgattgtccagtagttattccagatgttagtccttatgacgttttatttgctttacaccccttaaaaacaagtgtagacaaagtacaaatttcatttccgtggctgtcagaatcagaaatatctgatagacatagacgttattatcataaggttggagaccattatgaggttaaagcaaaatataaatatcaattctttaaatatgtccagacctcactatccatctgggctatgaacatttggattgtttgtgatagtgatgaggattttgccaatgtcgattactatgtacaaaaagaaaaaaataaaagaaacgtcaatagagaacgtgctctccaacgaaaggagaagtccgatgagtaaagataaaacaatgaaccggactgatgttgcacgtgccatctctcaatatacaggttatcgtatgaaagacgtgttagctatcttacaaatggaagatgaggttatcacacaagcaatttcacaaggaatatcaattaaaaaccataaattatggaaattgaatattaagaaaaaacctgagaaggtcgcatgggatggcatttctaagaagacgtttattcaaccagaaaaatatgtagttaagtttgtgccactttctaggttgaaagaagctatagatacttacaatgaagagaatgattagtcattctctttttttttgcccttgacataccttacaaaaatgctatactgaaatagtagaattacagaaaggggaagagagcttgaaaatactgttcttacaagattatatcagagagacccatgtacataacagtcagaatggacaatatgtagactataaacgtactgacatgggtaaaaagcttacaagtttacttaacgacataggtttaacaggtcgtgattatataattgactacgattatgacctaattcctgaaccacagaaggtaaataataaaacaggtaaagttattaaatacaaggagcctgtattaaaacttcggaaagaacctgaaaaacgtttattaaaacgattaatgaaaacaaaaccagacatcattattcctatgggaggaatgggatgtaagaacttattgaatagtacttctattacgaaagcacgtggtgttcctgtacaaaaaacaattactgatgaagaaacaggagagttttttgatacatggattttaccaatgtttagtatggaatacttgtcaatgaatcctaatattgagaacttggtaaaagcagacatttctactttatctcgttttattgcagagggtgcacaagcatttgagccaaagaaagttgagtatgagcttgttatgacaattgaacgagtgaaacaaatctttgagttcttgtctcggtttaaacctcttactgcatgggacttggaaacaaatagtctacgtggagatgtattaggtgcgaaaccactagttatgtctcttagttgggaagagggtcagggtgttacgattcccttagaacatcatgaatccccttggaatgaagaagaactagctattgtatacaatcatttacaagcttttgtagctgatgcacagcaaccaaaggtaggacacaatattcagtttgatattcgtttcttaatgaacacaaaagggtttgcttattttgagaataaccgtgatacactgattgggtattacttaatcgtagcacagaaaattgaaagctctaaacgtttgtcagaccttgcttatgaactaactgatatgggcggttatgataacccattagaagattataagaagaaatacaaggaagactacattgctcgtaagaaagctgaaattgatgagttaaaagcttctgagaaagcacgtgtagagaaggagtataaactagcacaggctaaatacaaagaagaagtggcaaaagctaagaaattaggtaagtctaccaaatcaattttgaaacctgtaaaagaaaaagtagttgttccttctaagacagaagttaaaactgtgaatgaaattgatggtggagactttaactatgattggattccattagaaattatgcacccatacgcaagtggagatacagattgttgcttacgtatttataacgtactataccaacgaattgctcctcatgaaaagattctagctctttggacagacttctatcctaaacttacacggacacttgctcatctagaagcagaaggtatcttcgttgataaagaatatgcgaaagttcttgaaaaggtatatgcggaagaggaagaacgtcttatcgaagaattacgtaagttccctgctgttaaagagttagaagcagagcatatggcactttataaagcaggtctagaagaatggaagaaacccaagtcagaacgagacgaagaggttgctaaacttcgtgataaatataagatttctgataaggaaaacaaagttaagttcaatcccggctctgctgtccataaaggaaaagttctttataagattcttggactaacattaccttatgacaaagagtccattaaagaaaaaccttttgataatggtgttcctgaaaacgagctaacttgggaagactataagacagataaacatgctttgggctatatcgcagagcacgatgaagatgcaaaagaattagcagaaatgctactagaatactctaaagtaaacaccttgaagaacaactttgctcagaaacttccgttactagcttcaaacaaagatggaaaagtacatggttcgtttaagattactggtacagaaacaagccgtttatcttctaaagaacctaatatgcaacaagtaccatctaaagttggagaccctaaacgttttgactatacgtacccaattaagcgtatgtttaaaacaagctttgaaaacggagctttattacagctcgactactcagccctagaaatgcgtattctagctttagtagccggagacgaagcgatgacccaagctttcttagatggagaggacttacacaaatcaaccgcttctattgtttggaaagtacctgtatcagaagtatctaaggatatgcgtaagaacgctaagagtgttaactttggtattgcttatggtgaaacacctttctctattgctcctaaattaggtgtaacaccagaagaagccgaacgtatctttgaagactactttgcaaacaaaccacgtattaaatcctttattgatgaaacacatgagtttgttaaagaaaacgggtatgtagataccttacaaggacaccgtagattgattcgtgatgcgttctctaaagaccgtaatacattcaatggtgctttacgtaagtcagtaaatacgattattcaaggaactggtgcatacttaacaaacatgtctctggtgtatattgacgattatctaagaactaaaggtatgaagtctcgtattgctattacagtacatgactccattgtaattgattgtcctcgtgaagaagtagacgaagtagcaaaagtagcttgttttatcatggaaaacctaccaattgatttcttaacaattaattggaaaggagaacaaatgagatttcctattgtagctgatgtagaaatcggagaaaactacaatgacatggttgactatgatgcagaagaagtgaacaaatttgcttcttataaaggatacgttaagtattacaaagaccaagctaaatttgaagactataagaacgcaggtatgattagtgaggaacaaatggaagccggtattaatgctgttaaagcttgcatagaacagtacaaactaattgcgtaagtcttacaaatttatttaaaaaaaattacaaaatgacgttgccctaacatgtaatgtgtgctataataatagagcagacaagttagggaatgtctgtaatattggaaaggagaataagacagtgtgctagacttacgagtgaacgaccttgaatttcgtaagatacgagttaccgatgaaaacggtgaaactattgtgtttgaccttacagaggaactacaggtaaacgagtttagtgttcggcaagcgttcttagaacagcctgcgaaatacacgtattggacttctttacttgaacgcttacgaatgtaccaagaaaactacgagttacaagctgagaagcgtaaagcagaactgtatgaaccttctagaaagtctttgattgagcaaggggtaactaagccaacaaaagaccaaatagaagcacagattatgcttgacgaacagtattatgctctgagacagaacataattagtttaacatttaatgttagacaagtgcaatatgtagtaaaagcctttgaacaaaggaaagacatgttgattcagtatggtgcagacttacggagggatttcgagtatagccagaaagtgtctatgccagacccactaaaaggtcaaaggacaagttataacaatccatataacacataaccttagaacctagttgaacaacacataattcgagaaaccaaaataaaaaaacaaaagaatggagaaattaacgtgaactttcaagaacaattaaaacaacaacttgcccaacaaaaccgaggagaacgtgccgaggtagactatccttccaatcatcttaaacacaaagagctgtttattccaaaagaaactaatcaagtattagttcgtatcttacctcctagtgtttctggtgaaaactataaccaaatggttcgtgaaatcttcttacaagcacataaccgtaacggtaaagaactaaaattaaatgctgtcttatctgcattccctaacgtagaagacccattagaccaagcacttattaactggaatgcacaaaaccgtgttcctaacaaatggaacaaaaatgcaactccaactaagaagtatcttgctaatgttatccaattaattagagacccacaaacaggtcaattccgatatgaaacggatgaacaaggaaacttgatggtacgcctattcaagttatctcattcagcttgccaagctattaatgctaagttaactgatactatgttaacaccaaactttaacccagatgttcctgattctgttaaacaatacagcttcatttcatctgcggaagcattcccagtaatgattagcaaacccgctaaaggttctggtcaaatgtcttacggtgttgatgtttatagcaacatgcctctaggagctttaccacaaggatgggaaactcaactagaagacttagcttatcaagctacaccttcatacagctacaataaagagtacattgattactttattgatgtagtaaacggtgttgaacctgtgagccaagcacaaggtggacaacaagtacaaccacaacaaggttaccaagctcctgcaatgggacaaggctttgcttctgctccacaacaacctgcttacaacatggcacaaccacagcaaccaatgaatactggttttaaccaacaacctgtagctccggttcaatcacaagctacaaacatgggtactccttcatttggtcaaacaaatatgggaacagcccctacaatgaacggtggatttgcgcaagcaccacaacaacctgtacaacctgctccaattgcagaccctatgggttttcaaatgccaatgaatcaagcaccagtaactgacccatctactatttcagatgctgatatgccttttaacatgcaagcaatgccagatgtaacaccgcaagcaacaagtgttcctgagcaaccagtagttgcaactcctgaaccaccacaacaagctcctgtagcacctgtagaaacagctacaaatactactttaccagatgttgatagcttgctacaacaaatgcaaggttagtaatagaggaacagggggctgaaatagccccttcttctatttaaatttgatatgtaattcattactaggaggaacaaatcttggcaagaaaaagacaaagtgaaacagtagaagcaggtacaattgatttaacaaaagaattgggcttaacttcttttagagatacaaaattttctagtgtagctgaccgactacctacaatgattcctcaattagactacatcttaggtggaggacttccatttggacgtatggtagaggttatcggaaagaactctagtggtaaatctacttttgcagtacaccttactaaaattgctcaactattgaaggtgccaacattgtggattgacgtagagggaactgctgaccctgaccgtttagctgaactgggagtaaaccctgatgcaggggatgtattcatggtagagcctgctttgaaaaaagacggtactaaggatacaatgacagtagaacgggtagcagaagaactacaacgtatcttaccagtaattaacaagacaggtaaacctattttaattatctgggattccgtagcacagaccgccgctgaaaaagaaattgaacgtggtgtaggtaatcaacaaccgggtattaaagctaaagcaatggcacaattctcacaaatcattgcacctttaatgactaattcgaaagcattatttgttgcaattaaccaagctcgtgatgagatgggtagtatgttcggaggtattgattctccgggaggacatgcacttcaccactgggctagcttacgactagaagttcaaaaagcaagtaagattgaaaatagtgaagtaaacgcctttggtgtagaagagaagtcctatatcggacatatcatgcgtattaaaacgttaaaatctaaagtatccagaccacagcaaaaagctgaaatgtatctaatggctgattctggtttagaccttgaagaaaacatctaccgtgcatgtttcgcaactaataagcaatatggattcattagcggtggtgcatggaaagcttacacaacagatgcaggtcaagaaatcaagtttaattctgaaaagaattgggtagacttcttgaaatcagaagaagggcaacctgtacgtgatgagctatttgctaaaatgatggctcgtagtttccctaatggatacgcaccttataaaaatgaagagattgatatttgtcaaataccattatataaatacgttaaagattacatggaaactcataaagaagaagcacaacctgtagaagagcaaacagctcctgtatctgcaacagatgtttcagacctattagaccaaattaagtaaggggcgttatgcccctttttataagagatggaggaaacctaattgcgtaaaactacaccagttaacaccgtactagaagccttagaaatgtttcaacaaggaacagcaactacagaggttcgtacgcctatttctttacaatctgtacgtaaacgtttcttagatgctaaagaagcaggaaaacgtgtattgattgaaaactctgatttaagtagtgcaaactctgttgttgttgatattgactatgtaggtagccgttggtgcttaggttatcaaaaagtattgtactttggagaagaggtacgcattcctcatactatccacttttgcgatgtatatggggcttatggcaacgaagcacaaagaagtaaacggcaagtgaaaatcatttttgaaggagagaacccttttgagtagagaccttaacaaagaggaacgtgagattagaaacggaaatcgtttcattactgaggttcacggtaagggggtctttccacgagatgttgatagactgtaccaccgttatgccaacttacgttacaaggtctataacactcataaagactcttttcgaagtgaagcctcacgaaaagaactaagaagttatattgatgaacagtttatcaagttaacgaaagaatatgatattaacggagaggtcgattttccgggatatatcaaaaaggctcttaatttaagagttagacatagctttgtgaaaggacgttttcgtgatagtgctcgtgaacgtctgggagcagaggacaacgagattgaaacattactgggaacagatacctcttctcaggaagcaattgaagatgctgaactaattgatgatttactatctaaagcgaagtttagccctgtagagttagccgtgttcagctatctactacgaggtaaagtaaaagatgctaatatcattaaagaggtgtcagcgaagtataaagtatctcaaaagtctgttagagatgcaatcaaaaacgtgcgggagtacgttgcgttaaatcttaaagaccgatagaattagttaaaatcctccttgtgtgtatgctatattagcagtagaaacacaaaggaggatttttgtaatggaagaacaaaacaacactggcaaatacgctccatttattcgactaattgtaatgggtatctccttcgtggctactggtttaacaactatgtttggttgggaaccactaccttttacagacgaacaaatgaaccaaggtttaatgcttgtactttctgttggacttgctatctataactggtacaagaacaacgctgttactaagtacggtaaagctaaagagcaagcaggtaaagaagtagtcggaactcgacaagacttcaaacaacaaggctaagtttgagggggtaaaacccctccttagttgatattaaaggagtatgacaatggaactaacaaatttaagtgctaaaacactacccgaattaaacgggaagtttcttgttgtagagactctatcagacggatacacaggaaccgtaaacggtcattataactatgaagttgttactaaaggtgaggactatgaaatctatcccacactttggaacaacgaaaaagcgcagtttgtaaaagctgacgaaatggttgtgtatacaaacggagatactgtattctatgtaacaagaacaacaaaagacccttataaccatgctgttatcagtgagttaatcgttgaagaaggaatggacaaggataagcgtacccttcaagctttccggctattcgcagacgatttattctctatcggaaactataacgtgttcttaacacaccaaattgatgtagtggacagcccaaataacgtaaaagttgaatcagtttccttagacaaagaatccggaacattatatgtgggtgacacagtagacttaacagcaactgtactaccagaaaatgctacagtcaaagacgtaacattctctgttgttccagaaggaattgctactgtaactgctactggtgccaaggcaacagttacagctaaagtaaaaggttcagctaatgttatcgtaactacattagatggagacaaaacagctcaatatgctttaacagtgaaagaacacgtttcagtttctggtattactttaaataaagaagctacttcaattgttaaaggtgctacagaaacacttgttgcaacagtaacaccaccagatgcagaaaacaaagctgtaacatgggcatctgataaacctgccgtagctaaagtagaccaaaacgggaaggtcacagcagtagacggtggtacagctaacattactgcaacaacagttgatggtaagaaagtagcaacttgtgttgttacggtaactgtgcctgtaacaggcgttacactagatacgaatgctattactttagaaattgacggtacacaaaaattagtagcaacagttgctcctgctaatgcaacaaacaaaaaagtaacatggaaatccgataaaccggaaattgctactgtagaccaagaaggtacagtgacaggtgttgcagacggtacagctaacgtaacagcagaaacagaagatggtaagaaagtagctacttgtgctgtaacagttaaccctgcgcaagcataatatactaggaaaagaggaatactaaaatggctaaagaaatcgcaaatattgcagacttattaaaaccaagcgtaaaaactgtcgaactagacggtaaatatcttgtagtacctaccctatcagatgggtatacaggtacagtacagggggcttacgcttatgaagtgaagaaatcaggaacagactacaaagtgagtgaacttatctatgataaagacaagaacacgtttactcctgcggatgctccaattatcatgacagatgatgatacaattttcttcgttactcgtacattgattgacccttacaactacccagtaattagtgaggctacagttaaggctcatgaaattaaagaaaaacaagtacttcaagcatttattgcttttgcagaagacagattcaaactaggggtatacaacgtattcttagcagatgacccttatatcttgcaagataaagcagaagactagtttgttctagtacaaaaaaactgtacaaaatttaaataaagtgttgacgacttacacctctcttggtatacttagactatactaaataagagaggtgttttattgtggttaaagctaaaaatcctgtacaaagacgtagaggaacttacaatagttgtgatgtgttagttgaagaagagaacggtttcttttactatagtgtacttaactcagatggtaaagaaatcataggtggctttagggataaaggctcccaagacatatctacattttacaactacttgcttaagttagtagatgactacgttaaatgtccagagggttttgttgaagatgtttaaacgtaagaaatactatgtagtccaactagttgttcaaccagatagtaagccttggtacaggtcaatacttgtccaaagagaagacgggtatctgtttacagaaggttacaacagaaaatgtcgggtagagccaatgtatacacgtcttggtatgaaatataaaaaagtttttactgaaaaagaaatatgtgcaatcaacccagattacatgtattttgcagtggaggtgaccaaggatggcagacctattaatgataactaaaaagaatgttcagggttatgtattaaactacttatttaagcaattagctgtaaaaagtgaacataactacacttgtgagtttttagataagtttaacttacctgatattaaaaattatgcgaataaagcagatgtactaattatttcaggcttccctttttatgagagccaacgtactactgtggatgaagcattacaggtaatgaacaatccgtttagtcaattctttcacttagcaacttttggggatacctatagcaacgagggcagttttcattcatatgtagatgaattagtaagccctgtaggaaacttccctaaaataattaaagaactagagaacttcttgaaatttaatgatgtaattcggcacctgcttctaagtgatatggaaagtatcatcgaagcaaccgatgcgtataatcgttatgaggtaacagatactattctagactgggtttctcttgtagaaacgtacagagagcagttatacgcaagatacggagtaggtacagacctagaggaaatacttgataaggataaaaccttggtcaaatcattgcgggagaaaaaagacgattatatcaaaagaacacttggcagaacatctgcacaggtaatcaatggtacagtcgtatgttttacttacgcagaggaatatgtaaatgaggtagcccataaactgattgagttttatcaatcatacaactatacaaaagtagctgtctttgttggacgacataccaaaggtgatgatatgttcagtattcgaacagcaggtatagatgcgggagaacttgcctataaggtaaacagaggtagaggaaaacctactactgcaactgttttcttaggtaattcaggtcaatccacattcaacgcattacttaacacacttgctcaaattgtataacaagtaagtgtgttataataatgttaggtataaaacaatacacagggagtgtgctacttgaaaaagaataaaatgctagaagacctaatgaaacaattagataacccatacgtaattggggcaattattgcaggaactttgcaacatgactttaaccgtatacacgttagcaaatataataaatatgctcgtgagtttggtttagaccgagagaacaaagaaagcttagaagcactaattgaacatttcgattctgataagttattaaaggaattgtacatgtcaagtattgcaggagaaattaatgtggacatgcttcgttcatttaaagataaaacgaaaaaatccgcattccagactttatctccattcgtggtagacaaccaagctgttttagctcgtaatcgtgagttcaacaagattcaacgtgagggtgcttacttagaccacttaattgaaggcttgaaagagcacttatccgaagaacttgaaaatactaatacgcttaaatatattgaaccagaattacgagtaaaaggcaagccaagtgaccgtgaaatgattctatgcttatctgactggcatattggagcatttgttaacaatattgatacaggcggatataattacgacattttccgtgaacggctaaacagtctattgtcagaagctttccgtattgtgaaagaacaaaacattcgaacagtacatgtttatcatattggagacattattgaacatatcaatatgcgtaatgtaaaccaagcgtttgaagcagagtttccggcaacagaacaaattgctaaagggattcgagtattagttgaaacactaaatgtcctagctaaagcgggtctagatgtaacctttggtatggtaggtggtaaccacgaccgattccaaggaaataaaaatgataaaattcataatgataacgttgcttacttagttgtagaccagttacactttatgcaagacttagggtctctacacaaaaatgtaactttaattgataacagacaagatgtttatagctttaaagacactgtagcgggtaaacgcattaaagttgttcatggagacaatgaaggtaagaaagtagacgttaagattccaaaacatattaaagaagaagttattgagtatttaatcatgggacatatccatacaacacgtattattcaagaagactattcacgattccatgtatacgttgggtctcctatgggtgcaaataactattcagcagaaaacaatctaccaacaacaagtccggcacaattaattatggtcttagaccctaaagtggatagcccacaatttatgccaatctttttgtaggagagtgatagaatgaacccgatttactttttattatctatcatgtatgtattcgagtttggacaagcattcttgaatacgaaacgaaaagaacgatatatgattgaagatggtggagaacctcttcctagaagctcttacgtgttcttattcattcaatatgtattgcgtactcttttcgcaatcttgcttatttttattgtaccagagagcctacagttcaacgtaggaggtattactgcctttatagtagttttgcttattattccatttatctctcggttcattgaagttggtattcgggtattgattattaaatacttgcaagccaagcacataaaacgtattaaggaacaaggggacgaaaaagagactaattagagtctcttttttgttatgttatattaagtattgaggtgaaaagaatgaaatatacagaaatccaagtaggtgacggacaaagcaccttattagatgtaaaaagcaaacctgccttaattcgtagaggcacattaacaatgaaagttaaatcaagagatagtctaatcagtaaggtagaagagaaacctgtatatattgttgagctagcagaagaatcctatggtacaagcgttgtttctgtttttagtgcagtacaggagggaagcggagaccatgtagttgttcagaaggcgtacacagagaatattacgcaaccatcgtttaaaggcaccacatttttaggtaaggttgctcaaaaggttcatgaaaagagcttaaaaccaaaacgggtaatcacaactaaaccccctgtttttttagcgcctgttgtcatgggagtagatacttttacacaggaacatggactaggattttatgaacgggaaccagataaatttgttatgaaagacggtcatcctagcattgagtatggaaagaacacaggagtctttatttgcttaaactctattaagtgggataaagcttatgtcaatgcaggacaattgattcaagactatgtagcagacaaacaactatggtttaatctgggaggaactaaaccacaatttaagagtgaagttaatcaatgaccgataaccgtttctatgaggcagacatacaagagttaatcttgaacaaaaaacgtatttttggagacatcggggaaagtgctattgtatttgagaaagcagttatgagagggaatactatttgtgattgtttaatctttacagaaaaacgaggcgttattggtattgaaatcaagacagaacgtgactcaacaaaacgtttgaataagcaacttaaagactatgaaaaagtctgtgattttgtttatgttctttgtcatgatacacatgtaccaaaagtggaacagattctaaatagatacaatcatagacatgttggtattttagcttatacggagttcatgggtgaagctatgttaggaatatacaaagaagcaaccccttcaccaagtaagagtgcttatcatatgctagacattctttggaaagaagaaattctaaagatgttaggtacgttcagacattacggtattcgagtagagactgctacaggaaccaaatttatgcacacagctaaccgtagcggaggtgtgagtggtctttatacgaagtctgcgaccggtaggacgatgcgaaagccagacttgataagaaaccttataaatcgtgtagggggtgctgaggaggctactagggtcttctgtgacgtgttcattcataatagacagcatccagagaaagctattaagttaagacactttaaacagcaaccaataaggagtgataacaatgagtaaacaaggactgccttttggtacttgggagaactccgcaggaagaaactacacagggctaggtaacacagataacggacataataagaaacgaatgtccacaagaggatattatcacgtagctctgacaaaagagtataggggactaacagagagggactttgaactaaaacttgaatatgggaaagaccttgtttctcaatatacaggtgtaccgattgacatgcttgttcttcgtaaaaaaacagaaaaacaaacactttcgtctatagatagtgtatactatgtttgtcgaggaaaggaacctatcggtaagctgtctgtaagggcacagagacggtttaaagaccttggactcacatttgtatacctagagaagaactacgcccctaaagtggtgagaagggtgtctaagggacagcgtagccttctgggacaaacgaaatcagataaacgtaaagcaaaccgaaaacaaaagaagccaaaaacaacaaattaggaggacaatcatgctaagtaaggggaaacaagttacacttagaaagttaaacaatattattacaaataaggaatacatccttataggtgctcgttacacgaacgattctttagaacgagatattcctattacaactgtaattgacgatatacttatagatttgaagaaagagacaatggcaggttgtgttttctttagaccagtaggagatgcacaaagaaatgccttatctctattaaaagatgcgtgtatgcactttggttacggagaatttttagatgaagctattgaacgtcctgcattgtatgcggggctaaaagcaaacgttatgctacctgatacagccttctcaaatatccaagaaatcccattcaatttttatttcacagaaccagaagtattttgtgaagaagtaactatcaagggaagaaaacatattcagtacactgtcttagacagaatcagtttagatgatgtacaacatgtagaacaatctcttgttgttcttttccgtaaagcagagtatgatggagaaaccctgttaggtgcttacacggatacaaaattaacaaagacagaagcaatcaaaatccttcaatttgttagtaacggttccttacttgaacaggtagttggggcagttactgtattctcagataaagtagtgtctacacttattcctttgtttaatgatgtagatataagctttatgaaatcaggagaaggaaatcctgttgtctctattacagcagatacaggaggcattgcctttgatgaaaaagatttggatggtatgtctattgaatctcctagtttcggagcttaccgtcttgtgttacatgtagggaaagacaccgtaagtattttaattggataaatttttttgtaagggagtcaaattatatattgactctcttatttttgtgtgctaagataaattcagttgttgtacaaggttacaatgacaacatgtacaggagggaaagaaatgagtgtagcatcaagtttagatagagctgatgaatggttgttgtcgcatttgtgtgataagcgtttagagtatttgtctcaaaaagaagagttaactgcaaatgaaaaagcagaaatattactaattcaagagcttaatatgaaactaatatgtaataccttacaaaaagagacacctgctcaaaccgtacagggttctgacgttactagtggcttattaagcaaagcttacacaaactctgttaatattacatcgcaagaagcgtggtatacatctttgttgaaacgtacgcttgatgttgttgatggaataccttgtgtagggaatgtcactgtatttgtggactcagatgagattagtatttcgattatggggcacatacgacacgacaatgatttagcctgcgatgtctacgaaatttcttttgaaaaccttggaggtatcgaagattttctaattcatgttgagggagtagaaatagctttaccggactatttagagtttattaccgaggaactacctgccattttaaaaaaatcattatgaggagagagaataatggatttaaaacaagcttacaactatgcagtagaacatttaaatgaaaatgccaaaacagaaagtgaacgtatctatgtattgggtgtcttccaactaggaagccgatatgccggatacgatattgaatcaagtgattacgattttacagtcgtttacatgccgtctgcttatgatttattaaaccgtgagtatggacgtagcaaaattaagtttgaatacaatgattacgaagtagaaatgtctttcatggatattcgcaaatacctaaatcgtttattatcaagttcactagaaacattacaaatggtgtttgcaccatctagcatgagctactatgctaaatttggagacgataacctatcattgcgagcagaagagcttgtagattttatgttaaaactacgtgataaccgtaaatcctttgtctacttgaacacagataagctatatgattcaatttcaggaagagcaaagtcttctatgggtaatgctagcattagctacaaaaatgatgaatatggtcgaacaatcaagtatgcgattggtgttgaatacatgcaagacttacttcaagcattatactacaatgaagacattcgagaaggtttgactgtttcacctatgcaagcacctgtttataaggaacatcgaaacaatcctagctatgaaattgctcgtttgtaccattctcgtgctgttaaccttatcgagaaaatggtcttaaacaaagaagtggttcgtgaaactttacgaaaactacagccaaccgaagacactattaaagtagttcgagaagtatggacagaagagtttgtaaacattatcttgggaggttatgacgactaatgatgacaacagcagtaaaagaaagaacattagatgaaatcttaaccaatcctaagaaaccgatgacagagaaactggttgaagctgaacaactaatcaagaacagtgagcatgtttatgactttgggttaggtacagttaaagaaactatggtgatgtctggtaaaaattggttagctagtcacttatatatcaaagaagttactacttatggatttatcttgcaagccgttgtatataaacagtctttagttgagcgggctgttactaacgatgagggtgaagaaataaaacctgcttcttatgactatgagctaaaccgtgtttacgaattagagtacagtctacgagataaatatactagactacttaaaaatggtagccctttgaaattctcagagaacaacattaaaaacatgttttctggtcaagaaggtgttattcaaaaactagattcatgctgtaacaccgagatgtactcttctatgtatgacgtgtttagttgtattggaaatgaatcagtaccccaagtagctcgttttcttgttagatttatgcaattgaacgtggttgaactaatctataaaagtggggttcctattccttttgctaaagactttgctagagaccaagctaggaaacttgaaaaaggtaatggttggtatggtagtccagagcctaatgctaactgggtagattgcacagctactgcacctgcaaaggttcttgatattccaaagtctttatttaaaattatttgtcaaggaaatgttagtttcagtagatatgtttcaatgcacagagctatagaaagagctgaaagtgtgggttttgaagaggaacctcgtgaggaatggaacagggaactacggatgtatattaaacccgaagaagacgaagctattgtacaaaaaaggaagaagtacaatgaaaaatgtctaaaacgaaataaacaaggaatcattcgagcttgtggtgcactgtatcatttgttcacctttgctgtggaactagatagtgaatatggaattgagaaagctagtaatttagcttctcatgagttcgaagatatgttatacagggaagtggtacctacccgtgtaaacagcctacagaataactcagcagtttgtattgccttttctttaggattggagttaaatcgtgttgccagatacatgtactatcaattacatgtagaacaaggatttactgatggatattataatgcaacttaccgtgactacctacgtatgatgcgacaactagagattgcggataaaggtaactaccctaaatcattgaaaacagtgcatgatgtagctgaaatgaatactagaatgattaaggataaagaactggcagataactttgcagaacaagtcaaacattaccgagagtgggaagacgttaaagttcgtggtagcaagtatattatgcgtgcacctgaaagtatagacgaccttgccaaagaaggttctagtctaagtcactgtgtattcagttatgctcgttcagtagccctaggagaaactacgattatgttcttacgtactaaagcttgtccagatgatagcttggttacagttgagattaagtacagccctagccgagaatgctatagaattgtacaagctcgtggtcactctaatcgagcattaacggctgcggagaacgagttcttagagaaatggtgtaaaaaatcggaaaatgtggagagaaaataggctattttaaaatgaaaaaatactactagttagttcattttcttaagttagctaaaacgattcatttcaaataacaattttccacctacaaatgtttcatatataattcacagaaaaaacacaaaaaaccctacagttatgtggggttttcttgcgtttcatttatatctgaaatttaacagttatgtgtgctatattaacagtagaacctaagaagggcgggctttatccgtgttcttagaatatagacatgttgaaggagtttgtatttgaaatggctaaaaaagacttaaataacagttcagtattgctgaacctatatcacaataaactattggtatcaaaggttgatgaagccctagacgagggtaaaccttatgattttattattgctttttgtaaagagaaatttgactttgaaatcagtaaacccgcattatctcgttataaagaaaaacgcagagaggcaattgagacaggggtagacctagaaacactacttgacaaaagacgaaaatctggtaaagttatagacctaaaaggaaaagaggttgaaactctaccaaacacgaacacgtcttatgaccaaacatttaacgcagtagagcaaatttataatgacgttgaagtgttagacactatcattcaaaaaggctttgctagcttgaaagaagtcgattatgtagaagcacctcttgccatgaaagctatcgaggttaaagcaaaagttacaggtaatcaactgcaagggttaagtctagtgggattgcgtgaactaagattacgtcagtctgctaaagaacaagcaatgaccgaagttatcttacgtttcatcccagaggaacaacacgaagaagtttaccaagcaattgaagaagcagaagcagagttctatgaaaacttagacctaacagcagaagatgcacgtatcactagcgcactcgaacaagcgggcatgaacattatctaagggggctattcaaatggcagaaaatctagtggaagtagactatagagggctgactttacaagaagcacttcaagcgctactagacaaaaaagtattgctagtcaaaggactagaacaaagtcggaatttagatgtattgatacgtctttacaccgaaggagtcgtacctgttactcaaatcagttatgatgttgttcctgctgatggacattggagagaagaatactggcagatatttgatatatctgttaatgctctaagtacgtatccgtgttacgtgtatgatgctgaaacggctaataaagcacctaagttcctgattggaacaacagtttattacaccagtaagatggatagcactcgagattccgctatcgttattggattgtacaaagacgatgagggcaattggcattacaaattaagtagagaccaagaaatttacgcagagacagagcttacagcagacaggttgtaagcctgtctttttttgtaattaaagtattgacaataaacagtaagcatgatatacttatggtataaattaataaggagagattcatatgaaagaagaaaagacttatactttagaggaaattagagaggaaattagggaaaaagaaagaaaagctaaagaattagaagagttgcttgcaaaactaccagaagatgtcttatgtgaagaatattatgcaatggaaaacgacatgttttatgcttgggaaaacggttcttgtgaacaagtgcagaagttgttgagtaaacataagtataacttagactcaattcaattggttcacgacgtattctatacactgaacaatttggtagaaggggaaatagaatatggaaaataagtagttgacagtactagtacaagatgttaacatgtttatgtacaagaaaacaaatcaaggagagatgtacaaatgaaaccattcgaagacatttttgatgtgttaaataaagcacgtcaagacaaagacaaggtaacacttacttttattgaaggactagacaatattgctagacttcaaattgaggattcttctgctacagcaggaatcactcgttatgtaaagttctacaacaatgacatccgtaagttccggtacgttgaccaagctgactttgaagaaatgtatgcaggcttagaaatgaaaacaggtaaaccaaaagaagaaacaattgagtttccttctgaggaagtaggaattatcagtgctttaaaaatcttgcaacaaagtggtgtctttagtgatgaagacggaatgcgaactttaggaattaacacgtctacattggaagatgctcactatatcttacagtatattgagcctgcaattgaccgttacttcgaatctttgaataaggatattgaagaattagaccgtgtaatgattaaccaatcagatgaacttaaacaaaaaatctgggaaagctttgtatttagcaaagataatctaagcaaaatgctagatgactttgaattggcaactctagacacgttcccaaatgtaccgtctaatttgattgttgagacttgttcagaagtgaagaaaactcttgaagggttattgattgaagatgcggaagaaaatcctattgagtgtcatgattaccttgttcgtggtttcgttggtgctgttatccgtattgaacaatttattatttctgttgcaacattaccttaccgtagaacagaactagaacttagagaatcaagagaagcttatatcaaagagcttgcttcaaatctatttatctttgcagaagctattgctcaggcgtatactagacttgtatgctctatcttaatggaaaattctattgatatgcacaatgctactgagtatatccaagttatggaaacaaaagcggttcactgggtaaaagaagaagcattaggcggaactatgttagctaacaatgaggaagacctcgttgagttatcccaagctttaaactctatgacactagatgacgtacgtgaaacccaagaagaccctgagaaggctgagtttaaagaagctttggaagaactgcttaatgagttgataggtgttttttcagaagacgaggacgaagaagaagttgacgaaacagaagacgaaaatgaggaagaaatgaaacaagccttgttagaatcattagaagcatttgaaaacctgttacgttcaattcaagcccctactatggaagaagaagaggaagaagacaatgaggtgcctttcgaaacacctatggtagacatggatgaccttcttggatacttattatcgggggaacctaaagaaaaagaagaacctgtagaactttcagatgatgcaaaagcagagtttgaggaatactttgcagatgaaatcggtgagttacaagaacttcgtgaaaaagggaaagatgctgtagccttgtataataagattaatggggaactaccattaaccgagataaaatcaatggctatgaaaaatatgggatttgcactgtcaactctgcaaaaaatgttagatggaacagagcttgactacactaagaggggtctacttgattccttagatagattaaaaggaagcaaatacaatttatttgtagaatatattgagtttttgagagaagcatataagttgtataaaacagtaggcatcggtattgttgcttacgcacatgcaattgttgaagatatagaaaatacggttgataacgtgatggacattgactatgaaactgcttaccttgttaagcttgcagttaaacagattaatcaagacattaaagcctttgaagaaaatgatggatactctgatttattagccttctctttagcatttacactcgttgttatcatgagagactatggagaaaccgacttaagtccaattagtgtagaggtagaagactttgtgtctaagaaaaaaccttccgttgttgtcgaggaagatgaagaggaagaaaaagaaggagctattgacttagctaaagagttgaaagacttgattcgtgggactgcattagacaaagacaattctttaaacaatagtgtagacgaagaagccctgattactgattataagaatggtgtctctcaaagagaactcacaaaatgttataatataagtacagggaagttctactcaattctacgtagacatggtatcgcagtagatagctctaaagtagctaaaaaggttgcacatgtagaagaaaacccggaagtacttgaacaggttcttagagattatatcgaaggtaaaacattagcttacatttactcaaactataatctatacaagaacggtttgttctatctactagataagtaccaaattccacgtagaaacaaacgttaacttccaaataactttaggcagtggctactatggtcactgcctttaataaggagaatatttgttggaagagacggtttataattttatacaaggcttaagcgggacacaattaactatattagaagatacatttgctttactaggactaatctttatacttataggaatacattttttagtagcagatacagttgaatgggtgaaacttgttaggaatccaagagtatctacatttgcaacaatacacatgtattttactttttatctaccgatgttcattttctttttggtagatggtagtacggttactacttttgttgtttcattactgctttttgctgttgtgtatacatggattgtctggcttcgagtgggtagatacacagaaaattggtcagtagtacgtccgtttgttacctacattaaagcacaagaccatgtgtgtacgctagttattggttcagtacttttaagaatagtactattttttataaagattaggataggttaagataggataggatggaggataagatacatgaatgaaataatgagttatgtttggttgggtgtgtttattgctatacccgtaattggctttatctatgtatataactacaatagaaaaaacccacgttggtaccttcgcaaaagctactgggcgccactagtgctagacttagttgtttttggtgtttgggcaatggtaggcgtaatcacactagctgttggacatacagaaactactactaaaacatttaatattgaaccacttacggtttatagttcaccagaaaatatttatgcaaagataggtagcacggatgacagctatgttaactttgcaattacaggtaagggaactcactctgcaccacttggtaacactagtatccattacgttgagtccgaaggtagaccgaaagtcacagttacttactacaaattaggttcctctttctcagcctttatgggaatgcagggagaacttgtaactaaaaaaactcgtgtagatattcaagtacctgtaggtggggtggacgtcacaaatacaggcagtacctttgaagagcaatcagtaaatgatttacttagataattccctaagtagcgggctacaaaaatccgctaagtagcaggctagagacatcttttataggtgtctcttttttattgacaaaactgtacagctatgctaccatatacatgtaaataaaacgagctaaaaaatttgagcttacctattgacattaaacaatgtacaggctataataagcttgtaagataaaacgaaggaggaatttacaatggaaaaacaaaaacaagtgattacaagaaaacaatatgaggagcttatggcacgttataacaaaatagactatgctatcatcgcagggttcgttatctttggtacaattatttttggactttggggagctatttttatggctgttgtaggtgcatttacattcccaaacatgcaacgaaaaagtcataatttaatagaacaagactacattgttagagatgacattcaacagtaagcttaattgttgactatggaaattacaggtgttactataatggtacaaggaggacaaagaaatggcagaagcaaaaaagagctattctgacatgacagaggaggaagcacagtatgcaatggtattaggtgctagaatcgctcatgcacgagaagggttaggtattagtcaaggagaactgggtaagttagcaggtttcaatcaaacaactatctctttaattgagacaggtaaacggctacctaacttaaagacccttatcagattgagtaagattcttaaaaaaagtttgaaaattacattggaatgaggtagagaaaataaaacagggggagatttattatgacaacgaaagtaaaagaaacaaaatcaaaagtaaagaatggtgaacgtacaccgaaggaatttgtagcagggatgaaacgtagtaagaaagacttgtcacaaacgcaagtggtaacttctttaatggaaaactatccagaacttacaccaaaagacatccaagaaattacaggtattaaacgtggaactatctatacaatccaaagtcgtctacgtagtgctcatcgtaaggaacatacaaagaccgcagatacgccacatatggataaagtagagtctattagtgaaaccatgagtccggaagctattggtaaacaagacttattcaatcgtttagctgatgtatacttaaagaagattgaagaaaccgaagatattgaagaagctagcaaatataacacgttacttattcaagtgatggaaagcttagataaatgatagcaggattctatttatataatttaagagtcctgattctaccgtatatttaacaggaatgtgcggtagaattttatttacataaacctattgacaataaacaatagataggctattatatacatgtaagataaatacggggagatgtttaaatgcaaacagcaactaaaaattttgaagttatacgtaagacagatgatttaatttattaccactttgcaaaagaaagtagttacgctatcagtaaggcagataaacaagagtgggaagaggcaatgactgaatatgtgaatgattttcttgaacaggcttacggaaacatcccacctatttcagtgtatatcaactctaggctttctagaacattaggttggtttcaatattatttagaagacaatggcaaacctccttatattgaagtaagtagcaggctagtaaaaagtgcgattctgctaacagatactgagcacaaagaacttgcatacacagtaattaacgacctgttaagacatgaagctattcactatgcgttgcacgtactagataaaccttctagtgatggagacgatacttttgagaaagacttgtttgtaacagggacatctcctagtctaagtacaccagagtataaagtatataaaaacgagtttcctagactactatgcaaatactatgcaaagtgccctgtatgcgatactgtgcttgcttatgagaccagaggacgttactattgtattcatagatgtatagaagagggaaaaacacatccagtcatctttagacctaagaacgaattaatcattgggatacaaccccacgtatcttatgggagaaagctactagaaggaaaatacgatggagaagttaagaagtcttacagagaaaaagtaaaaaaagattaaacatatctattgacaataaacaatagaggagttatactatgtatgaagataaggaaagggagagatgaaaatgttaaactttaacaaacatgtaacagcagaagatattatcagagatggagaatacaatgatgcagttgtagaacatattatcggagaacttgaaacaagtgataagaaaaaattagctttattcaaacaatggattgcagacaaaaaagaagatggagacacggaagctgttgaatactttaaaggtatgacagataaagaaattttggtttacatggacttagacgaaattgtagaatattatgaagaaacaggtcttgcagactttgcagatagtttagacattgactggacaggtttactagaaagctttggagtagaatagggggaactaacttgaacacagaaaacagagtaagaagagggagacctcgtaaatatccagagggagctaaacgggtagacaatacaagtttgatagtcacaaagaaacaaaaagaatacattggtaatatcgcaaagttaaacaaggaaacagtaaaagagacaagtaacaggctactaaaagaagttttagacggcaagtttgattacttgttaacacctattgtagaggaagatgtaccatctgtgccagtaacagtagataggaagttgacccatgaggtacagaagtatttagagggttacaacgagaatgcttcggaagtaataaggaaaatagtggaggagtttatgattatgacagacagaacactgaaagtagttgggggttacgaactgggggtaacttccattacaaaagagcttaaacgattttggttgaaacctacagaggaagcagaagaaaatatgttctttatggatgcttccattcaactagatgtagataaccgacatgtagtcattcgtgaaaaatctatgggtgtccgctcaatcagtcaaatggaagagcttaaacgttacaaagaccaactgatagagacagcttcacaattacaggatgcactggatacttacgttgcgaaacatttaggataaacttttaggatataggataggataaacaggataggatgcgtttaggataggataggattcacttaggataggataggataggataggatgaaaggagataggatacaatgttaagtacagcagaatacgattcacttagagagtatttagtagccgtaattcataaccaaattagtgagtatggaggagacacgcaaagcttagacgtatggaaagaagaggttaataggtacgcagataatcgaatgggttggtatctccgttgcatgagtctagcagatttgttatatgtagatactcccgcttcactggtagacatttacaaagactataaagaggagctaaacgaaatacttagagattacacagatgagttgcgtgcaggagctacgttcgataaggaagctgacgagcgcctagggtggatgtgggaagattatgacccattaatactagaagcacataatcaaggtctagtggctcgtctagggcttctaatcgttgctgaacaacttgctactcaattagaacaagggacgtttacaataccatatgataactaagtaacaggctagcctaagtagcaggctagcttttttcttctaagtagcaggttagctaaaatcttctaagtagcgggctacagtaaaaaaactctaagtagcaggctacaaaaaaactctaagtagcgggctacaaacagcttataaaatcccgaggcgtaccatccgacagccagacccgccacctttgcccgttcgatatgccaccactcaaacccgttttttccttatatatagaagaaaaaagtttttcatcttttttagtgttttttattgacattaagaaataggcatgatatagtatagacagttaaagaaaggagaaacaaaaaaaaataaataaaaaaatttaaaaaaagttattgacaaaagacaataaacaagctataataaacatgtaagataaataagacaaaagaaagagggaactaaaaatggaaaaacaaattattgtaaactttttgaaagagattgaaaaaaatattaaaatggtaaacagaggcttaaaatctgaaaacgaaactcacagcgaacttgttggcatgtatgacggcattaagttagcaatgaaaacaatcaatcccgacaccgtaaacattgacttacattatacacgtacaatcatagaaaactattttgtaggtactaatgaacaaaaagaaaatgctctagaagctttacagcttgcgttatcagtcgcaaaagactaacatataaaacggcgggacacgttcccgccttacataaaaaaagttaaaaatttttatgtttatctattgacattaaacaatatagatgataatataaagacatagaaagggaggggaaaacatgaaaagcaaagtaaaagcccaaaagaaagaagtaaaagagattttacagacaagaaacaaggcaataaacgagcttaaaaatttaaataaaaaacttatacaaaactattgacaaaaagaaataaacattatataataaatatgtaaggtaaaacaaggaggaaaaaagaaacatgcaaaagaaattatacaagaaaagagatttttataaaaagttagcttcattcgctgttatgtttttacttggttcggttgttacggcggtattttcattttcagtgtcacttattatcggtttgactttattcgtttttgcttttatgatttttgatgacttagactatacagtaagaaataaataaaattttttaatcaaaactattgacaataaacaataagcatgatattataaacatgtaagataaataagacaaaagaaagagggaactaaaaatggaaaacacaaaaaaatatacattagagggcttgaaacaactagcaaaagaaagcgggtttgaaattgaggaggtaaaaccaaaattacacgatattaatcgttattattggagtggtagcatttacggcggttcagacttcattttcattgaccacgatttaaaaattattgtaacaggtaacacacgagcaacaaaaagcgatatgtatacaagaaacaacacggaatgtaaacgaaaaagagacttaaacgaggaaaaagcttactatgaggggctagggtatcaagtatttaataatggggctttctcttatgaggctttgcgattattacagaatggaagtgttaaccgctcattaaataaagaatacagcttacaagaattgcttgacatgaaagactaacatataaaacggcgggacgtgttcccgccttacataaaaaaattaaaaatttttatgtttatctattgacaaaaagaaataaacattatataataaatatgtaagataaagaaaggaagtaataaaaatgattattgcagaaaacgaaaaatatttattaaaacacccattaaattcttgggacatgaattatcatttaatcgaaaaagaaacaggtaaagacttcttaattgatattgacgacgtagcagacaacgaggaagaaagagaaaaatatgatttagttttattgttttcagacttgcaaaaccttaacactgatttattgattgaaaacagttggaaaacgttagaagatgaataaaaaaatttaaatttttttattgacaaaagacaataaacattatataataaacttgtaagataaataagagaaagagggacttaaaaatgacaaaatacggaaaatttaaagcatacttttataatggatttgacaaaccaaaattggtggcaacaagcgttacagggcttttaagagatgttacagtatccgacacgtaccaaggagatgtaaccaaagaaatgcgattagaagtaaaagcgtataaagaaggacaaaactcttttcaagaatttaaagagtatttacaagactttaatatctttatagacccaacttattcggaattaaaagaagcttcacggcaatggttcggaaacgataccccagaacaccatttcacggaatttagacaagcagaagcacaagcaaacaaagaagaaaacaaggcgctagcattggcaaatgtgacagaatacaaagacatgaacgactataaacaagactatgaaacactagaagaagcgcaagccgattttaacgaaaaactagaaaatggctatattcaaaatatcacattagcaacgtataacggcgctacacaagaaagcacattttacgagctaacagacgaaaatattctagaagctatttatacagacttgcacgaaactgattcttatgatatgttacaagaaatagaagaaagcaccgatttaacaaaatgggactatatacgagcttatacagaagtttataacgtgtttacacttaacgggcttgtatacattgaaagagactaaaggggggacggtgtgacgatatgaaactaaacaagaaactagaagcattaaaacgggctagaatggaaaaattagcccgtgagacaatcgagaagcctatagaatttatttacaacggtaactatacacaagaagaaatgtattatttcatggaagaacgaaaacgattgaaaagaattaaaaaacgagaataaaatagttgacaaagaaaaatatacatggtatattatacatgtaaacaagggaaacacctattcggacgaactcaaaaaaagagtataaaaattttagtcaaaactattgacaaaagacaataaacattatataataaacttgtaagataaataagagaaagagggacttaaaaatgacaactttaaaagaagcatacaacgaaattattgaaagcaacgtaaacgaaccagaagaacgcaaaacatacttacaagacttaacacaacacggggcaattagcggaatggttagcggtttgatttactacaatgaaacaactcaattctttaatgaacaccgtgacgaaattcttgcaatgttacacgaactaaaagaagaaacggggctagacgaaaaagggctattcggtgataagtggacggattgggaagacttactagaagaagaggcggacgacttagacccgttagcagacacaaacaatcaaaatttactagcatggtttgcggtggaagaactagcaaagaaagaacttgacgaactagaagaagcctagcaaacacggcgggacgtgttcccgccttacataaaaaaaattaaaaatttttatgtttatctattgacattaaacaatatagatgataatataagagtatagaaaggaagcataagaatgttagataaagaatatttacatcagcaactagaaagaagtttctaccctataaacgatattaaacgtttatcagtgctacacaagcaagagcttaacaacttgaagaaccatgtaagaaagggggctacaccggaacacgtagccaaacagttggaagaactaacaaaagaaatgaacgagctttctaaccttgcgtgttcattagagttatatgttagaagtgtaaagaaccaactaggcaacgaactaggcaagaacgtaaacaaacacgaataaaaaaatttaaaaaaagttattgacaaaagacaataactattgtatacttaacttgtaagataaataagagaaagagggaactaaaaatgagtaaaacagttgaaacagttattacattgatgaaaagagcagaaaagaagggcgtagcaatcaaacgagcaagacaacgggacatgtggggcgtgggagacttacaagaagtgtatcgagtagaaaacaacggtaaaacagtaagcttataccactatgaaacactaaccgcaaaagttgaccttgaaaacatgcaactaatagaggtatacggggaaagccgttctgatagtgatagcgtggcaactttcttatctgaattaggtttcaaaaattttgactttggttttaaaccagtaaacgggggcttttggttattcactaacaaagacggggaaagacaagaaacctatctagacgaacaaggagaaaccgccgttataaatgaatttaatcgggtacaggcataacaaaagaaagagggggaaacctctctttctaaaataaaaattttaaacttttctattgacaataaacaataaggataatataatactagtgaggaatgataaaaatgcaaatcgaaattatcgaacctaaaaaagaatttaaatttttaactagggaggaacttaacacctatcaattagaagcgggggaacttgtggaactaacttatatagtaaactacacaaaagaaacgcctaaagaattgacaagtgttttcatgtttgcggataccatcggggcaagctcgtatcttgtagacgtagaaacgggcataatgacaaagacacaaacaaaaaacccgctttctaactgtaatctagctataacaaaagtagactttttcaaaacaagcaaacttatactagaaaggaaagaaaactaatgaatttaaaagagtggggctatacatgggacggcatgaaagaaattacacgggaacaagcaaagaaacaatacaaggaaaaagaaacatttattctatatagtgatgacacagaaagccttatcgagtcagaggaacaatttaatataaagggcgttcgttacggtgtggaaaaggagggggaacaatgaacaaatttctagaagaaagaaaatcagacttgcttattcaacaaaaagaacaagctcaaaccttattacactatatagaggaaaacaaagaaccagaccaaaccatcatacaaagacaaacaaacaggcttaacaggttaagcgctcaaatatacgaaattaaaatgatacaaagaaaactaaaaagaatataaggagaaaacagacatggaaacagtaaaagacattaaaagaatgataggaacactaaaagaggatataaagcataaagaaagctatataaaggaattagacgaacaaggaagaatgatagagtcagaactattgaaagcagaagtaaaaggaatgagggacgttatacgggacatagaacaagctatatactagaaggaggggaaaacatgaaagaagttaagcttattcaattagacaagaaagaaatagatagttatcacacatggggcatatttgacacaacggaaccaatagaagacggggacagaatttctatatatgaccataaaacggggggcgttttacttatagacgttataacagtaatcaaggaaacagaaggctacttctttcttattatagaggaatagagagagaggaaaagaagaaaaagagcaaagaacccaaaaaccaaaaaaaagaccttagagcctg

SEQ ID NO: 9 - DNA, 152140 bp, synthetic construct
  misc_feature 1..152140: note = Efs3_colE7
  source 1..152140: mol_type = other DNA
agattttcaaaacccgagcttttcggaacccgcttataagggcgcacactgtttttctatcattctagcacaaacaggaagctagagggcacacaatagccctaggaagccataggaagcccttagagcgattttacatagatttatatataattatccataaataaatagaactatcctagaatgctttaaaatagcttaaaataaattgaaatatttaaaagtttatacttgcatttcatctctttacatggtatactatagatagttaaaagagagcttcattattcggacgggaaacaaaataaaaaagttgagtttaatgcttgacaaggtaaaatatacatggtaatataagagtgtggttagggttaaaccttacaggaaaacgagtacgaccacacaaacaaaaaaatttaaacaaatctattgacattaaacaataaagctgatatacttaacttgtaagataaataagaggagggaaacaaaatgacaattcaagaagttatcatatacggggcgcaatacggtactaccttaacagaggaacaagtaaaagcattctttgcagaacatcaaggaacaccaagcgcaatgcaattggctatttttgtaggggcgatggatgaaaaaggcaactttctaccaaagaaacaagcttaaacgttatttaatctaaaaaccaaggtgcaaggcaaaaaacaggaatgctattgcaccaaggtttgcgggactaggtggttaaaacttccctagggcagaacttcatagttaaaaatttaatcttgttattttaaacttttctattgacattaaacaataaacaagttataataaacatgtaaggtaaagagagggaggaaatgacatggaatacaacacactagacgaattattggacagtaaagaatttaaggacttcatggacgaactagaagacgatggattttttgaccaattcgaggacgaagaagacgggaacacactagcagacacgggacgttatccagaatagagagagaggggcttaacaatgaaagcaattataatcaaacaacttaaggacggttacaaaggcattctagcacgtaaggaaaacggttggacgaaagaggaactaatcaattttacagcgggcgtaagcaatacactatttgaccttatcaacgatttacagggcgggggctttattacagacaaggaagcggaagaaatcgaggaagtattttctaacactatcgacacactagaattttaactataataaaacagcatataaagcccgtagcgaggttttaacgggctttatatataaataccttaaggagggcttacaagtgcttacagtggaaaacaggggcgttaggtggctagtgagtaaagaagcatggcgggcgggctttgctatggaagtgctaggcttgccagattgtaaaattagtacagtattaaaagcgggctataaaattattatttaattatttaatcatatctattgacattaaacaataataatggtattctatatatgtaagataaatgaagggaattgataagaatgaaaaatctaatgaatgaaactatctatagtaatattacattaaacctaactaagaaggcgcaaggcattatatcccaatatgtagaccataacgagggctatccaagacaaaagaacagaggtcactactaccgctatacagttacatttatcaatggtgaaacgtttgaaagtaatagcagggcggacatcgctcactatatttcatctatgacagcggacgaactagaaaccatcatcaaggaagcacaagccgagcagtaagaaataggtatataccagttaaccccaccccgtggttttgtgaccgtatttaggggcggggctatcagggcaccctcgaccctcgggtacctattttttggactggaaattttttctagaaatttggaaagtcaacactaaaagtcaacaccttatctccaaccccaccccgttatttcctctaatctatttatctaataaaagaccccaccccgttgatgatgaggtctttttattgtgacgtactccatagttacattcctttattccaacctcccacatctttatgagtatcgaaaccacaatcggggcagtaacctgcttgttctgcatctgttgggtacatgctatagctataatagaaagcatacatccccatgttttcatgtgtacactctgattcctttttcttatacgggtaagggcacgcaggacaggtaaatgtgtactctcctgttgaaccaattaaacgttccccacattttgggcaaatatctgcaaccatcttagtcttcccccactataaatcttgctttagcctttaatggtgcgtagtccttttctgttagtctcacgtaagcaacacccggcactcccggagagcatacgtaagcaactacaccccagtctttaacttcacttactgtagcaaaacatcccccaaacacggcatcaaaatgcgggactatttgaacaacgtcatatacttctgtataatacttcatttattcttcctccgtatttaatgggtcttgtagatagaagtcggagattccccatttgtttacataagtgatttctccttctttactacctgtcacctgtcttaacttgtatgtgatttcttccccgtcttcacgagagttcccgtctttgtctattacgaacaatggagtcttctctgtgtctaatagttcgtaacgctcacctgttagcttgtgtatataaatcatgttatccctcctttagaacaatgcacatatagatacaatcaccatagttttcactgtcatatgtgatatagtctacttcatagtctagtaattgttctgggaaatcttttgagtgaaactccgtacgccatgactgttctgcgcaatagggttccccgtcaaagtctttaatatagattcggaaagagtcaccaactgataggatgtctctaacttgtctaagtgttaatttcaaatgtcttgcacctccggttctgtgatgtctaagacagctattacttgtacctgtcctactccttctatatataatggtgtaaacaaactagttaactcgactaggttatcatgtctaatcgtgatagcattaaacttataattacacccataaataacttcatagatgcccataaaaaccctcctgtaatttatacttaaagtatatcacttagagggttaattgtcaataccaagcaggcaaagattgttcataatcgaaagaccaaccactagagtttaaaaattctcctatctcgtttacactctttgctttcataatcttctttctagcatcgaggttttctttccttgttatactactatataaggtttctcctaaccttatgagaagttcttctttaaactttttgaaggtttctccttcgtaatagtctgcccattcccatgtaatactttgtgtgcctttaaatactttactgaaccctgatatggttatggtgtatttgattgtcattggtagttccttcatcgtcttatctcctatacccatgaaatcttcctgttttgttgtggacgaaatacctctactttacgtgtatgaatgtccctacctataatagcgtaaggactataatctattacttcatacaaacgtacagtgtaggggtgttcttcccgtataaagctactagcttctgcaatactgaaaaccttgttaacaatgcgtactgccttcattacacaccactgtacctttcttgctcttcatagatagccatgtcttcttgtagttcgacttctctgtctatacatttataacaggtttcaaaggtgtagtcgaagtcacaatctaattcactcactagtcttccacaactagcacaacgtacctcattttccattactttgcactcccaatatattgaacaaaataatttgagccttttttagctaaagtaaacatagctgtaacttctccttgttctattacttcatgagtaattaagtctactaagttaatactactcatatttgcaataaaagcctctccacaaggatgcccctctacaagtatatgtgctcctgatgctgaacgacctctgtaagagtctaggatacgaatgtgtcctttaaaatctaccttttcaattacttggtatttttcggggtagtgttcaatataagcatccccatattcaagtaaccgccaatcagttaaccctcttgctttatctggtacccaaatattgtccaatctttctaaataataggttactgccattgtttctcctccttgttaggtattactcccataggaatatatcgtttcttataacaaaaatgtcttctagcggagtattataatgcaactctacattatgattctctttcatgtaggtttttgcataatcaaataaatgctctggacacttaaaactaaatgaaccaccatctgcatctttgcaagctatatgctcttccatagtactattgacaaaccagtttacacactttggtggataacctagcataattcctagtgcataatcttttccgtgttttcctgataatttagaaaactcagctagttgttccaatttagaaacaacaagtatgccatttttgcctacagaagttgcaaaatgctcccgtacaacacgtttaagttctggtgtcccaataaagatggtatctcttagtcccaaattaaatgccacagtttcttctgctaaaataaccatgataatctctcctcttatacctaattactcttttgatagtttgcttcttctaattgtcctccactatttcgctttaaaattatatacaggtttgacaatcttttgaatatctactgtatctttgatgatttctttgatttcgtcagcattcttgtatgcttttggtgcttcgtctagtgtactttgaacaacagatgttgtatagataccagacattgtttgtttaaactcatctaagtcaagcagttcttttgctttagaacgagacaatacacgccctgctccatgaggtgcagaattattccaatcagtgtttccttttcctacaccaatgatagagccttctttcatgtttaaaggaataacaagtctaacaccctcctgtgcatctgtggcacctttacgaatagtgttggaggctacatcaatataattatgaatagagtcaaatgagtcaactacagtccaacccatattagaaacaatcttatcaatgatagttttacgattcatgtaagcataacgttgtgctagttgcatatcatttaaatagtcatccactgcggaaccttctaagtatggcaattgtggtttaacattgacagctttaaaattcttaatagcctcttgaatttctgactgtctgccttcttgcttaagtgtctcaatcatagttgctaaacctttgtcatcacgttcatggtataaatccgctttcttctggtgatattgggctactttaagtcctaaagaacgggaacctgtatgaactaataagtagtaattgttttcgtcatctttacttaattcgataaaatggtttccaccacctaaagtacctaaagacaaggtaacacgttcaataaatggttcttctgttgcacctttaaacgtcatagattctaacatgtgcttaatcgtattcggtacagtaggatgaagttcgtccaaattttctctaatgttaaacccagaaggaaccactctgttaatcactgcatccaatttagcccattcggtatctgtcgtgtcttctggcttctcaatttgagctaccataataccacaacctacatctacaccaacaatagagggtacaactcgtttaataccgtctggataatgaatcgttgtaccaactgtagagcctttaccataatgtgcatctggcataattctaacaatgccaccgtctgttaccggttcattaatcattgttgtaacctgaccgatagtgccttcatcgactgtattaataaacattttcgcatcggtatacttaccgttaagttcaattaagttattcatcagttttctcccccactaatactttcttcatcttttcatctagtctctgtataatctcttgttgttcctgagctagctttgcatggtgttcacgctgttttttatacttagcataagcaaatagttcttctgtagttagttcttctaatttacgtgtaaatggtgtagcttcaaattccattacaagtacctccttgttttttatacttaaagtatatcatgtaagataaaaagaagcaagcagtttttacactacttgctatatttttttaaacaaattcttctcttacttctccccaactttggtctgggtctggtaagctaaaaggtagcttatcctgttcttccttagataagctctgataacacttctcatgtactgcaatggttccagaactcccctgagcaacaggtaacacactaatcaattcccgcatagcttccctaaactttttatagtcttcatcttcatcgttatcgactaggacatacacgtcacattctgctttacgtgcatttgcaatgttttcctcactaggagcatcgtagaaattttttctttgcagttcaagatacttgactgctttaattagtcttttagcatagtttttagctatcgggtcaacatcaataccattttgtaaatattctactaattgatacttcgcatcccctgatgagataccgaatagagataagtaacttgtagataaaatatctccacttggaagtatcttgttagaaccaaaatggtgagaatctgccctaccaaactctgaatcacatatctcagagtggctattagggtttggagcaccgtctactgtatggtcttcacctctatagtccttatcttccatgacaccaccatactcattgtagtgccctaccgtttctccaattaactttccctgtctgacatgctttaaccgacaaagttccccaccattaaagcagtcacccacaatctgtgtattacatactggacaaatataaccaaaacaccccattagttctctcctcctttttcacttgggtctacaaacggaatatctattgcaccaaccgcttcataataaggcacaacccgatatagcgttcccggacgatgcttactagaatttttcatagcaccttctgctctaccttttgttgtatgaaccccttttacagtaatttcaccagtaactctgtgtttcatttctaatacatataatggcatcttacattccccctacaagtttgagaccttcgtttttaaaggatacttctctagctttttctatttgttctagtatacgcacagcttgtgaagcaccaccaaagccattgttaatattcacaacagaaataccagaagtgcaactagttagtgcagtatttaacgctgtgtaaccatctgctgaaataccgtaacctgttgaagttggtacagcaataataggtaaatcaattaaacctgcaagtactacaggtagtgctccctcaaagccttgtacagatactaccgcattactctttgtaatagcatctgtagaagccattagttttttcaagtcatttacaccaatatcatgaaacgacacagggacatatccatttaaaagtacggttaaataagcttcgtctacggtgtctctatcagctacacccgcagatgtaattgccacagataggtcactctctgtagggtttgcacgataaaacgctgtctgactagacttgcaatacacaaaagggcttccttctccccaattatctatccaatctggttcctctagttcctctgctttttctataatttccccccaagagagaacctgtgatgtttcaaaaggtagtgcatagaacacgtctaaaggtaattttgttaccatgatatttgtatctgcgggtacctctgcaatctgactggctagttcctgtgcagttttatttccaccaaatagtgtacgtaatttcattagttaatctcctctaaaaatttagttttgtctactggttctatcgttccatcttcctcgattccttgaactttgaatagtaagaactctggcatcgcacagacaacagcagggtcatatgctgtttccgggtcacatgccatctcaaacatgttagtgtctttgttatagaaaaaacataagtccccgattctttcatctgggtataaaaagtcagcaatgtaaaacgccatgtatttcatactagtttcctcctgttattttattgtatagtttagtaagaaatccaatctttttattgctaggttcagttaccaaccatgttattgttagtgatttaattcgtggactcaaagcattttgcagataagttacatagtcattctcttggacagatactgaataaccctttcctattaaaaatcggttaactgcctctacctcctgcttgttaatattaacgtcagagataacacaccagtattgccctagctccactgcttccttaatactaggtagtaccttatttttaataaaatctacggaattttggactaactcttcttcgatttcctgttctttttcaacagtcttattataagcctcctctgctgacatcattatgcaccaactccaatttcttcatctagctttaaggatttaatcttattactaaacatgttagcttgctcattataatgtaaagctaacaacatcttaatgttattttcaaactcagatgcttttgaatctacatatgcttcccgcactagtgaatacattgtgatgttatctttacagaatgcccaaagaggtgtatccaactcactttttagcacacgagttttaaacagatagtctggctctttactacggttctcaatctgcttttctgtaattttcaagtcttcttctcggattttcattacacgagtggtacatgtaaagtctccttcgattacttccgatggtctaacatctactcgtacaccaactaaatataaagaatcctctcttgaaatatatacaggttctatgtccacaatcttagtgaatgggcactcgtaaccattcttagcaaaccaatctgtaattaaggcttgtaactcatcttgcttatcttctggaatttcatctgttaggtagtagtcctctgcaacttctccaacttcttcatagaccatctcttgtgtacgttccaagaatgaatcaacatctacagggagataaaccggagccactcttccaactacaaaactattgattggttcttctggtagaaatcctagaatatcctctacgtgttcccagatttcttctacaaaagttttcccatttctaatggcatctacggctagtttacctgcatgaatagcctcttccttggtatcgaaataagcacaagctctccaaacttccacatctgtatcacttgcacacatccattttcctactaaagattcattactcattttttctttcctcccactttatccttatctagaccccatatatgtgcccatttacgacaaaagtgtttatcataatctaagtccataccggtagcaccttcgaagtctttaaactcttcataaaattccgattctttaaactcatcccactttttcaattcaaccatcctatacataagttggtcaaattgatagtctggtattttaattgcatctaattcataatacagataactgtgtagtagtaaagcacgctctgtcatatttataaaggacaggttatctagtatagtattatttacaacggtcacttgttactcccccggaattgaaattattacttctatatctaacacagccataatcttaaacaaggacggtaagctaattacagttaacccgttttcatatgtagaaatggctttttgtgtaatgcctgcctttgtagctaatgcacgttgagatagaccttgttcttctcgtgcactatgaatatatcctcgtaatgtatcagataaggcacgtgtatattcttctgtgtcatctttattaacacccagttcagcaactgtttcggttaagttgatttccatgttttctcccccttgcctttctatactcatagtatatcagatacctttcagtacgtcaacaactttaaataaaaaaatcctagtatttactaggattttttctcttttattgcatctgcgagcatctcactaaaacaggttcccccattatagaaggtaaacaaaaaattatacaggtctgattcaccctccacaggagtaagtaaagacacttcatcattatctaagatagtttgttcgaccgcatgataaaggtcatcccctactttaacgtagctatcataattctcttctaaaaaccactccatgtcactatcataataactaggtcgttctcccctactttgtgtaaacaagctaactgcttgatactgttctgcttctgtaagcttacgtaccttacctacacgtgtttccatttctgacattataatcgctcctgcattaattttattttgctttcaatgattcccttaacacactcccagtaccacattaggtgctgatattcattctcagagacttgtgttgttagaaatctacattgagcgggtattatttcatgctcatcgaaatacaataatatttggtttctatcgaatataactgttgttaattcccgttttgggcggtcactaatgtgcatctctaaaatggtatacaacctttgtatattatactcctcgtctaggtttatacttatcacaaataaacctcgctctttataacgattttcgcactccacaatcattgtatttactaactggttatgcttgatgtagtccttactttttacatgcacgaatactcactccttaaatatggtcttcatctttaaatgtttcataggaatagtgaacctgtgttctaacataaaagaccttattacagcttggacaagttgtttcccaaattgccccctcctccacattttctgaactatagattccagagtgatacaggtcttcctcgtctttcatagtttccttacaaaatggacaagtgggatacatttccttctcttctataatgtatcctttatacataataactccccctacttaaatgcttcgtctaaatcaagttcacgttttgcgatttcagtgatttcttcaatggcttcttggtattctcggatagttgtaatctctttaccatttcctcctaagacccaatgacgttgaatcatgtgtaaagcttttgtaaggttcgtttggtaaccgacaagcgcaacattctcgtttccttttttgtcgtaagtgatttctcctttgtcgttacgaactacacgttttacagttacgttgtctgcatcgctagtaatgcggtagtctaatactttcatgtttaacattatttgtctcttcctttcattcgttggtttcctgtacgaggtttaaatttacgtggtaaaacacgagtattgcgtttagcttcattgtatttacgtttaagccgaacctttctgtctgactgatgttcaaacatgtctgcaagagcggagcagtaatcaatctctgcacgtactttttctcccacatatctttctaaatagaatacatcaagagctactttactatagtcaatatcatatcgactaatagtaacaatgcgctcaactgtgtatctatcacaaatagagaatcgtaagtaaattattaactggtcaaatcttaagtcataatagagtggtttaagatagtccaacttaatacggttatctatttcgtataggtgttcttttgtatagtctaacagagcaataattcgattgtctgtctcattcatttctaacgtcataccttcgtcctttccggtgtgcattgatagagtctacaggtacatgtcttagctgaaagcttgacgtattagactcggataaaagccccttacctagacctgtccgctaacagcggataatattatctaggtaagggctaaggataaacacaccctatacataccgttaatgtgacacgcccggttcgttactgtcttaaaataaggtctgttggtagtactgagtagcgtttttcatccactgggtttaacccatctttgccgagaactgccactacaagtttgtcttcatcgtagcctgtaactaccaagttagcccccattagttgttcatttcttgcataaagtcctgccggtgaatagagaacccaatccccaatgttaaatacccctttaaggtacttaccacacattggacagtacttaataaatgttctagcctctgcggtcattgtcgtacgaacattcccataactgtgaaaactaaactgtgcacgcaatacattatggtctacacctataccaataccgcctgattcgtcctctaaattataaagtaattctccaccctcacaccaattacacatgttgctcctccttcgctttttggatttcactttgtaaaaaattaatgtaccttggattttctatattaaacatatcctgaacatatacggctcctagttctctacgatacgcatagtccacaccaatacgtctatagaactcatggttaacatgatacataaactgatggaatcttgtatgctgtcctcttaaatcatacagctcctgtaataggtcacagatttgtacaaattcttcctttgttccacttgccatgatttatctcctccttacctgttacctaaagtatatcaaaacccagagcatctgtcaacactctgggtaacttttttattgtacagataataaggaagctacgttaatgtaagtaatcaaacctttttctacgtcctgtacaattgggtactctgctttgtcttcatacatgatgttatctcgtacatatagcatctctgattcaacataacggaatatagcatctgaactacctgttgttgctaatcgtatccgtttcttatccgtagggtttgctatgactgcctgatttttacttagcttacataacaacttaaacattcttgtaatgttttcatcttctaaagccggagaagatgttgttttcttcttcaatcgttgttccatataaattggaattgcttgtgcagataacttcatcgtagtatcactatttaagaagtactctgtagtagttaaaacaacctttgattgttctaaaaacttaagctgtaaatagcatcgcaaatcatcttctgagaatgatttttggtattttgaatggtctgcatttatccattctacgatgctacttaagaaggttacaggtctcttaccagagtaagaaatactgatatagtcagacgtatttactacctcttttgcacaagagatttcatatatggtagccccctctaggtcgctatcttccccgataaaaatagtagttaagaagctacttggaacaaatcctacatggataaattcttgggtttctggtagatgtgactcaataaaactacctaaaagttctttccataagaactgctcgtccttgactaatgcttccttcttttgaagtttgtagaacagaaggtcaaacgcagtataccaatcttcggaaatttttagtttagttaattcttcatctactggaacatcaatagtagcagacgtgtcttcctcaacttccgtgctatctaaatcattgtcccataaatcaaatgttttacggagacaaaactctctccataatgtatcacttgggtcttctccatattgcaatagcatctgctttccaattgaagttagtgtaaccttacctcgactattgataccttcgttataatcttgaatacatcctttataccgcaaagaaagtaacatagtgttagttgctttatcttcgataagttttaatatttgtttatagccatactccatatagaaaacagggaagttcttttgctcaacaaaagcttcgtgctccacctctaacccacgtttttgtcttcctagtttatcaattatacgaagcgcctctaattctcgttcctcaatggttacaacatactggctaattttgttttcgtaagctaaagcggtgttcatctcttgcaaaatctgtttaaataaatcgtttgcatcttttgccttctgagtcttaaatgttctgattgtcgtatcatagaaacgttcgtgactcgaaatagcaaactgcccaatgtatcgcttaccttttaaatttaaacggttttcgttacgatttcctagagtaaacgttacgtagacagactcactagacttagaaaaataaatgtcttgaacaactatgccgatagtttcaagctcgtttatacgtttagtaaaatcactctcatattgtggtctgtttatatttttgcagtgttttctatagtgtactgccacagttttcgattcttttgccacatccaattacctctcttatctttcttcttttgcaacatatgcctctaatacaatggttctaataggttctatttcgtgtacttcatctctgaccttcttgattacaccttctcttagcagtccttctcctaacttatgcgaagcttctagcattcgtaagtttacaagttcatcactgtcaaatacactcacatctaaccttactctgtaaggtaatacttgttggtgtacacgggtgactgttaggggttcccctataagaggactcttcccaactcgagaaaatgcccagttatctagtttttggttaaaccgcttctttaatctgtctaacatgttttcacctccatgtatatagtatacatgttaagccttacaaaagtcaacaataaaataaaaaaacatacaactaagtatgttttttcggtacaaaatatttctcttgaatattaccgtctttatctacaacaacgccatttaactgtcctccataggcacaagcaccatcaataaagactgtacggtctcctaaataaatatcacagttattgcctctatgaaagttaactgtaggtgtatgccctacaataatagttttacttgtttcgttcttttggaatggatttggtctagtccaaagcatttcatgttcctctgctgttttccagtctggctgtctccatcttgggatacctccatgcacaaatagcacgttaccgaactcgtagtaaggttctaggagttccaaggtgtcttttacattagagttattaagaagctctgtacgcaacgctagggcgctaagagaagctgtcttagttcctagaatagaattagcagtctcttgacctccttgataataccacactgagtatatctcttgcaagtcctcataatctggttctaatcttaatgggaaactaaggaaatctaatagcatttggtcatggttccctttaattgctgtgccaccagaagccatatgttcataaacaaaacctagaacttcttttgattggagacctctgtctacataatctcctaaaagaaccaattcctgttcttcacaattccaattttttaataactccataaactcatcgtacataccatgtatatctgatactacgaaagctttctctttgctcattaatcgtcctctactttctcaaaatatcgaaagaacgcataccaatcatatcgttcagtaacctgcttactctcgtgcataaatacaaactcaacgtatttgtgtttaactgcatgagggtctactggttcccaaggaagcctgcgaggataatcataataaacttttgttggaatgacttctcgcattaacaatttagggtaccgctttttaggacggtacctctttcctaaaacatgttcgtatgtcggtctcattctattataccatgtttcgtataagttaagccggactcgttgaaatgcttttccttttcttcaatcaggtcaatacactctttaattgtgtatggtgtcccaaaagggtgtaaagttaattctggtgaatcgacacctacatttaataagttaggttcttgataagctatctcatgaatatgtccatgtaagtttactcggtttcctcggctaccaataatgagcggatagtgtgttaaatggatgatttttctttcctgctttagtattacgccaacatcactccaaaatactcgttcacgtaattcctcatcccgattaattgtttttaaaagcttggtactgtcgtggtttcctttaaccatgataatgataccgtttagcttacgaagaatctctagagtatcctttggtttctggttcatagcaaagtcccctagatggtacacagtgtcttccggacgaactcgtttgttccatgtcttgattaagtaatcgttcatttcgtccacatcagcaaacctacgtcttgtctctacaaagccatcttctccacaaatattgtgatggttgaagtgcatgtctgaaattacatatgttttcattctagcaaccctcccaattcaaagttatcgaaacactctgcattgtatacattttgaatggcattccgatagaactctacagtctctagactaactggggtgaagttgtgtacatctactcctacattaagtccgtcacgtttcaccttttgtttttcatgaatatgcccaaataagccaaaatagccatctttgattttatcttctgaataactcatatgggaaggctcgtggacaagaactagtttttggtctacaagagtgacaacttctccttttcgaacaaattcaaagtacttttcttgttccggagtaatgaatccacctttaccatcacgttcatagttaccaaataataaatgaattttacctttaagctgtttagctacttcgaagttaccgaaatctcctaaatggtaaacagtgtcttcttcatctacaacatcgttccaccgttctatcatagctaaatcagcatgttctacattatcaaaatacatacctcgcatagaatatttgaaagtacgttcttgtccaaagtgtgtgtcggacgtaaaccaaatcttactcatttacatcatctccaaacgttcataacattttttaattaccaaggcatcccacattgcattatgctttacaccctccattgtttcaccattaccaagaaggaacgcaaactcttcacgagaaatatcagggtcaacgcctttaaccttaaataacgtacagatgtcaaagggaatatagtacacgttactgggtatagagagcgcatccccaaatagatggttgaataacacccagtcgtatgaaagacagtctgaccatacttctacagaattaaactgcgatagccattcctgtagtttttgtgcaatatattctgtatccccgtagtactgattttcttcttctcgtaggttttctttccctactaaattatcaagcacatgcgcctgtaaccattcgtctacttgtgtttcatcgtaatcgtttaactctgcataaaatgatacaccattttcagctataattccaatactaattaatgtagtgtctttatgcaatcctgtaaactctgtgtcaaaaaagattttcatgtcttactcctctatgcagtttaattataattatgttgtgactattaatagaactaacaattgaagataatgaactgtttggtcaattgttaattgtgttttggggtctggtattatcgaaggaaaccatgtactttgtgctttgagatagtccattacaaaatgtggtaaccatagaacaagtaaaatgtgtgctaatgtaatagacaaaccaattaggtagcctgtcatagcaattgtaaaagtccaaatagttgcatggataaataacacatacaagtcttttgttttttctcttgcaatatattcactttgtagtgcgtaatctcctacagcatgtgcccctactaacataacaaacatagtaatatatggtgtcattatattctaccaccctcatctaatagtttctctaacggaatgaactctgttgtccgtctaagaacaacatctcctgattcctcaattgtatcaagccaacgtttactaccatcactcatacgaaacagtcttaaagggtatcccatttcatcatattgtatgatatttgttctttcgtatacgtaaggctctggcttgttttttaggaagtcgaaccaacccattcctacccctcctcagttaatttaactattatttttaccgggataatttctaagtccttgtattttctatcgtactcgttacgctcccgtaaaattcgttttaaagtatctcttctacttacagcagaatcatacatggtgtacgcttgcgcatctgagggactagaagaccacgcatataaagtcagccctgctacataatacatatacatgtcccattccatgtcgtatactcttataataaattgattgctcatttaatctacctcataaccattttccaccgcacggtaaaactttaatatattacagtattcaccaaaccagtcttggacgaaggtttcccagtttcctttgtagtaatcatcaatgacagagcggataacatattcctttgctctatcatttctggtacctcctgcattttcaataatctttgctataaagtaaggaactctctcttttttcataattagtcttccacctcttcataagtatctgcaaaaatatcaggtttacatggataaacttcaccttgaatgcctcgaataacatagtctccaacagacacgtgcatccaaccttcaagagtaagaatataaagttctccctctttaaaccggtaatttgcctttaacatccattctggcacatagtagtttccttctgacataaaatctccatcaaatttaaacgcctcaactactactggtttctttcggaactttcttccttcttcttctagttttttaacatcaacctgtactgtttctcctgcaaatctattataaacgtagtctttgcaccaacgtacattctctgcatgacttaaacaacaatcaaaatcaattttaaaatactctccattgtgtgttccctcagtacgatacttcatttcactgtttcccccttttctgcaactacaggtgtgccatctggatgcaatcttacagtcatcccaccagctctatccccatgaaaaactaagtattgcacttttgtttccgggtctgtatacaccgctatatctctagaatctgcattagtacttttaatagtatcttcatttgcaacagaagagacatcacatgcccctaaaaatagtaatggcaataacaacaacaattttttcattttatttcctcccatagttctgtaatgtcttcctagtcttcgtcattaatgacaccttcaatgtgttttaactcacgcatcagtttaagaaaagacttcgtatccagtgtaattgatgagtagttacgttcttcttgtatagtaatctctacaaccttgtcttcttcatcgaaacttcggcggtcttcttcatacgttaccttaacactactgcgagtgtcctcatcactatataatgaatagtatctatcagttcgtatttccattttaattacttccctccttttgttggtcttgttccgtttccttgtacttttgttcccctatacttaatagcacagtcagcgtgctgtagtctccaatagccattctttctttcaaaatgaccttgacctttctctacaaaggtaccgcacctgtaacaataccccggatacttattgcgcatagtagtctcccctttacacaagttctaacgaaatacttagtataccagaatatttatcttttacagcttcctctacttggttaactgcttcttccagtgaaatagttgtatttgtatcctcggaataagtcttagctaaaatccgtattgcatgaacttgggaaacctcttttagttcaacagaggtattgtcttcgtcatccacataagcttgctctttgtatatctctaaagctttgctaggactataggctgatatgagagcaaaataaggactagttacttcatagaacttaattcctgttaagttaaagaaaggtgttacgtagtccattacgcctttttgcatacgtaactcacttgaatgttctaggttgttatagtgctctttttctactacgacaacctcgactactttacctttttctacttcatttggggtacatagtctatctctagctccaagataactacacattagtgcatctttaactatcgttccggaagcagtattataccctgttttataaaacccatcttcccttactgcaacatataattttaacggctcactcatactagttttcctcctctgtaatagtatcatagaaaatcatcccaaccgactcccacgctacgcataaaacaagacttattacatagtaagtatcttttatgatactcatttttaaaactcagagtacttccgcactctgaacaatataacttcacttttttgtctgggtatccatcgttgagtatctcctgcttaaatctcttaattccttgtcgtctattcatctataacctcttttccactggcacagcaaatagccagaatcgctcatctattgctttgatttccgcttctgttagctgataagcagatttttcccaccaacataattcaaatttatcattaaaacagaaatcatttctgtcattaaatttcttgataagatataagtcaccaataataacttcatacaactgctctttcttgacctcgtagccgtttttcatactcaacacaatgttcatgcagtcaggagttgcatttaaccatttttgaaaatctgttttatcttcagggtattctactatttcccacgcttcaccaatttcaccaaataaattattgtgtaaatcatccttattttcctcaaaccactccgccacaaacttcggcacaactggcttctgcggttcgtctaactttttcattaccgcaataccggcatttataccatcgttataacaaaaggctcttatatcggttcctgacatcctatggctttctaattccttaatcgcttcttgtttattcatagctactccttctctaaattctctctcttggctaacaatcggaaattttcataaaaataacctaaagtttcgtcaccgatagccccatcatctgcatcagtgtaaaattcatctttaactccgttaactaaaagtaccccgtcatcatctattccttcaacaaaatatacctttgcttcatgtgtacctttacgaataactaaatccccaacattcacttcccatttaggtattggctctacttcatctggcaatttaattattgtaaagtgcgttttatactctgggaagttatcgtctaatggagtaccagaatatggtgcttcactaataggaaaatcccaccaaagaacatctcccatgtcttcatgccatttatctgctcgatatgctataaccctctgagagttgtcctgataatctttcacaggttcgattgataaccaagctcccataaactcttctgtattattagcaatccactttagtgctactgtttcttgtagacttccggtaaaaggttgggacttagttttataactaactagaatttccattatagtatcaaagtctgtatccgggctttctttccaataagtgagcaaatcttgcacttcttctggcaaggagtaacttattatagcctgctgtttttttaacgaacgaatagcattttgtaagtaagcttcttcgacatcccgacttttattaccatttaaaacccgctcaatctcatcaattgcatgttcaatgtgattcattattattcctcctttaaatccccaaattttctgtctaattcaacaccaaattcaaattcatcagctttcttcgataatttgcacatatcttcataatttttcttgaagttcttatgaataatcggagaacaataacctgtctctatccgtgctaatgaatacttgaccagtctagcaattttatactctaatgtttgataattaacaacaatatttaatttattttttgggttgtaccactcatgtgtatatggaggcattgtaaccctattctcaaaccctaaacctgtcaacagctttttgactgcttctgtattaacttctaatgtgtccatgtctacctccaccagttaggttctttaataacttgccacgctctttttagttgttcttcgttgaaatgtccaaaatgacaatcctctttaggaataccaagcttacgagctaacacactgtacagctctcccctacttatctgtctagacttccatacagggtcaaataaactgtgacatagttttttccatcgtttcataggtggtgtggctaaaatacctagtggttcttttggtctgttcttgtgagtccctacactagcaccacaacctgtacaataataacatttaccattaccgtaaactttcccatataatacttcattacttgtccaaataactttagctccacagtaagggcagttatctggtactaacattttatccatgatttgttcacctctcatgtatacagtatacctctatggtatcagtaagtcaacactttttttacaaaaaaagaacagcatttctgctgtcctaaaaatcacaccaatcatctttatcgtaagaatcatctgtgtagtgttctttacctttaatgttattaacattaacatgctcgtcttcctctggttgctcttctttgtttttcttaacgaagtagtaaccaatagagaaagctatacccccaagcaacagtataataagagcgataaagaatttagcaatgaagaatcccattacttgtcagtgtccacaattgcttgtccgtcaccgattgtagtagtaacccaaccgtgttccttacgagcttgtgcttcttcgtaacgaactaattcatccgtaacagattctgcaattttcttgttagcttctgcttgtgcattagctttgtctctaatagcttgggcttccgcttgggctttcaaagtaacttttgtagcctcagtttctgcttgtgttttttgagttttagcatctaactcagcttttttagcttcttgtcctgaacggataattgcatcaattgatttttgtgtttctgggtcaacgtcaggtacacctaccgttacgttttcaactaagaaacctttaccttcaactgaatcagagaaacgagctaacacttctccctcaacctcagaagacttacctgaaagaacatctaacaaactgtacttagaataaacttcacgagcagtcttttgtagacgagatttcaaccaacctttttcaatgtcctcagatgttacgttaccgaactctttgtacattttagttgcttgtttagggtctactttgtagtcatacttaatgttaactacagttttcttaccgtcagatgtagaaaccgcaacatctttagcttggatagtttgtaaacggattgggtattgtgttactttatcaatacctacccatttaacaccgggctgtaatgcttcggatttaacaccaccgttaggtgaaaaacgtacacctacataaccgttgtcgattcgttcgaagaaacggaaagcaccgattgtacctccaatcaataaaataactgcaaccactccggctacgactaggcgtttaaacgtcttctcggtcataaaaataattcctccaatatttagttttttatgtgtaagttttccccttacaaatagtagtataccttacactgtataacaagtcaacaactttttttattttcttgtggaaaataatttaatgggtgtatggtcttccccttcaagatacttaccatcttcccacaagaccactgagcctttctctaggcttctctgcacatcaatgatacgttgattccatgaaccacggaaaacaaggttagggttgaatttatcctgctcaaaacgaccatctactagtacatctacgtaagataataattcaagcttatcttcccagttttcagcgttagaatccgtaagctcttcaaaggtataacctgaccatgaccagattgttttacctgttagctctgatttaatacgtttagctaaaggcagtagaacttgtgtatttaagaaaggttctccacctaacaaagtaataccatcacaataatcttgtgaaatgtctttaaggatttggtcttctacttcttgggtatagtcttttccccaactaaagttttgtgcctttttattataacaccctaaacaattaaaagggcaaccggagacgtagatacttccacgtaccccgataccgtctaccattacaggaaacttgtaatcagcatatttacccttagacaatctttctgctgtccatgtcattgggtctttactcatctgtatttccttctttcttaacatgtaagccttcgtcataccctgattgggtaaacttagcttggcaaattgcacacttataggctttgtaccctagattattatacggaaccactttgtcttccccatcttcatcttggtgggtacacgctttttgtagcgcatttagtatttcgtttcgttgcttgattaatcgttctttctttgcaaggtgtctacactcttcatgtagaattgcagactctgcaatggctaaaagattttgtaaagaggaagctgtactcattaaattgccacctcgtaattaaatcttccgttatgtttgtagccttcaaccttaagttcagatagtgggcactcaaagaagttagtcatgttagcctcttcccaaggcaatactagcttaggttctgcgtttagaacttcctctgtcataggagcagttacttgttcgacagcttgtaccatatgacggtcgtagatatgtgcattgtcgatattccagaacattgtacccaactctaagccagataccttagacataactacatgtaacgcatgatactgcaatacgttaaatggcagtcctaagcacacatctgcactacgctgtttaacgtgtaagttcaacttaccaccctgtactgtccagtgagtagcccatacacaaggttctaatgccatttcatctaagtcttccacatcccatagagttgtcataattctacgagaacttcgattgtattttagttgatatagaatagtttctacctgattaaacttaacgtagcacttatagtcttttgtttcagggttaacatcaaccataatatcctcttcgggaaaaaagtcttccggagaagctacataaaattcattattcgtgtctagttgcactttacgttttttattgcgtaactgccaaccataagcttttccgattgtaccatcttcttgttcccattcgtcccaaatagttactccacgttcttgtaaccacttgacattgttagacattgcttgccaaatccactctaattctgtaaatgcccacttagagcctacaaacttactcttaagaattggcagtcccatgtctggtgtaatttcaaagcttacaccttcaattgcatatgcaggagcaggttccccatcttcatagtgtgctcgtacttcatcgggattttgcaaaatacccttttctttgatggctaacacaaggtcagcataaattttgtcaaaactcatgtgtgttctccttttctatgttcgtctaactatattgatagagtctgtatacccatttcttcgtacccactctgtataactgttgtgctcttcttgcgcaatcgcttttaaagaaccataccacttcttgacttcttcccgttttttacgtttgaatactaatgatttgtttttatctatgacgttgataatcttacttactccaccagtattatctataagcattaatcgtgaaacggtcggttttgagggaaacatctttttgcattccctacatagttcttctatttgcccacctaatgcacgcaaatcagatactctacgcccgcaacgtatacactcagttccataagcctgctcaaaatattgtgcattaatacgaggaaacttttgcgtaagtcttagattagttgaaggtgttttaactctttttcttagtactgttttgtttttcttaaccttaacactaactgggtcattaccatcaaaatcaaaagaaaagctaattgttccagaagggctaattgttggggtaactacattgcgttccactcggtctgctaatacccgaacatctgttatacgaggacgtgttttctttgtgaataatcgtcctcgtgtgtagtctataccttgcatattacaaacctagccatgaacgtactttgctgaaagggggtttcttttcaggttccttgtactcagagtttgtacgttttaatttatcattgtagttatctgcaagtgttaacaattcatcaggatttactgtttcacaataaaaagcaatctcttccccagttagctctctattttcttcaatcaatttatcaagagtcaaatcgcaatactcatcttcccagtcagctaagaagtacatacgttccatgacataatctgatgtttcatctaagaatataccgaatagaattgggtctttatctcgattatcttttgctacttgttgacctacttcatctgtatagtctgtaaacatgataactaagcggtcaaatttatcttgtacacgttcgattacaggaacaacttcatccggaatttcacgggggaaatctttgaggtcagctagtttaactgaacgattttccacattttcaataaagttttcaatatcttctgaatacacaaaagttgtaatgcccatatctctaatttctttttctaattggattgttctaatatgatggcgtaacaaagaaatctgtctatcttgctttgttttaattgccttttctagcatacgtaatgcgtttgcgtaataacggtctaggtcggcatcttgattttcctttttattttgttttactcgttcgaagaactctgtaggtgatagttcttctaatggtttcgttgttaagttttcagtcatgatacatcctcctaaaaaaatattccttacaggaaataatatatcacctgtaaggaataaagtcaacactatattaaaaaattgttgtaagcatttgactgtggtctaacgctaagacagcatccccagtaacacgcccatcacggtatagaatgattgtagtatcatcagttgagatgtctactttagcctcatgagaggtgatggtaaaccatacgtaatcactgtcagattcgtcttctttacgttcagcatctgaccgcatttgagctatatacatttgtgcaagattatgcccagaagggtctctattagggtctccaaacactgtagatggactaataccttcttcttgtccgtctaatgaaactgtttctaaaatactctcagcaagcatattaggggtatctgtggctcctaaaaaagcgttaggtaattcgtacacaccttcttgaactcggtgtagtaaaatagtagcacctacttctaattggttccttaatacaactaaagaaacgttaaatcctactttttcaatcatgttctttcctccatttttccatttcatttattttatcaggcaatgttcttcttgttaaacagcctgtagtacttacatgaagcctttgaactccattatttttgcctagaacttcgtctgctttcttatagagcatgtctgtatgttttggacaagctatctcattaaaagatgctccgttatctgctacacttacaatcccgtttgcacagaatcgactacgacaacctatacattcattcgctagcttcttcatgagcaacctcccactctgtggcttcccttaactgtagctgtctagcttcttctaaaggactgatataatcaggtagctcatctaccggtgtaaaacgttttgtcccgtcttcaagtataccataaaaatggtctgccggacgtgcaaaaactgtgttagcatttggtgaataagggttaggatacattcttcgatacaatactaactgctccccagtctctgtatgaagtacatcatcatattctagtgtagcataataagcacccttataatgacgaaaccacgttccggctctatgcttatattccattcctcttcccccctaaagaaaagctagcactaggctagctctttatttttacctttgattaatttaccactttcatcataccacgcatagatggcagttacaacatttgtttgatataaaacatctctaattgcaaaccagtagttaccagaaccgaaatctagtaagaaccaaaagaagttacttgcaaaccatccccaccatgaaaagtcaattcgcataatcattaagaattgagatacgattcctagcaagtaagcaataatgttaccccaatacatgatgttacccattagggaaccatctgtagtaaagccgattttatctccgtacataattaagacaattaaacctacaattgtgaatgctaaagtaaatactacccaaaaagcgttcatcttacctactttaatacgcccatcttcatcttgattggattcttttgtccactcttttaacccaataatgtgtgtaataccgtagtaaatacctgcaaaagccaaaccgaaattcccaaacatagtattaataatgatttcaccaacgttagagctaatacctaagatatttcccattttaggatagcggtctgctaaagataccacacaaggtacacctaagcagtacgctgtgatataaaataaccagttagttttatctgaccagtcggtgacaaacacccctacaaccagtcccagtactaccaaagtgattgcgtactgtttgcgccatttcccattagctagtgaaatattgtccataaatgttttcatattatttctcctccttgttagtccaaatttcgtcaacgtataattgcaacgtgtcaactgtagttccttctaggtacttttcgataattttcttgcaaagttcataacgagtttcataatcactcgcagttacttccacatatgggatatgattctccgcatataatttcttcaacaggttttggaagtcttgtctacgtttttcatcaccgattaaacgcataccatcgtctacccatttagtcgaattatctaacaaaataaccaaatcaaagcggtcattatcaatcttatcttgtacagatggatgaggttttccttcgtacgtaatacagaaggcttgtgtggctacgtagtctgtatccgaaatagtaaatctattagcattacgtcttgcaaatcgaacgtcttgatagtgaccgttagcaattgcttggtagtcactgtactgtaatgcactctcatctccacctaattcaagttcacagtagttgcgaccgtattcccaaacagtcgtagtagcaaagtagttacctagcttatctaccatcaaagttttaccactagactctcctcctgcaattacaattgtaggagccaatgcttcccggctagcacgaggtagatagtcccagtacttaatagggttgttacgtacttttgttgcactaatattaacattagaacgctcggggtctactaacgtagtaggacagccaaagtatttttggtacccttccgcatcctgtggttcacttgaaaagaatgttgcttcttcccaatcaaaacctctttcagccaacacacgattacctgttacagtctctttcacaaggtttgcccatgcttcccatccgttagggtactctggaatgtttgattcatctacgagtacaggaatgataacatctcgttgaacttgaaaagtcttttgaacaattcgtagtttgtctcgtgctgttagtggacgtttcatgttagaatccatgtataaacggtcgtctcgactatctgagtggcttaccactacaacaagagtctctacttgtgtgcttgctttttgaatcatatctacatgtcctttgtgtaagggataaaatttcccaactactactccgaactttttcataccttattcctccttttaggtattttttactataattaattataccacactttactagttattttcaatataaaaatagccataaattaaaccaattgttagtgcaatccacccgataacaattaataccgtagaaaggattcctttagacaatttggactcaacaaatttatcatatgcagtataagaaacgttaatagcactgtctttacctctgactgactgtaacccattttcactagcatccgcaagaaaagttaaatgtaacttcttaggtacgccataataggtaatacgtacatctgatgataagtacttagtagttatatacttgccatcgaacccagtaaacttgttaaagtcatatatatggtcgtgtactttaactttatcaacctgtttagtcttagagccatagtatacccattcccagtaagtttctgttttagtttgtgtattacctttctcgtctacataactaactgttctagtccgcatctcatagtgttcctcttccgcaacaactttcatatattccccaccaatacgaggaaacgttactggttttattgctatgaaatcactatgcgtataaaagataccttgttgtgtatctaacacgtaatcatacgtttctttatcatctgccggaatagcagtttcgtacatttgattagattttatccggttctcttctacttttccatgtacccatattcctagtaaactagttaaggtaacaattagcatagggataatgatgaaccggattctactatccacccgcatcatttgctaaacaggtctgtatgacctttaggctccacagggattgttaacaattcataatcttgtacttcatacccttgcagtgcaagtaacttacgatttaagaaagttctagtgaatcgtttataatctgaaatttgtcggttataagctttacgatgactagcaactcgattctctgtaatactgaactctttcattgcttgtttgtaattatcctgtgatttaagttctggatacttttcgactactgcatttaaagtcgttttagctgagtctactttaccagtttctgcttgctgtcttgctttaacaataagttctaacgtactcttttcatagttattatagctctcaatagcatctactaagttttggaacaggtctactcgtctgttttcctcagtatttaaatccccataagcttgctcaatagatacttcgtaactgatagctctattttctacatgttttactccaaaaaatgcaacaatacctaataataaaacccctactagtgaaacaataattgtattcgctttattcatgcgcttttcctcctaagaactgtttaagaatttctctccaattgacatattctgttgtatgccctttgtcatcaatgtaaacatctgcaccaagcttacggctgttatttccatatgctttcatcaaatctggatgattctcattgatgtagtgatagttaataccacattctgccaaaaaactttttgcttgttctaactcttcgccttcacgacatgtccatataagaatttgttttcctgacttgtataggcggttaattacttcttttgcatgtggttgtagccctacaatatttggaaattcacttcttacaatagtgtcatcaaagtcgatagctatgtatttgcactttgataaatctttcatttgcttctcctttcaaataaaaaaggtatacccttctttgctacaagaagaagtataccttatgagtatcaccaagtcaacactatcttacaaattatttgtaagaattttttatttctttaatttttcccatttgtacacccgtaaaactaatacctgtagacgtttctacgtaaggtaatgaggttacggacttactaactaaataatctctagcggatggttcattatcaatattatgctctgtaaactcgattccttcacctttaagcatattttttacaaatgagcaaccaccgcacccattcttagaataaactgttactttaaccatgtgttatttcctcctgtttaaaccattttgaacctgtaaatgctacaacatcgttagctaaataaagcatgtaagttaacattaatacatacacagcgtgaccatgaagagctgtttgaatccatagtgctactgacattaaaccttggaatgtccagaagtaatactgtgcacggaaccctttaacacacaatactgctccaactaaaccaatcattgcacttgtagcatctaagaatgcttgtggagaatgcaaaataactgtatccaacagatacaatgcaacccaaaatacaacaacaagtaccaatgttttaagcatatgtgctcgattcatcttacgaggtttcaaaccttcattccaacgtttagagaagatgattggaatatccaataaaataatatatgctgattgcatgatgatgtcactgtagttccctgttacacttgctactccaataagtagaattgcggaaataaacccaagtaaaccattaattgatttacccattgtaattgttacggtacaagtaaaaccaattattcctgcaatagtggcagttaaacctgttacagtaataccttgtccttgtaataagggtagaataagtcccgtaaacacttgaataaccattcccacaatccataaaattcttgcaggtttagaccatccagttagtccgtctctataatattcatatgtgaataattttttaatatgttccatcttgctgttctttttagcttccattaatttgttactcctccaatgtgtattaaatatctttacgctctatatcccagaaatgtgctacaacatgataaggtacatcaattccagatgactttgcatgattatagaacttcataactgcttgttgattgctttcttcttggtataattctttgtatgcgttaacggcttgtccctcagatatacagcctaattcaaataatttatctataatttgacttacgatttgctgtctatgttctgggttgttaacaaaatcaatctctgtaacatcgagaataatttttgggaaacctaagtctctttccatccaattttgatagttctcatgatgacgtttgaagtactcgtataattcggtaccttcttctactttttcaaattcacgagcacgagcattgattcgtctgatttcttcttcaaaagaacagtttaaaacaaccattaaatctggtgttttcttaggaagtggttctaactccttaagcattctctctagtaaacgatggtagacaccttgttccatttcgttcacatgtccttcttgtactaattggtctaagaagatactatcttcaaatatagaccggtctaaaataccgttatccacactcattgcttcttgaatcatttcaaagcgtttggataacatatctatttgaaaaagtagtccgtattttgatttgtcttggtaaaacaattcaagcattggattctcttctacaggttcataaactgcttttgtatctaataggtttgctaatatttctgtcattgatgatttacctacaccaataactccggctaacgtaattatcataaccaactcctcgggatatttattttttgacaatattaagagcctgactagcaggctctaataaaccttacatatgttttacacgtgcatctatttctttcttacgtccatgtgcattaggacgagcttgtggttgacctaaataaccacattgtcttttaacaacatcacatgttgcagggtcattattaccacattgcgggcattcataaccatctgatgtagggttaaactctccatcaaaaccgcattcatgacatttatcaattggggtgtttgttccaagataaccaactttatcgtagctgtagtcccaaacagcttctaacgccttaaggttgtgaactagtttagggtattctacataatggataaaaccaccggaagcatattttggaaactctttttcaaaatcaatcttttcaaaaggtgttggagctttgcgaacatcatagtggaagctatttgtatagtattctttatctgtgatattctcaataactccgtatttttctgtatccatgcgacagaatctatcagttaaactttcacttggtgttgagtagatagagaaccagattcccgtctcttttgtccattcatcctttttatcataaagcttacgtagaacatctaaagcaaactcttttgcctcttcatgatgtgggtctgttttatcttgccaatcaccaccatagaacatgctagcaacctcgtacagcccaatatagcccatagaaaccgttgcacggttatttatgaacaattgttttacatcgtcatcatcggttaaattagccccaaaagcaccatgtttgtacaagataggagcattctttggttgagcttcgtaagtacgttcgattcgataaaccaaagcatcatgtaataccttagctcgttcttcaaaaatttcccagaagacttctttatccccttctgattcaatagcaatacgtggtaagttaagagttactactcctaaattcatacgaccagagtttacttcgtttccatgttcatctttccatccttgtaagaatgaacgacaacccataggacatttaaatgaacctgttagctcaacaattttgtcataattcaaaatatcagggtacatacgtttagctgaacattctaatgctaactgttttacttcatagttagggtcttctggtttacggttaactccgtctttaatagtgaacaataatttagggaagattgctgtacgtccttctgtacctagaccttggatacgtactttaaaaatagctttttgaatttctctttcccaacgtccagtacctaaaccaaaaccaatagacgtgaaaggagtctgaccattcgatgtaaataacgtattaatttcatactctaggctttgcattgcatcgtaaatatctttgtttgttttctcgattgcatatgtttctggctcaggaatacgataacgtttagcatctgtcatatgtttttgataattcatttcagcataaggtgctaatacttcatcaatgcggtcaaacgaacaaccaccatattgactggaagccacattcgcaataatttgtgctgtttgtgctgtagctgtttgaatggaatgaggtgaaccgatttctgcattacccattttaaacccgttcttcaacatatattcaaagtcaatcaaacaacaattagtcattggacggtaaggttggtagtctaaatcgtgataatgaatatctccacgtaaatgtgcgttagctacatgaggagggagcattttaagaccctcaactttattaactgtacctgctgtaaggtctcgttctgttgcaaaggtatttgagtccttatttgcattctcattgacaatagttttgtccttttcttgtagcttacgtaatcttacattaatgtctgtatcacctgcacgttcagcatcacgtaaagaacgaaactcaatatagtttctagctacgtttttagcaaaagatttcattaattcctgctctacaatactttggagttttgcaatatcgacacgtcctgtatcgctgtaatgcttcactacaaagcgtttaacacgttcagctataatctcccctaaatctgttttagcgcccgtagcatccttctcagctcgtcctacggcacgtacaatccttccttcattaaacttgacagttcttccgtctcgtttaactacaaaaatctgctttgtcttaacatctacatcttgtgttgcttgcactcaaaattccgcctttcttacaatatctagtatacttagtatagcataacaatacttacagtacaagatgtaattgttaacaaaaaataaaagactacaaactaagttgtagcctttttcaacaaatattacaaattgattaattttttctcagattagctcacctaagaaatcttcaccatcatctggtttcttgtgcttatactcatccgttttgagcattaggtacttgttacctgtttctacttgtaacctctcaaaagctctacggtactcctcagcactagatgtagcatctagtaggaacttagcattaaggatggctaaaacagctagtagctcttctcgactaccggacatctgtaccttaactttaccatcctcagtcgtataagctccgattttattcttgattgccacagttacacctcttaatcttttaatttaattttaggcatagcttcaagaagtttattattgaactttccagaaataacagcttccccaagttcatttgttaccacggaaatccagtaaggagacttcggtttcaaacgattgttattaacatctaggaatgctctaaacaatcgagggaaagaggttactcctactaatttactagcaaggtcatgcgcaataactttcttagtgaaacgctctgcattgaatgagtctagcgtatacaacaagaaataaactccctgcaactgtgtgtttgacctaaaatctgttgaatcaataaacttttgatacgactgagcaaacttgacatattctttatagttacggaaacggaacgcaccatcacgtacaacatctgtttttcttcctgctgtactactataacctaacgcagtagaaatagtagaggacacccgtaatgccggatacgtagacatcaagttcaacagttgtttataactttggtatcctgattcggcatacttatggatgtagtcttcgaccttccatgatttacttgtactattcaattctgcaacatcaatgtcactgtcatcgaacgtataagtaatgggtaacccaagttcacgagctacagctaaacggtgttgtccgtcaataacttccatctttcgatttactttaatttcagtaagtactccacgtttcgcaattgagtcccgtaaagctttagaaattttaactggtctgtttccttttagttgtttgaatttagacaggtctgctgtttcatagacctgttttactgctttatcttgcttcttttctttagacacctgtcatctctcccttaattattttttgtattgaatgctttgacttacctcagtgattttcttaacctttttaaatacattaggataacatttttccaaggtatttcggtctacaccaatgcgttcataggcgctaataagtttgaatgttccgtattgagattcaacttttgttttcttaagttgaatcatttgttcaagaatttcttttctaagttcgtctctttgctcgtttaaagaatcaagcaactcctgaacacgtttgtattccttaaagttgcgctctaattctttttcttttacttctgtagttgttagtctcatgaccatctctccctttctttactatactcaaagtatatcattacatattataaaagtcaacacctatcttacaaaaaattgccaaaaaatatttggcaatcagtttttgtcatcaggttctaatagcttgtccgcaggcatatcaaaaatccgagctaatttagcttgattatttgctctgggttttttgattccatgctcccaataggatacggttgaccaatgtacacctagttttttagctacagaacgcaaggattcatgcttttcttcacgaacacgtttcagcaccaagggttttggcttgctttccacgattctcccctccattctatatataactacagccctaggaaaacctagggcaagtagattatttaagtgcttcttttacaaagtcgtattctggtttatttaacacagacaacatcatttcttctggggaagtaatttctccacctaacacttgtgttaagatgtttgtggagaacccagatactaaagctgttcctttttcgtcaaaacgtacaggtgtattatcatgacgagagtttacattccagaatactacagatggtagctcgtaacctgcctgttcgaacttaagttttgcttgttcatagttagtgtaacctgccacaccttggtcaaattccatatcggaaataataacgatttttgaaggtaactcattttgtggtgtgtggtttttcaccgcagtagataaaatcaagtcgaatactttttgtaaatttgtatttctagcattgtatgaacatttatcgtaagctttcatcttatccataagtgtacctgacaatggtaagtttactaaacgaggttgttcagaaaatacgatgaaatgacctttgaatgcaccacttaagcgttcagcagtgtagatagctaaaccttctgcaacttcccaaggggtaacattttctgtaccaccccatgtcatagaaccagaagtatccgcaactacaattgcattatcttcaatatctttcaacacatcgtccatagatttccatgttgcttctagtgaacggtctaatgttctgtagtaacttctgctaccataagcccgaattacttcatgaggtaacatgttctttgcgttcattgttacttccccagattctactttagaaagtaaatcttcatattcgtctggcatgtgtaattgcaaagctttacggtatttgaacaatgctttagaggatacttggttcaaatcaatcttatggtattccttgcttgctaaccgaacttcaattacatttaaataatcacgtaatttagcaatcattttacgataacgagttagacctgctttaccttcaaaacctaaatagttagcaatacgagcaccttgattacgtttcttgctatttggagaacttacattagctaaccatttacctagtaatgatacaggcttaccttctgacatgtttttaatatcagatgttagttggttcccgatgatacgtgcaccttctgtatccacaaagtgaatactacgcttgtgtgcgtactccatagtttcaaataagtctgtccaacgaccaacatatgccatgtactccattaaagtaacgattacttgcttgttttggttgcgaccatccactaagtacttgattgcttctaggtaagcggaacgttcacccaatccacctaaacggatattacgtaagtgtaccaaattgcgtaatgctaactctgggttttcatcgtaagctttagcaaacatgtttcgtacatctcctaaacgaccacgcatagcccctgcttgtgcaaagaagtctaagttagcgtttaaagttgatgtataagttttagctccattttctgtagagccaacagttgtttcttcttttaggttgtctaaaaatgacatctgacatctctcctttgtatggtaatgttttatctaacaccactataacatgtaatattatgtaagtcaacactttttgtaaataaaaaactcatccgattaagaatgagtttgtatgtaatatcaagaaccacaggcttaattaaattcaatagttttaatttgttagttgattgctgtagggttctttatgctctggcaacctaagaggttagagctatggcaaaataccaaaacctttttaatatgtaacaagaatctattttatacgttgctctaccaactgagctacaggaggaatcatcctcccggcaggactcgaacctgcgacccacggctccataggcaataaaaattgctgttagattctttatgttccggcacccattaaggatggaactatagctatgctaaaaccgttttatttatgtaacaagaacgcattaactttaagctttaccaattaagctataccaccaatggtggcagttggattcgaaccaacaactcacatttttcagatgtattagttttaaaagtttgctgtggcgttctttatgttccggctacctgttaggttggaactatgacatatgtcaaaacctttttatcttgtctttataatagcataaactattcaaactgtcaactattaatttaaatatattgaaacttatttaaaagctccaatatatttaacagtacccttgcatttacgtgcaaaagcttctagctctttacgagcacctaaacggtctggttgagaagactgtactgtaacttcttttggtacagtaatttcacgagttttcttaactgtctttccgttttttaacttttgttcgtactcttctgtacgagtagaagttgttgaaataattccgtaaaatttagacatgttatgtgacctccggtcattttattttaatggggagtgatggagttgcaccacccgagctttcgcaactgatttacagtcagccccgctactacttacggtataactccccgcataagtatgtatatatcaatacaatgtacaagaacttttagtgaggtagctctcatagtgtattaatggggtacattgtgtaacttcaactagtattgcctcacacgtgactagtcttatatacacaatgcctacatacaacccgatagaccacccttggtacgcatattaagaggcgcagggtgatacgaatatatggattgcaggattcgaacccgcaccctttggttggaagccgaagatactacccttatactaaatccacataatgttaataggcgggtacccgacagcgaagtatcattcctgtcttgtcattctcctattaactccataataccttgcctagagttgagctaggactcacaattaccgaaggtactaatcgggaaagcaggactcgaacctacgaccccacgctcccaaaacgtgtgcgctaccaactgcgctatttcccgttaacttatacatatattataacacaaacttacatgatgtcaacaactatttgtaagtttttttaatttatccattcgggacagtgtgctttaaccattcagccacccgcaggggtaacccgcaggacgggattcgaacccgtataccactgtcctattggataggcttgtgtacctgtcatcttccgattacacacacctagtctagttaccgtaccaatagatttgacaggaatctagggtaacgcccaatatggtgttaattcacctcgtattctgttacaggtttgcaaccctgaacaaggatgaccaatcctaatggagcatagcggactcgaaccgctgaccccctgcgtgcaaagcaggtgctctcccaactgagctaatgccccgtataaaacatctccgctgagattcgaactcagaatgcgggattagaaatcctgtggtttatccaattagcctacggagatatgattgtttacagataaggtactcctgtaaacaattcaattgcttcaatttcagtatgaaagttttcccattctaaacattcatagaaatcttttaagatatgcttgtctttcctgtaaacagtctcacctttatgggctttctcacagatttctctaacagcatccacattatacttaccaccagttttatactgctctaaaccagaatctaataaaactcgttgtacttcttcacttttatctcctgctttccaagaatcaaaagctttttcaaacagtgtgtcctccatgttttcaccttctacttccatgattgattgaataaatcttttccacttagaaggctccttgtgtttacctttacgaaaactcatgattagcctccattatctttaatgaaccgaggaggagggactcgaacccccaaacgcttttacacgtctatgacttttcaagagtcaattttttccagttatgatactccccgaaaaagaaattgattgactagtactgttagttgactagccaaccggaactacttaaaccgaactctttaaacagctttagtagtttatatttcaaatggaaggcatgggattcgaacccacacatgctgttatacatctacttggtttccaaccaagcctctttaccgtttgagtaaccttccgtcttgggagcaggcgggtttgtgtcaagtacacaatacctaatcttttgtgcatgttgttccctaggcttcatgcacaccctactatctgcatactaacagacctgccaattttctaacactttttctaatgcttcgtatggacacattactgtcttaccgtgaacatcatgtattctcaaaataatataatgctcatttatctcggaggtaacaaagtatatcttgtccttcactaaacctaaacttccgtttaaaccaatgaattttaaatacatcatgttacctcctaactatgtataacccatgaagcatcatggggggactgtagtatgcccaacctgcggggatgctccgctctgaatccgtagaaatcagccacaattatgtcactggtaaggatttgcaccttacatgcacgcttccattagttagtcggcaccttcgagatagggacatacagcttcaattttctaatggatttataggaatctagccttacagttgtttacccgacttgttctagactagcctgaatcttcccctgtgctatactgtgttaattagcgtttacctattccgccacagtgactatggagctgacgggactcgaacccgtgtcctaacgtagaaccatacaaaattctacgggcgtagttactagttttaatctacgttaaggttacaactaataactgaaattaccttaactgagtggtaaagcctctcctgagttatccacttttacctcagcgttgtcggttgatgagtcctctaggtagaaccgaccctagtctagaggggtaagtgtgtagctagtctaaaactaggctacagctaataattcttcgtttttagcagttatatttactgcgatgattaagtcatcactctgcccgctattcatatactccttacgccagtcgaaaccaaaacagccccaacataagaatttcttttgactaaccctacccttccggcagggtctaatcaaaagtatacaattaaaaaaatgaaaatgagttacggaaaatgtaacgtctccaccaccggactataagggtaagttgttccggtctttaacctaagtactttacttaaatctaacaggacagtcttcattacgtaaactacttaaccatgtaaaacgtaaaggtcaatttccgttgacctaatacaagaggagggattcgaaccctcacgcccatcacaggcatggcattctaagtgccacatgtctaccaattccaacactctcgcataataacagtcctacccacctactgttctgctagcatatagcttgcaggctttttatctgtgttataaaaaccagaaaggttatacaggtaacaggagtcgaacctgcatgtcacaagggacaatggattttaagtccacagcgtataccaattccgccatacccgcataatcactttttatgaaacaaggagaagtgtaaccttgggttattccgacatttgcagaactcgtaaccaacgagcgcatctaccctcagaaaggattttgtccctgccgacttcactgctttgtcaatgttagcctgcttgctaagatagatgtcttccttacaagaattactatacagcatcttgtaaggaaagtcaacacttacatataaatttatttaaaaaagttttgatgaatctaattgagagaaactttcgggtagagaacctagttcttccatgtactcttggtcaatctcgtaaacagttaactccgttacttcattttcaatagtaagtttcattgcttctgctgtttgtatactgtgtccttctacttgaagcttatcatcaagataaatgccttcccagtctcctgcaactacataatctgctttcaagatattacctactttcttctcaatttctgataaaaattattatccttgtaatcatcctcgtgggcatagaattttttcatgtcatatgtccaacaagtttcttctactcgtttatgatgtgtcaatgttacttcatcatcaaaacgaccttgatttaatttatgcctgtaatttctgttaaccattctttttatatctcgaacagttgaatctttcatacaaacatatcggtaatagggttttctgtaacttctactcattgtaagtcctccttaatagatacttacaatttagacaatactttcttcacaggaaccactccttattaataaaagctacctcccgaaaaacgtttcttcaccaaagtgtaagacgtaaactaacgacaggtcatagttttccaattaaggcaaataccagtgagaggatttgaacctctgacacccgccttatcaagacgatgctctaaccaactgagctacactggtgtgacccatgtgtcaggactttcacctgttctcggggtgccccgcctctctactaatctccccattcggtgcccctactagagtgactagagatagttagcaataaaaattatatatcatgaatcaaatttttactgcatcctatatacacgataccgtctacaggatttgaacctgtgacatccaccttgtaagggtggcgttctcccactgaactaagacggtgaaatatggaaccctaccagaggatttctttcggtattacaatcacctcggcatgaacaaagccagatattgaggtctggacttctcacgccccgggagtcgaacccagtatagacaaaccatattttatacggaagacaggattcgaacctgcgatataggagttttagtgcactcattatctcccacggtatccgctacgtattgccatcacgtcacttccgtatgttaaccgacagtaaaggaatcgaacctctatcactagattcgtagtctagcatcctatccaattgaacgaactgtcgctctaagctagcaattacgcagactgactatgggcaccttcgtcccgtcccctgtaagtgccctcctacaggttgtccgtggcaccgcaatgtactaaccgatgtccccacagggatttgaaccccgaaccccccgattaaaagtcgggtgctctagccgattgagctatgaagacagttgtgtttttcaagataaccctctcgaaaaaccgttactaatagaaaaactaagggtctcgactgacagatttgaactgcctgctcctcctaagaggcgtgttaccaaagccatacaccaactcttcgagaatatcccctacaggattcgaacctgtgaccccctgattaagagtcaggtgctaccaccaactgagctaaggagataagattaccaatagctagttaagccttacggaatcgaaccgccatgaggttatgaagctcacatagaccactagacacaaaactagcttattgataaaattctatatagataattgtatgcaatgttcgcactaactaaccagataaccagtcaatcattcaaaacattaatttgtgagtttccgctcacaatgctgattgagagaatcgaactcccattcccgggttacaaagccggagtaatagccgttatactaaatcagcgtaacccctcaatagaggggaattattatactaagttaccatacccgtaggtatttgtttgagcttgtttaaacataatgctcttgatagttaagtcgttgtacttttcatcgtcttcatcatcaaggtacacatcaacgttaacgttcttaccggaaataccgattgtttcgtctttaccaactgttaagtctttactgttgaaggatacatcaaagtagatgctatcttcttttgtacgactaccgaacgaaactctgtcaccaaataaatccaagcttcgagagttgattacaacaggttgtaacccaccttcaaattgaatagttactgtataatattgattttcaatattaaggatatttaaatcagcaatagcttcaccaaatgggataccaaagcttaattccaatgcaattgctcgtaagcagtcatagtttaacttaattctacggctaaacttaacaacactgtcaatttcaccatagtaagcttcgtctaacttatcttgcaagtaagtacgaatttcatctgcatcaggatattcgaaacgtaaatggtaatggaaacgtcccggacggttaagcataaagtcatttacacgacttaagctattaacagtaagagcgtagatacgtttacgttgtgataaaccatcgaataagctcaatagtttttcttgtggttcacgaccgtcacggtcattgaatactttttcaaattcatcgaacaggataagagactcttggtcaatactgtcaataaattctgcaatccccggataagcttctgtaattaagataacaggcatatcctcttcaatagctcgttgagataagatttgagtaaatagtgatttaccaatccctttgtctccacttaaaatgattcctaagctacgattaattgttttaaatgtgtgtagcactttttcaattttagctaaacggtcaccgtaaactttaggttctttcaattcaaaatcgtctgttactactagtgagaacccagacattggattgaatcgaactttataagtttgcgcaggcaacttatcataagttttaaggtcgtttgcataaatttcatagttactaccatagttgattactttcataaatattccccttattcgtgttttattagcatttgctaatggagaggggtggaattgaaccaccgacccctagggtttcaatctagtgctctaacctactgagctacctctccgtgtcaatttggacttatcccccacgtggttactaagataagtcctatgcctttgaagtgtggatactcaaaaatgagtacaggtactaaaaatctgatgacaagtcagatttatgtcataagcagaaggtgagattcgaactcacgttcaggggtttgcaatccctagccttaacccacttggctactcccgcattggcatccctctaggtttttatctgcatcgggactcacataaactgataagtgaaaacagggcactagtctgttttacacctgcgctatcagaacctagactcggcaacactgccttagatgactttactcttgtaaacacgtcacattcttcaacaattaccagtagagtgctacataccagtaattcgttcctgtgaaggatagtacactataactatcaccgctgtccaagaatacacgccgtgaaggattcgaacccccgtcttccgggttggagccggaaatgatagccactacaccaacagcgcaagattcggaggggagggactagcaaccctccgaaaaatgtaagataatgagagattaaaacatgccactattaaaagtggaataggtaattaaggattcgaaccttacaagcccttactgcttaccttgtaaacttatagtatcatgcgttgtaccgaaagtcaacactttttataaaaataatagggagaaatatttctccctaaaaatggactataccggaattgaaccgatgacctgtcagttatgagctgacggctctgacctactgagctaatagtccgtgtaataataccacgaaataaaccttagtaagtcatatagtcccagaaagggagacatatgaaactagtgttgaatgccataatcgtttaataaatgtgactgagagagtaataaatttcttaggcatgtccatatgcctcctttccaataatgatagttttaagatataaacagaataaataaaagagaaaataataatgaataatagcgcatgagagagtcgaactctcgattccggttcgaaagaccggtgtcttgaccgcttgaccaatgcgccataaacgagctatatgggacttgaacccatgaccttctccgtgacagggagacgagcactcctgactgctccaatagcccaatgtttccccaaccaccgccacctaagggattcgtacgtctacgtgagttttttggttatacattattgttcaagacaataaattgtacgagtggaataccaatttaccactctgcggttcctattgcggtaggtgggagtcgaacccactaaagcttggttatgagccaagtgcctaaaccgttcggcatctccgcagtaatacaagtctggttaaaaactcaaaacttaatagattaagggcttttcttcctgcttcatatacactcactgcattcggtcacatactcagagaggctgaaccatcgggagctacccaatagcttctctctgcctttaatgtatggtctagcacggtggctaacaacgttcacctaaacattcagcattaaaagtattattttacatataacccatatgtcttctgtaatattttcatccaacgctgacttaagctacttgtaccaaggtctcttgttaaacctgtatttctacagttctcgtcaaagggagtcttttgagttttccaaggtctgccaagcttctcacacttccacctaacttggattcttttccacaggaacgtctattgtatcccccaagagtcttgtaccttacaatccatgtatactccacataacgcttaactgatattagcttttactaatagttactcctatgttaccataagacctacctgcaacccaaagcactatcgcaccttcggttacatccagactcacgccacgttatcctagcaagctgttcaaactttctgcactaggttcaaaatctattaagttttcaatttttaaccactaacttgtggtgtaatactaatatagcataacattacaaagttgtaaacacctttttgtaagtttttttgatttttttgatggaaggtaagggggtcgaacccttacaccggatttctccgacctaactgattagcaatcagccctcttaaccatttgagtaaccttccaaaagcaaaaagggaacccctgtaattaaacaggggtaagagagatgtctctaaaagcctacaaccattataacatagaaacatagtttgtacagccgtaactgtacaactgtcaggacagggttcgaacctgtatcgcaaccttcaaagggtcgtgtcctacctgttagacgacctgacaaaaaggtggaacctccctaaatttggggaagagggaggttctcatgctattaacaaacacgaatttgctaaccaagtaatcttgactagcaactcacctagcaggacttgaacctacaagaactggttaacagccagtcatgataccgtttcatcataggtgaattttagttctatcaacattataacacaaaagctgatagaactagcaactttttttacaaacttaacaacttttttcttaactactgattcagcaacttactcaatagttaaagacttaaagaaagaggaagtaattgaggtatgtcaatcactaactaaagtatacaacatttttatcatcctgacaacaactaaatgcaaaaaagttcaaaaaagattataaatagttaaattatcagaatattcaaattaatgtcctattttaaatttttgacctccttatatacttaatactatatattaaatctatatatctaaattatataattattagactatatattattaatatatataagacttgcaaaaaattaaaataggacatttttctgacaattcacttttagataaaaagaaagagagcaaaatgccctcttaccgtgtttcaaagtattccttgattgtatactctctagcttctttagcttcctcagtttcatctttaggagctaaatacaatttagtaattgtagcgggtacctctaccatcttatagtcaataaaagtagcttgacgtagatttaagtatcggatacctgttgttctatcagtacctgtatgaacaggcaagaaagttaattctttacctctgacagaaccattagcttgtgttagtgcatcaactacagttccgcccatatagcgtggaaataggtaaaccttgtcagtacctactgtaatttctgcgaccttttcgtgtgttggatagttcacttataatttctcctttcagaatatgctataattacagtataagtataacacattctatggtttaaaaatgctgaacacgtaagtcacaaccgcaccgagaacaatcatgaagatgttttccacgatgtctcttttatggtcaaactctttgtcgtttacaccttcgagagcatcaatggtttcttccagttttgtaatctggtacgtaagatgtgaatatttctcttcatgaacagctaaccttttatcaagactgttaacgatgtccttcaattcactaactgcattattcagttctgtgttgtcctgtttaatgcccttctcagttagttctccatgttggagcttgtcttccaatcgttgcagtcttaatactaggtcacctacttggtaatcgttcatttgtgctccccctctcggttgtatagctcaatctcccggtcagttagaaaaccacatgtaaccgcctatgcccagaatacatccgacaaggtaaataattggagtatacagcccaatgaagagcataaccacgctaccaacactaagtccgtataatatcaaaagatacttatacgatgccaaaggacttaaatctgcttgcagttttttgtactgtatagctcgggtgacatagtaggatgctgagtaaacgaacaactgtagcaataacatagcaataaatgctagtcggtacattctatcgcctctcttctttcctagagctatctttaatatagtacaccaaagcctttataatcaggtgtgctagattaaatatgtaggctaaaaaatataaacggaagagtgagaaaaagtgaaggtacggaaaaaattattatacaaatcaatttttatcaccatctctgttatcatcatgatttgtgcaagcaagctgattgcagatatgctaggcttagaacaacactttacaacaacaatgcttgtaggaggttctttgtgggcttggatagctagtattgtctttgattcttatgagaagaggaaaaagaaagataatctacagcaacagcttcatgaagcactgcgtgatttaaaagagataaaagcgttaatcaaaaaataattaataaggggtggaggatatgtcccttacaagagaagaaataaagcaaaaaaggcagtatatttttagcaaagctcaaaagacgacaaatatacgaaaaggggataaacgcatagcaagtgctacacggatgtgtgcagtatgtggaagaccgttgtctagacttgttcttactaatggttctgcaatagttactacagcacatgtaagctgtaagatgtcagatttagtacgattgaacatgtgtgaagacatacggtcttgctatgcgtatacaagtaaaaagggggaggaatagccacatgagtatggcagaccgtattaaagaaaatgctgaacaaaagaaaatggaacgtacatccgaacaacgattacgtgacacatttaataatgcttctctcacgttaattaaccagttcatggctaaagttatggcaggttcaatagatatagatgacgttggggatttaacccgtctattccaaatctacatgcaaattaataatatcaatgcaggaatgcaagagggaactggtcaattacctgctcttagtgctacgcaaaaagatattattgcagataaggtaagcactgaaaaggctaccatagacggagaggaggaggaagttgtttcgttggaagagttagctaaattatcagacgaagaaattgataagatgctattggataaggaaatccaaatgaacaaagaaaacgaagcaacgttttaatgacaaataaagcacaacatattgctaaaatggcaaaagaaatgtatgggacggacaaaataacaactgcacagcttgcctacatcacagacatgttaactccgtccacatatttactaagaaaccactccgttcgtaatcatccgattacatttatgatttccggacgtgaccaacaaaaagcccaagcacatagaccttggcaagtaaaaattattaatgaccaacatcgaacaaaggcagttattaaatcacggcaattagggctttcagaaatgggtgtaggaaccatgctacactttgcagatacacatagttacgatgcagttaagtgtttgtataccttcccaacaaacgaacaaatgactaaattcgtacaaacacgtcttgaccccgtattgcaacgtggttattacagtacgattattgacccagaagtagactcattaaaggctaagaagattcgtaatagctttttatacttccgttcaagctctaaaccgggagctgtagagggggtcgatattgattacctatctatggatgagtacgaccgtgttcctgcattagccgaagcttctgcattggaatctatgtcatcttctccatataagattgttactcgttggtctaccccatcagctcctgatgtaggtatccatgctttgtttgaacagtctgaccaatactggtacctacacaaatgtgataagtgtaatcattataaccaaatgaactatgaagactatgtaccagaggcaccagtggaacgtagagggaacatcctttgtgtaaatcctaaaggggtagacccaattgctaaaacagttgtggatggctccttccaattcgtttgtcaaaaatgtggagagccattagaccgttggtacaatggtatatgggttcctaaatatccagaccgtactaaaaatggtctaggtattcgaggatacatgatttctcaaatgaatgctgtttgggtatctgctgaccaattaaaaacaaaagagctaacatcactatcgaaacaagcgttctataactatacgttgggttacccttatgctgaccaaaaacttactgttaatgccggtgacgtagaacgtaacagacgtggagacctcccagaatctcctagagaccgtggagattacaagtttatctctgtaggtattgactggggaaacagacactgggtgtccattcatggcgttagaacgaatggtcaagtagatttaattaaattgttctctgtaggtaaagctaacccgttaaaccctgatgcaattgatacagatattcagtcaattcgattacaattagcaccatatgaacctgatattatcgttgctgatgttggtgactctggtgataaagttgctaaactgattcagatttatggtaaagaccgtgtatttggttgtgtatacccatctacacctaaatctacaggtaacttagtgcctagttggaatgttcaaggtaacaaggtatctgctgataagctaatgcagaataaacgatacatctcaaacatgaaagatggagttattggtttctaccacaaaatggatagtgaactaatgctttacattgaacactggggaaatgtagtaattcgtgatgaagaggatgaaaaatctcctacaggattccgacaaaccatcggacgtaaaggtgatgaccactattcacaagctagtgtttattccatgttaggttatgaacatttgatgaacgtatttacaggggcagatgactacgggtttaactctgattggatttctactcaattgaaccctacacctcctgatatttttactcagtttacttaaaaaagcaaaatgtcctattttaatttttctacgtccttatatattaatactatatatctatatacctatatctagttagtaagtatatatagtataatatattatataagggagacaaaaatttaaaataggacatttttattaaattagctattgattgacaaaaaataatatgctattatactacttgtcaataatagcactagttattttttcttgtcataacaataaaggagacgtttacatgaatgacaatcaagaataccaagctcttgttgataatcttcttagctctgttccagaatttaaacctgtagaagctacagtcagtaaatcctttttagaaggtatgctaggcaagaagttagactacgggtacgttatatcagaaaatgaaaaattatcaaaagactattcacatattgtgaaggcttatggttttaactccttttatgacctatactgctatgctgatagttgtgattcactaaatgactatttaattaaaggtggtcaaaaagatttatcaaagttgaagccagttaaaagacgagtaatgagaaatggtaaaatgatgacgactactatctacgaagacagttccggagaagatgatgataaaaacccattagataaggacactcaaacagaggaaaatgttgagccaagaaatgctagagatttaagcaaaacaattattggagatgaccataatggtatagacccaaaacaaattgctaaacttaaaactgaggcaggtaatctaaatgggacattttcaactgattgttcttcatacttagttcttcaaggagaaaccggagaaattggtggtgtggcaggttatcgtaaagagggtagctatttatatttagctttctaccaatcagacgaccttacaagtggagtggcttatgtagcatttacacaactattgttacgtgctcgtaaacttggcttgggcgctaagattgatgctactgatgacccgttagcactagaattatttaaagaatacggacttaaaaaaagtggtagttgttatataatttccaagagttccctactggaagcgcttggggagccatgatttcaacttttgagttatttttaattttagccttctcaacaaccgtgtttatatgctataatctttttgtagctcaaacagtcaagacaatttttgatttgagaaaaaaggcacaagttgtgctaactgaaagagcaactgagctaacgaagaagttaacaaacatactgaaaggggatgtacaggagttgccagagaaagaaaacgtaattattaacgaacaaacactctctgacttgttagtcgaaaaagcaagcgatgccgactacaaattgttcattgagaaactgacagagattgtaaaggatttatattcaaattatcaatttcttcgtcaagacccacaacccgatgatttcatgtcaggttattttttagggttccaagtttttagagaggaataccctgtcgaatatgagtatttattccgattagctattgaccgtgggttagacgatattaaaatcaataaactctttgtcgaagctttacaaaacggagaggtattaccattaggagatgccattgtagaccctaacttgtccggatgcagttctatccttcaagcacaagaagtacgtgtaaacattgtattcgcacctaaagcatacatggagcgtaaagaagagctgattgaagaaaaaactgctgaaatggaaaagcagaagaaagagcaacaagaactagcaatccaaaaagacaacgtggttaaatctgcacgtcttgctgaggctgtcattaacgaattagtggatgaagtcgcagaaaaacacgaactacaagaactcgttaaacaaattaaagaaagcatgaggtatttctaaatggcaaaccctacaaccaaagtaacattaaaccaagcattaatcaaagaattgcgtgcacttcaaggaaaaagagagtccttgattgcaagcaatctacatgtaccagaacctcagtcagttatgattccaattcctaatgttttagtaacagatggtgacaaagaggtactaaaatttattaaaaatatcggtttaattagagctgataaatcttttgggttagatgtggcaattgaagcaggagaaaaagtaacccttacagatggacgttcttccactatcttggaatgtattttctattacacaggagatacaaaaattgatgaaattgagcaattcttagaacaaaactaatatttcctgattaaaaagaagctttttttacttgtgctatattaacactgcacaggaaaagagagcttctttttttgtgacttttttacaggaggttgcaagatggcaggagaagtatttagtagtttgattacaagtgttaaccctaatttgatgaacgcaggtagtcgtaacggtattgctattgaccgaattattctacatcacaacgcaacaacaaataaagatgttgctatgaacacatggttattaggtggtagcgcaggtacatctgctcactatgaatgtacaccaacagagattattggatgtgtcggtgaacagtactcagcattccatgccggaggaactggtggcgcagatattcctaagatttctaaccctaaccaacgttcaatcggtattgaaaatgtaaattcaagcggtgctcctaactggtcaatagaccctcgtacagttacaaattgtgctagattagtggcagacatttgtaaacgttatgggattccatgtgaccgacaacatgtcttaggacataacgaagtgactgcaacagcatgtcccggaggaatgaacgtagacgaagtagtacgtcaagcaaaacagtttatggcaggtggaaacagcagtacagctacagccactcgtcaagcattcttcgatgttgtgaacgtaaactctggtgcatttaatgtgcaaggatggttcatccctagcaagtctacaaaaggacaatctatttggttgtactttatggacaagaaaacgaataaagaaattgctcgtttccaaggtaaacgtgtagttcgtgaagacgttaagaaagtatatccatctaaccctaacggagcagatgttggttttaacgttgatggtgcaactccacaaagtcttatgggcaaagactattacttcttgttacgttacaacaacgataacaaagaagaacttttcgtaacagataaagtctttaaagcacctgcactagttaaccgtggttgcctagacgtaattagaggtgacaaaggtcaggttactttacatggatggcatttatcttccaaacgtagaaactctgacaaacacttcttgttcatcatggataagaaaacgaataaagaaattgtgcgttttgacgttacaaaatcttcattcaaagcttccccagatattcaaaaattgtatgacggtacaattgcacaacgaactaattgtagatttgcttttgctcatgcactggatgctaaatcccctgcacgtggtaaagacatctatattttaagtcgttactgctctgaccctgcgggtaacaacgggatttccgaccagttacaacttggtggaactcacaaattgtaacattacattgacctaccttctggtgggtcttttttattactgtaatataatgtaaaggaactgtaatactataggactaactttgtaacactaatttgctatattagttcctgtaagcaacacataaaactaaaacaacccaaaggagaacgacaacttgaagaaaacgacaattgcaacattaggacttttaggactaggactatcattaggattgggagctaaagctcacgcagacgaaatccaagaaaatggacaaacttactggcaagtagaatccggagacacattatcagctattggtaatcgttacggaattgattttaacttaattcaccaagcaaactcagacaaagtttcagatgctaacttgatttatgttggggacaaactattattaccattaaacggtgaagttcaagctcctgtagctcaaccagtgcaagaatcaccagttgtagaacaagcgcctgtagtagaagaaacacctgtagttgaacaggcaccagttgttcaagaaccagtagaacaagctcctgccgttacatctaactcagcaaaagaatggattgcacaaaaagaatctagcggttcttactcagcaactaacggacgttacattggacgttaccaattagatgcttcatacttaaacggtgactattcaccagaaaaccaagaacgtgtagcagatgcttatgttgcaggacgttatggttcatgggaaaatgcacaagctttctggttagctaacggttggtactaaaataataaatactaacagattaaaaaaagactctctttttagggggtctttttcttatgctatattataactgtaacttaaaaacaaacaggaagtgatagctatgagtaacattaacatggaaaccgcaattgcgaacatgtacgctctaaaagcacgaggtattacttactcaatgaactactcccgaacaggtgcagatggcacaggggattgctctggtactgtctatgattctttacgtaaggcaggggctagtgatgcaggttgggtacttaacacagatagtatgcacagttggctagaaaaaaatggttttaaactgattgcacaaaatcaggaatggtcagctaaacgtggagacgttgttatctttggtaaaaaaggtgcaagtggtggttccgcaggtcacgtggttatcttcattagtagtacacagattattcactgtacatggaaatccgcaacggctaacggtgtttacgtagataacgaagcaactacttgtccatatagcatgggttggtatgtgtatcgtttaaatggtggaagtactcctccaaaaccaaacactaagaaagtaaaagtacttaaacacgctaccaactggtctccatcaagtaaaggtgcaaaaatggcaagttttgtcaaaggtggtacatttgaagttaaacaacaacgaccaatttcttattcttactccaatcaagaatacttgattgtaaataaaggaacagtacttggatgggttctttcccaagacattgaaggtggatatggttcagatagagttgggggaagcaaacctaaactacctgccggatttacgaaggaagaagctacgtttattaatggtaatgctcctattactactcgtaagaataaaccaagcttatcttccccaacagctacaccattgtatccgggacaatctgtaagataccttggttggaaatctgctgagggatacatctggatttatgcaacagatggacgttacatccctgtacgacctgtaggtaaggaagcatggggtacatttaagtaacatgacttaagagggctaaatagccctcttttttgtgctatattaaattagtagacagtgatgaaaaattgttacagggctacctgtggtatacttaaactagtacaaatgcttgggaggtaagaatacgtggcatacttacaggacgatacatggcaagcagtaaaacagttagctaaacaaaacggttttgtaggagactggattctaattattcacctctactatgaaaacggtggaaacaatgtacaagttcatactgctatagataataaaaattaccgcatactacgaatcttagataacaaacaggttttattagttgatagagaaggaaacgttgctgtagaggactatgaagtagtcaatgatagtcagaaaggtttcttttatagtgatatgcacaaagtcgaactaacacttccggaaggttgtagcttcaacggtaaacaaagaataaaaatttatatatgaggtaggtgtaatcaagttgccaaaatggttagataaagtgttgggtgtagaagaagatactgacatcgttaaaagcgaagaagtctaccaaaccttgcttaaagaaattcaagcacagccgttaacagaaacggtagagaaaggtatgaatggtaaaccagtagcatacatgcaacctataattggtgacatgtcagtaaaccccggatttaagacaaaaccttctattagaaattctcaggatttacacaaaatgttgaagaagtttggtaataatatcattcttaattcaattattaatacacggtcaaatcaggtatctatgtattgtaaacctgcaagaaactctgagacaggtgtaggttacgaggttcggctgaaagatattgaacaagagccatccacacatgacattgcaaatattaaaagaattgaaagctttttagaaaataccgcagtattcaaagaccaaaatagggataattttactgctttttgtaagaagatggtacgtgcaacttatatgtatgaccaagttaactttgagaaggtattcgataaagatggtaattttatcaaatttgataccgtagaccccacaacaatcttcttagctactaacggtaaaggaaagattattgaaaagggagaacgatttgtacaagtactagacaatcgaatcgtagctaagtttaacgaacgtgaaatggcttttgctgttcgtaacccacgtgctgatattgaagtaggtcagtacggttatccagaactagaaattgccttgaagcagtttattgcacatgaaaacaccgagacgtttaatgaccgattcttctctcacggaggaacaacacgtggtatcttacatgttaaagcaggacaacaacaaagtcagcaagcattagatattttccgtagagaatggagaagttccttatcaggtattaatggttcatggcaaattccagtagtatccgcagaagacgttaagttcgttaacatgacaccatctgctaatgatatgcagtttgaaaaatggttgaactatttaattaacgtaatttctgcgttgtatgggattgaccctgctgaaattaacttcccgaataatgggggagcaactggttctaaaggtggttctttaaacgagggtaactcaaaagagaaaatgcaagcttcccaaaataaagggttacaaccattattacgctttattgaagatactgtaaatactttcattattgctgagtttggagacaagtaccaattccaatttagaggtggagacctaagtgctcaattagacaagattaagattcttgaagcagaagttaaagtgtttaaaacagttaatgaagcacgtgctgaaaaagggttggaaccaattaaaggtggagacgtaatcttagacggtgttctaattcaatccattggtcagttaatgcaacaagaacaatttaactatcaaaaacaacaggataagcttaacaggctcttagagctttctggtggcgaagcagatgattctaatggaattagcttccaagacaaacaacagggcttagatggaacctcagctagcgtaaatggcaaaggagagtcatctgttggtaaagatggacaaattaaaggtaagggcataactaacaccaattctgctaaacaaggtatgaaaggtgacaaacctaacgactggcaaaaataaatagaggggtaacaccctctatttacaattgtccaactgtttagtggtagttctgctatattaaaaacagatgtaagtttaggtggtgaatgaacaaagatgcaagagaagtataatattttcgttcccattgacgtagcaggttccgtagagaaatctgaacaggcaaacgatggtgaatggtacgtacagggttatgctacaacgcctgaccttgacttgcaaggagacattattttaccacagggaattgacatttcttactttgttactaaagggtgggtaaactacgaacataaacaagatgcagaatacattattggtgtaccaactgacaactgttatgtagaccttaataaaggtttgttcgtggaagctaaacttatgaaagaaagcaagtatgctcaatcaatgtggcagttagctaataccattcaaaaatcaggaatctcacgtcagttaggtttctcaattgaaggggcagttacaagtcgaaatgcaagagacaatcgtattattgagggtgtggctatcagaaacgtagcattaactacacatcctgctaacccacaagctacgtgggaaacacttgttaagtcttggacaacagggtatggaattactcctgagacacagacagatgcaggagcattacgtagagagatgtttaaagaagacatcacaaatctaacatatgcagtgaagacagtagctaagttgtatggtaaaaaacccgaagataaagagtttatattacgtgaagttgctaagagtttcgaccaagaaacctctgaaccagagttaagtgcatttatgttacaattaactagaggggtttccttacaggaagctaacaacttcattgaaagtagaaaggagctaaaatagtgtctaaaacaattaatgacattatcgaagatttcgattcaaaagtgaatgtacaggaagtatctaaatctattgaagatgaaaatgtagagcctgtacaggaagaacaaattgaaacaccagaagctgttgaagaaggtgtagaaaatgacaagccggaagaacagcctgttgaagctgaggaagttaaagaggatgttgaatcagaatccgaacctactgaatcagatgaaaaaccagaaacagaatccgaagtcgcagaagaagctactgaaccagaagtggaaaaagtagaaaaatctgataaagaatccgataaagaagatgaggaaaaaaaatcttctgatgacgaggacgacaaagaggataaaaaggataagaaagataaaaaagctgacaaagaagataaagatgaaaaagatgaagacaaagaagatgttaaaaaatctgatgagtccgaagacgtagaaaacgttgaaaaatctgttatttcttcccaagatattgtcggtggattcgaagctgtattcaaaaatatggcaaacctttttgaaactcaaaaatctttaactgatactattacagaattaaaatctgaaatcgtaagcttacgtgaatctcacacacaagctatcacaatgaatacagaagatgttaacaaatctattcttgtagataaagttgatggagtatcagtagaaggtaaagcagtaggatttgtttctaaatctgtagatgtagaagcagatgtgacttctgaacaagaagatgttgttgaagtagtagtagaaggtgccgaacaagaagaagctccggctaaatctgatgaagaacaattgtttgacagtgttcgtggaatccgtgatgacttaatgagcacatatactcgtgttgcaagtaacggacaagcccctcgtggtgagttagaagaaattcgtcaattatggggacgtattaaatcccaagacgaactagctcgtgcacaagcattcattgataaatacaaataaatttactaaaaggtaaatttttttaaggtgtactgctatattatagtcagaaccaatgagagacctgacatttcccccctgaacctccacagggtcaggtctcatctttgagaggaataaaaatgaaaggtgatttatatataatgccagaagacaaaaaacaagaagctaaattaaatcccgttcaggaacaagtaatcaaaggatttacaactggttatggtattactcctgacacgcaaactgatgcggcggctttaagacgagaatttctagatgaccaaattactatgcttacatgggcagaaggagatttgtcattctatcgtgacatcacaaaacgccctgctacatctacagtagctaaatatgacgtatacctagcacacggtaaagtaggacatacacgtttcgttcgtgaaatcggtgtagctccaatttctgacccaagcttacgtcaaaaaactgttaacatgaaatacgtttctgatactaagaacatgagtatcgcaactggtttagttaacaacattgaagacccaatgcaaatcttaacagacgatgctatctctgttgttgctaaaacaatcgaatgggcttctttctacggagatgctgacttatctgaaaacccagaacgtgactccggtctagaatttgacggtttagttaaattaattgacaaacataacgttattgatgctaaaggtgaaagcttaacagaagcattacttaaccaagcttccgtattaatcggtaaaggttatggtactccaactgatgcttacatgccaatcggtgtacaagctgacttcgtgaaccaacaacttgacaaacaagttcaagttatccgtgacaacggtcaaaatgtaacaatgggattcaacgttcaagggtttaactctgcacgtggtttcattaaattacatggttcaacagtaatggaattagaacaaatcttggatgaataccaaatggttagtcctaatgctccacaaaaagctactgttcaagcaactgtagaaactgacaagaaaggtacattccgtccagaagacattgctactcctgctgagtacaaagtagttgtagtatctgacgatgcagaatctgctccatctgacgtggctactgctacaattgctaacgctactgacggtgttaaattagcaatcactatcaacagcatgtatcaagctcgtcctcaatacgtagctatctaccgtaaaggacatcaaacaggattgttctaccaaatcgcacgtgtacctgcaagtaaagcagaaaacaacgtaatcactttctacgatttgaaccaacaaattcctgaaactgctgacgtattcgtaggtgaattgactccatctgtagttcacttgttcgaattactaccaatgatgcgtttaccattagctcaaatgaacgcttctgtaacattcgcagttctatggtatggtgctttagctcttcgtgcacctaagaaatgggcacgaatcaagaacgttaaatacattccatctggaaacgtaattaacgaacgctaagaggaggtaaatatatatgtcaggtggtgatggtcgtggtcacaactcaggtgctcacaacacaggtggtaacatcaacggtggtccaacaggtttaggtggtaacggtggtgcttcagatggttcaggttggtcatcagaaaacaacccatggggtggtggttcaggttcaggtgttcactggggtggtggttccggtcacggtaacggtggtggtaactcaaactcaggtggtggttcaaactcatcagttgctgctccaatggctttcggtttcccagctttagctgctccaggtgctggtacattaggtatctcagtttcaggtgaagctttatcagctgctatcgctgatatcttcgctgctttaaaaggtccattcaaattctcagcttggggtatcgctttatacggtatcttaccatcagaaatcgctaaagatgatccaaacatgatgtcaaaaatcgttacatcattaccagctgaaacagttacaaacgttcaagtttcaacattaccattagatcaagctacagtttcagttacaaaacgtgttacagatgttgttaaagatacacgtcaacacatcgctgttgttgctggtgttccaatgtcagttccagttgttaacgctaaaccaacacgtacaccaggtgttttccacgcttcattcccaggtgttccatcattaacagtttcaacagttaaaggtttaccagtttcaacaacattaccacgtggtatcacagaagataaaggtcgtacagctgttccagctggtttcacattcggtggtggttcacacgaagctgttatccgtttcccaaaagaatcaggtcaaaaaccagtttacgtttcagttacagatgttttaacaccagctcaagttaaacaacgtcaagatgaagaaaaacgtttacaacaagaatggaacgatgctcacccagttgaagttgctgaacgtaactacgaacaagctcgtgctgaattaaaccaagctaacaaagatgttgctcgtaaccaagaacgtcaagctaaagctgttcaagtttacaactcacgtaaatcagaattagatgctgctaacaaaacattagctgatgctaaagctgaaatcaaacaattcgaacgtttcgctcgtgaaccaatggctgctggtcaccgtatgtggcaaatggctggtttaaaagctcaacgtgctcaaacagatgttaacaacaaaaaagctgctttcgatgctgctgctaaagaaaaatcagatgctgatgttgctttatcatcagctttagaacgtcgtaaacaaaaagaaaacaaagaaaaagatgctaaagctaaattagataaagaatcaaaacgtaacaaaccaggtaaagctacaggtaaaggtaaaccagttaacaacaaatggttaaacaacgctggtaaagatttaggttcaccagttccagatcgtatcgctaacaaattacgtgataaagaattcaaatcattcgatgatttccgtaaaaaattctgggaagaagtttcaaaagatccagaattatcaaaacaattctcacgtaacaacaacgatcgtatgaaagttggtaaagctccaaaaacacgtacacaagatgtatcaggtaaacgtacatcattcgaattacaccacgaaaaaccaatctcacaaaacggtggtgtttacgatatggataacatctcagttgttacaccaaaacgtcacatcgatatccaccgtggtaaataatcttagttcaactaagaaaaattgaatagaaaacggaatagggaacggtctaactgttccctatttttattataacgaattaaatggaggaatacaaatgttaaaatctacagtattacaaaataaaaaagttgcaacatcttttggagaagctgaatttaaccatttaggagaaagtcataacttgccagaggaacatcaaaaagctttagctgaaaaggtgccttacttgacacacattcctgataagaaagaaaaacctaaagaggaaaaagaagtaaaagaagaaaaaccaaaagctaaaaaagcacctgctaaagctaaaacagccaaaaaagataaagagtaggagggcatcatatgtacccagattacggttatgatgatggtggaaaccaagatgtataccaaccatatgcacatggtaacccaaaacatattgacattgcagacctagataagattactcctgctgattacggttggactcccgacacgttaaaggcttacatgtttggggtagctgtagttaaccctgaaacaggtgaaccattaggagatacattttatgaacatgtaattgatacagcaattgctaaagctgaaaagaaactggatattgcgattttacctcgtttaattcaaggggaacatcacgatttccaccaatctgactttaactcttacttatacacgcatgtatttaaacgaccactaattcaagctgaaaagctacaattagaaattaacggacgaggaatctaccgttaccctgcaaactggtggaaagtatataccctagcggggcatatccaaatgtacccaacagcaatgatgcaaacaggtacacaatttgcctatgattttgcattctctggctacccacaattagcaggtatgccaccttcatctggtcaagtagatgctccacaaatgattcatattgactacgtagcgggtatgttacctcgtaagaatcgtggatacaacgctgagtgggagtgccctgctgatttagagcaattagtaatcaaatatgctattaaggaaatcttccaacaatggggacgtttgattattggtgccggtattgcaggaaaatccttgtcaattgacggtgtaactgaaagtatacaaacaacacaatctgctatgtatggtggtgcatctgccgacattaaacagattgacgaagatattgacagactagaacgtgacttagcttcctacttcggaatgaacctaggaattatttaaggagggatgactcatggctaatgaaccaacacgtttcagcagttcaggttctacaggtaaccctaagcaatacatgaatgtaagtagactagagtttgaaacaaaaggtatggatacctttgtaatgaaccgtggtataaacattctgtgggaacgagcttggctttgtacatgccgaaatccgatgactcttgctcctgactctaattgccctatttgtaggggtagaggtattgcatatcaacctgctgttaaggatataatgattatccaaagtcaagaaaaaggtgtatcaaatcaagatttagggttgttcgattctggtacagctattggtacaactccaattgactctaaaattactttccgagacagaattactgtcccagatgtggaaatataccaaagtttcatttttaatgtaaatagtcgtagattagagacaggtatgtttttaagctatgatgttaaacggctagaggatgtgtatggtgacaaagggcaagtccttgtggagggtaaagactttacgatggactatagcacgaatactttttatcctaaacaacatttgttaaacacgaacatctctatcaacatggcagtaacattacgttatctggttattgatttactcaaagaaagtcgttaccagtacacgaaatttggtgtaaaagaaccgctgtttgagaaccttcctagaaagcttctattgaagcgtgaggacatctttgttgatagtgaaccctttgtattagaagtagatacgaagtctcgtctagaggcactagagaaggaaaaagaagtaacagaatctaagatggtagaccctaaacgtacaggttcgagtgcgggagggttctttggaggtaaactaaatggctaagaaaggacaacgacctgcactgttcaccagtcctaaagaaatgttaggtaatctgacacgagcaatggtagatgagattctatctgatgcacaagaccaagcgttacgtgcaggtgccgatgtccaaagaatgcctaattatttacaggtaacagaatcaagaatggctaagagcggtgtaattgatttaaaaccgttcttcgctcgttctagtaagaagaagtacaacaaaaaaggtgaatggtacttatatattcctattcaaattaagacaagaaagatgtctagaagattgtatgacgatttaaggtcttttcctacaaatggtcgtcctgtaacagttaagatggactatctttatgatagaagaaaacaaagtcccgctgtacaaagtatcaactatagccctaagtccaaaaatgttacaattataccaagagagtggggagaaggtacacggaatacatatgtgacattccgtacagtaaatgccaattctccggctaacagttggataatcaaccgtagtaaagtgaactcggacgatatgagtaaaacaatgttagctaatatcgacaggttaatgaagtggaaattgaagaatttaggagggtaaaagatgataccaagtttagacacttacttgtataaagaatttgaagaaagactgagaattatcttagaagagtgctatattatagacgaagctttgaaggagatagattcccaagctttagagacatttaaaaatacttattgttcaattgacggtaaggctccaaagaaagaaatcgaaatgtcgtattctttcccacaggagaagcagaactttaatgctcgttatgtgattacactaggtgggagtgatgaggagaataagtcaatgggtggtgtacagggaggctatacttaccgagaaggtgatatagttaatgaagctgttcaacttgtccgtaatggaaaagatttaattctgaacacaacaaagcctgtagctgattttttgaatagcccagatattagtttttcagaaagcgaccatttcagaatcgaaaacaacaagcctgtatttgattattccggtaatgaacacttagaaggtaaatcttttaatattgtttatactgtgaaagagtctgatgaggatgtagcaggtgtttacaaagggtaccaatcctccgataccgtaaacattgtcggaattagtacaaatatggacactgcccgctgtctagatgccatcgcaagattaattcttattacgatgcgtgacagcttagatgagaaaacaggatacatgctacagacgttacactttggagacatgcaacctgtaattgaatcaggtgagacagtagtatttggtagaccttgtacaatcgggtataaagtaactaattctattagttttgatttaaaccgacaaatacgagaaattattaccaaaaggaggatgaaagcctaatggcaaaagaaacaacaaagactaaacaagagagtccaaaggaacaacctaaaaaggttccaaagcctaaagggtacgttcatgtagatacatttttgggctatgcacaagtactttacggattaagtaagtatcaagtagcaggcttcaaagcattcatggcagggagagagtatcagcacgatgatgccgactttgttccgtttttggaaaagtatataggaaaggaagttaaataataaatggctgtagaacaattcccaagaaaaaaagtgtcccgtccacatactgaaattactgtagatacttctggtatcggtggtgcatctaacagttctgaaaaaacattaatgttagtaggttctgctaaaggtggtaaaccaaatacagtttatcgtttccgtaactaccaacaagctaaagctacattacgtagtggtgaactattggatgctattgaattagcatggaacgcttctgatgtgaacactgcatccgcaggtgacattttagcattgcgtgtagaaaatgctactaacgcaacaatcaaaaaaggtggtttaaccatcgcatctactatttatggtttagatgcaaacgaaatgcaagttgctttggaagacaatagtttaacaaatactaaacgtctgacaattgcatttgcaaaagacggatacaacaaagtattcgataacttaggtaaaatcttctctatcaagtataaaggagaacaagcacaagcttccttcactattacagaagatagcattactaagaaggcaaataaacttattctaagcgcaggtgctgaggttgaagaccaaactcctgtaatggaatatagcttaggacaaggtgtttactctgatacaaacgtattagtaagtgcaatcaacagtttacctgactgggaagctaaactattccctatcggagacaaaaacgtccctactgaaacatttgataaagtagaaaaagctgatgttaaaacaggtgagaaatatgttgaagctctaggcggagacattgctaaacaattggaatacaatgactatgtaacagtagaaattgaccgtgcaactccaattcaagactttgcgttaactaacctttctggtggtacagatggaacaatcccagaatcttgggctgacaaattccctctactagctaatgaaggtggttactacttagtaccattgacagacaagcaagctgtccattcagaagctttagcattcgttaaagaccgtacagacaatggagaccctatgcgtatcgttgttggtggtggaacgaatgaaacagttgaagaaagcatcgcacgtgctacaaacttacgtgacccaagagcttctgtagtaggattctctggtactcgtaaaatggatgacggacgtttgcttaaattaccgggctacatgatggcttcacaaattgcaggtattgcaagtgggcttgaaatcggtgaagcaattacgtttaaacacttcacagtaacaagtgtagaccgtatctacgaaagtggtcagttagacatgcttaacgaaagtggtgttatcgctgttgagtatgtacgtaaccgtaccttaactgcattccgtatcgtgcaagacgttacaacttacaacgataaaacagacccagttaagaacgaaatgtctgtaggtgaagcaaacgacttcttagtatccgaattgaagattgaattagataacaacttcattggaactaaagttgtagatacaagcgcaagcttgattaaaaacttcatccaatcattcctagataagaaaaaacgtgctcgtgaaatccaagattacacaccagaagaagtacaagttgttcttgaaggggatgtagcatctatcagcttgactgtaatgccaatccgtagcttgaacaagattactgtacaactagtgtacaaacaacaaatcttgacagcataacaggtcgggggcttttagccccctataccttactaaaaataatctaaaataggagtgaaacatagatggctagcgttggaaatcaaacagtccacacaggtaacacagtttacttgatgattggtaacaaaattatcggacgtgcacaatctgcatctggtgaacgtcaatatggtacacaaggtgtatacgaaattggtagtatcatgccacaagaacacgtatacttgaaatatgaaggtacaatcaaccttgaacgtatgcgtatgaagaaagaagacttagcaagcttaggtattactgctctaggtgaagatattcttcaacgtgacattatcgacatcgtaatgatggataacttgactaaagaaatcgttgttgcttaccgtggatgctctgctgtatcttacagtgaatcattcacagctaacgaaatcactagtgagtccactcagttcacgtacctaacatcagctaaagttaagtaagtagtgtaaaatagaccctaaaaaatggggtctattttttttagttttggtattgacaaattatacatgtatctatataataggtattgtagttggtatacattttcgaacttaatctttcttatctttatcttacacatgacctagcaggagtgctaggtctattttttttgctctcatagaggcaactaactagtgtgctataataagtatagaatgctatattaacttatgaaagacataggaggaataagtaatgactgaaaaagaaaacaaggttgatttccctcagcttaacatgactcgtgaacagcttatcgaaaagattaaccgtggggaaaatctaacagacgaagaaattaatttgttaaaatatcataatgcagaagcagagcataaagaacttaaccgaattattccgggagttaacaatgtattctcaaaacattatgatttaaaagagtttggtatggaatttgatattaaaattaaagcaccaaacgtggtacaacaaggtaaaattcaagcaatgcgtgaggcttacttagaaggtatgggtatggcagtaagtaactttattttccaatgctaccatacactagctactatccgtgtttgtggtgtagaagtacctaaagagctagaaaaagatgaagacatctataacatctacgtcttaaacattatcgggaaggattttgcggagtggttaaactcctttcgctactaatctcgaaagtttagggggtataaaaaccctcgtcagaaatacatatagccgaaacatgtgggctattatgaaaaaatttaatgtattacctagtgaccctgcatggcaaaatctaactcatgagcaagtagaatggattttgtataacatggaaagagatgttgaagaagaacaacgcagagctaaaggtcttgctctcgaaggtgaatacgaggacttggatgcttcttggtatgatgtacctcatgaagagtttaaccctgtacgtgaaggtcatgatgaagctgagattgctcgtaagcttaatgaaatcactacagaagaggacatggctaaacttaaagctcgttgggaagctagtcaggaagtcgatgcaatccgtgccgaaggtggtacaacgattgaggaagacacaatcaatgaacttattgctaacaatgtacagaaagctattgaagaagctaaacgtattgagaaacatggtggtaataagtggggagacaaaaccccgattgaattagaggaagagcgtaagaatctagaatttaaatctcagcttaagcaagatgatattcaagatgcaattgctctgttcaatggagaaaaagatattgaaccaacatcagtagacgatgattttgtaatataggagggtagggttttaccctaccttttctttgtaaaggaagtgtggaaatggctaacaactatcggttttacgttgatgcaatgactggggatgccattgcaaaattagaagaagttaataagttgatggataaaattgactctaagagtgcaaaaggtacccagaagtttttccatacaactcaaagagaaatagacgaagcagtagccgatatgcaacgtttaattcgaatgaaaaaggaactagataagaacttcgaaaaacaaagttctatggcagaagctacaggtagcatgacagattttaaacgtgcacgtgcaaacctagaacagttacaaagtgagttccaaaaaacacaaaacgagttccaaaagttagcaagcatgaaagctaacccgaactttacgaataaaacagctttgaaagaacaaagagcttacagagaagaattgaccgagcaggaaaaagctttacaagcaatcaagaaagctcaacaagaattaaatcgagtaaactctcgtgtaaatcatagagcacaccaagctacctctacaggtagaatgacctacaatcaatctgaaagcatgaagaaggatttaggtggtgttgggctatactcagatactcaacgagaaaataaagaacgacaagctcaactaagagaccaataccgtagaagacaagaggagctatcacaagtacgttctgatacaaacttagatagacaggttcgtaagaatagagaaacatctatcttagaagaaatcaaaggtatcgaacaagagattgaagctcgtaagaaatttaatcagaccttgaatgatactattgagaacttaaagtcaaaaacggaacagttaaacaatagtaacgttaaagtagaggcggataggaactccactgcgggcgttatagcttctcgtgccccatctatagccatcgcaggtttaggctctgctgtggcggcaatagggggcttatacgctaagggagctactgcgaatgcaggtatgcgtgattcaaccatctctttaggacaacgtacaggtaacggagacttccgtgctattcgtaaagaagcccaaatgatgggtattgaaaagcaacttgggtataaaggagctgatatgcttcaattccaagaagatgcgttaagtaatatcgggtttaccaataaagaagacctaacagctaatactagagctttagcggaaggttcacgtgcagttcctgttgattctgaaaccttaagcgggtttatgaacgaccaaatgcgtagaggcgctgtgagcggtaaagaccaaattaaagcgattcaggaaggtttcttaggagctatccaaaaatctggtatggtaggtcgtgaaaaagagcagttaaatgctttgaaaacattaagtgaccaatcatttagtggacgtaacggtagtaatgaggaacttaaacaacaaatggctatgcttacactgttgaacaaaactggttctcgtgccgtccaaggtgaacagggtgccgagttaatgactagtttatcagcgggtattcaaggtagtgtttggaacaacaaggcttctttactactaggtaagggtagtcaataccaaggtttaagtggtatgtatgacttagcaggtaaacaagaagagggagctacccctgaaaatctgcaaaagattattggtagtgtacaaaaagctgttcctaatgatgaaaaaggtcagaaatatgtccttaaaagtgctatgcacgaactatttggtacaaatgcaactaatgaccaagtagatggtatcatgaaggcttacggtaatggtaatctaaatgaagaaaatatcaataagattatgaatgaaagcgaatctactggtaaagataaatacaagaagaatgcagaagattatactaactcgaaagagggtatggctaatcgttccgaagcagtaactgagaaacaagcttccggtatcaacgactatggtgatgctctacgaggaattaattctaaattaggaggaatccctccggctatgtatgctttaggtgcaggtatgggtgccctagcaactgccttgattacttcgggaactatgggtggtctctctagctttgttaagaacttgacgagagggacattctctgccggagctacaactgctacaacagccggagcaactagtgcaggtggttcattctttaaaggtgtaggacaagcctttaaatcaggtaaggctactggtggatggtcagcaggtcttaagagtgcaggtactacagctaaagacttagcaggtgctaatattgccggagctgaaactattgcaggagctacgaaagcaggttctgtagcaagtaaatttggtaaagtagcaggtaaagtagcgttacctattgccttagtcggttcagcaattgatattgcaagctccgatgacaaggtaaaatctgttggtgagaatgccggaggactagcaggtggatttgccggagctaaattaggtgctttagcaggtacagctattttaccgggtgttggtactgttatcgggggtgcattaggtgctcttggaggtagcttaatcggtaataaagccggtggtggtttagtagacggtgttcgtaagttctttggtggagaggaagcctatgcagacgaagtagatacaggtacttccgcaggtgggcaagaaacgcttaaaggacaagagaacaagtctggtaaacaagaagaacgagacatgacgaataaacgtgtcctttctgaaaaaacacgtgctgagaataacgctgaggaagcaactaatttatctatctactcaaaattacttgatagagcacaacgaatcctaaatcaagctagaaatcaaaatggtatctttggtaactccaagggtgctaacagttctagtgatagtggcggtatcggtgacgaccctgcaagtaaggattttggcggagactgggaaaaagccattcgtcaagcttctaaacaacttggggtagacgttacagaccaagatgtagacacattgcttaaattaattcaagcagagtctagtggagatgaaaaagctgtccaacaaatcattgatgagaacaactttaacggttctggtggtgccaaagggcttctacaatacatccaatctacgttcgatgcttataaagtaaatggacacgatgacatcatgagtggttatgaccaattactagcgttctttaacaatagcaactggcaaaaagacttaaatgcttggaataaccgttaccaaaatggtagtacgggttggggtccaacgggtagtaagacccatgcgatgggtggacatatcacttctccggaacatgctttgcttggtgaggtgccgggacaagatgaatatgttattaacccacatcaacctacagctcctagattactggcagaagcttctcgtaaaactgcacagaaattccgtttgtttggtaatggttctggggacgaatggtcttcccgtataggtggaattaacttatccggtggaggtagttcagcacaagcaccaacattaaacaatacaaatgacgttaaagttagcgtaaccgtacaaggtggcggaacttctgaaagtattgctaatgaaattggtaataaaacagcaagtaagattcttcaatcagccgatgatgcaatgagtttctttacaaaagaaatgaaacgagtttaagaaaactagggggactcgttccccctttatttattgaaggaggtaaactatggcggtagaattacgttatcctagatttaacctagcgttttatacagaaaaagacgaatatcatattacgtatgatgcacagacaggtgaatctaatacttctgtagtaaacaaagataatgattcggaagtttctaataactttatgatagaatccgttatcagtttaacaacaaaaaattcaatggaagatgacagtgctgtcttttcttttgttctagccggagatgtatactgggatagaattttaaaagccaatgatgcagttgtattacggctttaccctgatataaccagtgacctacctgttaacccagttttattagttgggttaatctcagaagtacgacttgaaggagactatggggagaactctaagatgtatcgtattacaggtcaatcatttgctaaggctttaatgcaatttgacctaggtgttattcaagaagttagtgttgtattaactgatattggttggttacctgatgatgcccaagagggggttaagatgacaggtagaagtgccagtcagctagcagaaggtatgatgaaccgtttcttacaatatatgaaatttgactttaacggagaaggcttagagcgctttttagaatgggaattagacagttggacagaagcagagcgtttgatagataataccccgtatattaactatgagggttccctaaaacaattgttagacgacatcacagctaaaccatttaatgaactgttctttgatgctacaccgggaaacaaatgtcgaatgattatgcgtagaaccccgtttgataaagcagactgggagaatttaactacgtatactgtaacatctaaagaagttatttctgagtcagtagcaacaaatgatacagaagcctactctatctttaatatttctataaataacctttatggtacagactctatgatgctcggttctaaaccacaggtattccctgctttagttaataagtacggatacaaaaaactagaggttgataacaaatacttgcagggtgcaattgtagataacagtgataatgcagatagtgcggatacaaatactgacggtgatacagaaacgaacgaagacaccactacagaaagacgtacaactagaaaaaaagatacgaatgaatctagtgcattcgacacgacttacggtacagtaatgaactatctacgtggttacccattagacatcttaagagtgaaacgtggtaatgttcgagctaaaatacttcaagtagacagacgtattacaggaacaatggcagataaaatcattgaccagtatattacaacacagagcttgacaaaagaacagttcacagatataactggtattaatgaaaagaatgctagcaagggaaatggtaaggaaaaacctacgtataaaaaacttgtgaagttcttggaagattacaaggatgaagcagagaacaatgagactaccacaatcaagaatgaacttatgaatgagttcaaattaacagataaccaagcaacatctattgctagtgagtttgtggctaataaaagcttgcgtaaaactcaatatgacgaaatcatgaaaaacaatcctagtgatagtacaacggtatctggttctgatacaaaatacgtaaaagaatttacgaaacgtttagctaactggtactgcgaaaatcctaacttctatagtggagatattgtagttaagggtagtccagaatatcgtttaggcggacgactattcgttatagacgaacagaacaacgaattgtgggaatactatattgaatctgtagagcatactttttcttacacgcaaggatatacgacaaccctaggggtaactcgtggtcttaaaaacggaggtaaagaccgattcacacacctttgggacaagtcagaagacttctcaggaggtatgttgggtgaaaagaccttagaagctttactagaagagcaagaaaagaaaaacaatgagaacaatagtagttctggttctagtggtggttcaagcggagttaacccatctaatattccgggtggtacagtagcaatgaaagctgtaaactggggacgttctcactccaaaacagaatcttcctttaggtctgcgtatgactggggaggtgggcgtacaggtagagacccatttgaaagctcacctattgctacagactgttcgtcatttgtatggtggtgtttcaaacatgcaggtgtagaattgaatggtggagcaactgggatgactacatggagtatcattgcggatacgaaacttgaaacaatagctacccgtggtcaaaagaactctgctatctttgataagatgaaagcaggagatattatctggttccgtaactgtgaacatattggaatttactgtggtgaaggaaaaatggttgcatgtaatggttcaggtaacatgaatgaaagtcctacagcaggtattattgtgtcagatatgacaagtggatactggtgggatacattcgatggagatgtaaaaagatacaattaacctcgttaatagcgaggttttttgttgtaaaaaaacaaaactagtatgtgtgctataatattaagtagagacacatacaagagaaaggatggtatcaacttggcaggaggacgtagatttcaggcagggttaggttccgaacataaaagattatacaaagaaggacaacaaattaatactttgttactagcccaagttatccaagttaattataaatacaatacagttgatttactagcattacagcataaagaagttttccaaaactcctatgccaatgaaggtagattttctgctcgtttaccaatggaatttggtggacgaaaccttgcaggacaaccatatggtcaagtaaaccctattgccgttggtactgttgtcctagtaggttttattaactctgataaagacatgccgattgttattagtgtatacaataacaacgatgtaaataaacaattatcccgtacacgttttgctaatgcagaccctacagatatggctttagcgggacaaatgtatcaaaaatttagtttgtacccatctttaacttacgatagtattgatggggatggtaaccgagtagttacattctctggtaaatcatttattgcattcgatacaaaagacatgcaaaactctccaatgacagatgctagttacggttctcgttatgaagacttaggaacatcttactataacgatggagaactaattgaaccgatgaaaggtcgagcacctaatgtgttgttcaagcaccaaggtattcttgacgatgataataaacccgatacacataatttcatgattcacattaacccagatggaacataccgtacatctatgatggatacggaacaagactggcggacaatgtttgagatgacaccggagggtaaaatccgtttacgtagacaaggggatactgtacgtctaaacgatggttttgaaattggtgaactaggtattaatgaagaaggtatcgtttacttacgtaatggggacatggacttagaagttcgtgaagatggtatctactcccaaggtaaactaatcacagaaaatatcaatcttgatgatatttatgaaaaattagctaatgttacttttgaaattaataagacaaatgagtccttacaaattttaactgagaaatcagagctacaagatggtaagattgtaaatctagaaacagagattacaattgtagccggaaaagtagaatctaaagtaagtgcaacagaagtacaagacatgattgatagctctattgtagacatgacggatgctattaaaaaagcccaagaagatgcagatagagcaaatcaagttatttctgatatggctagtgataatcgcttggctcctagtgagaagctagatttactaaaagagtgggacatcatcaagaatgagtacccaacttatttagcacaagctgaactatacgaagtagatagtacaacttatactgctaagtataaagctttagaaacatttgttactcctttattggaagacatggaagctactagtgtagtagatggttctattatgcgtaaaacatttagtgcatattacacagaacgaatcaatttactaaatgcaatcactaaagggttaaaagatggtttagaagaggcaatgaagaaagcttctcaggcttctgtagatgctacacaagctttagctgattctgcacaggcacaaattgatgcaaacaatgcaaaacaattgattgcagatattgctagtgacggtaagctgactgcttctgaaaagtaccaattgaaaaaagaatgggatgttattgttaaggagtatcctacaacaattgcccaagcaacaaagtacaaagtaaatacagataactatactgctaagtataaagctttagaaacatttgtcactcctttgtttgcgaatatggatgaaacaagcgtagttaacggggaacaactacgtgcagtattttctgattactatgctgtaaagattactttattaaaagaaatcacagatattgctcgtgatgaattgactgattatggtaaccgtattactgtagcagaaacaaaaatcacacaaacatccgaagctattacgttaatggcttccagagtggaaactgttgaaaatgatgttaaaacaaacacagcgcaattgaaagtgcaagcagacttaattagtcagaaagtaactgctagtgaagtaaaagatgctattgataatgcaattgataacatgtctattggtggttctaacttgtttgtaatcaaaacgcaaacagcaggactattgaatgaaaataatggtactgtaggaacagccgtagataaatctgtagtatctaactatatcaaggtaacagctaaaatgccttatgtagcttctttatatggaaacacagggacaaacagtattatcattgcatggtatgacacaagcaaaacgtttatctctggtcaagctgtagctgattctggtgatttccataaaacttatgttgcaccagaaaacgcagtatatgctcgtttaagctataaaaaagctgacactgttaaaatgaaatttgaagtaggtacgaagccaactgattacagcccgtcatgggatgatattaaaggtgaccagactgctttagaggaatacattaaacaggtagaggaacaagctaaacaagcacaacaagaagcagaaaacgctaagaatgaagcagaaaacgcaaatagtgctattgctgatatgtctaatgacaatatgttaacagcaaatgagaaacaacaaattttactacaatgggaagaaattaaaacggaatatccaattaatttagaccaagcaactaaatttggtgtttctgctacgcagtatacaacagcgtacaatgctctaaaaacatatttagacccattattagcagatatgacaacaacttctgtaattgttggttctactatgcgcagtacatttaatacttactacgaccgtagaacaacattgcttaatcgtgtagctgaactagctaaacaagtagctgaccaagctaaggatacagcagacaaagtagacgatgacttaaacaacattggtgggtacaactacatcggattctcttccggagaccatatgtatcctcgcttgatgattaagaatgttggttattactatgttccttctacaacaagtgcagaatttgtagatgatatggtttgtttaaaacctaaaacagctacagctacaagtgttcaatatgacatcggtaactctaatgttagtgtggctaacgttggacttgctaactatcgaatgaaagaagttaaaacaggtcaatggctgactgcttctgcaaatttaaaagttgtgggaacaggtactgcttatctaactatttttacactggaaaatggttcatggaaagcttcatacagcgatagaattagtgcaagtcaaggcgtaacccgtgtagttgctcaaagacaagttacagatgcaactacaggtattttagttcgagttgatggaagtaacataaccgaagttcatttcggaaatacgcagttagaagttggtatccgacctactccttggaagaaatcagatattgacattcaagaagacatcaacaatgttgcagatgacattaaagattacatcggtgctcgttcagataacctaattacaaacggttttggtgagttagggaacaatacgaatattggtggtatctttgatggtgctgataggattgtaggtaaaggttccttccgtcaagaagaaggaaacaaatcactattattcagtgaacacattgttattgacaataagaaagtttataactttgattactacatgcacacattaaaaggtgttggtagaagttacgcaatgattgccccgtatgacgtagacgggaaacgtatcacatttccttctctcgggggacgaaactacaactctattacccctgttaaatttacaaaactagcaaaaccacttaaagtcggagatacagaggtttttgtagaagatgctagtctatggaacggacaggcaccgcaagactaccaacgtagtattatcatgtggggttataaaaactcgttcggctatacttatcccgatggaacgtatagtcagctaatgcagatgaagacatatgatattggtgcagttgacaccacagctaacaagattacgttaaacaagccatgggcagttgcaaacccaaatagttcagatgggattttcccagtagggcatacacttagcccaacttctgacggttccacatatctatatttgaatggtcacgtaaatatacaagtacctactacgtacaccaagtacagccatttgattagtggctcttctgagtttgctaatacaacgcttatcccagtagaaacaggttctatccaacttggattcttgttgaaccgtgatacaacaggtgaaaaatcttggctaaacggtttacgtctacgtgattatacagatacgtataagctaaacgatgacgttagagaaacacaagaaaatgtggataaagcccaagcagatgcagataaagctaaccagtcaattgctgatttatctaatgataatttagttactcctaacgagaaactagatttgaaaaaagagtgggaaattattgttgctgaaaaacctaagaatgatgctcaggcagataaattcggagtaagtaaagtagcttacggtactgcgtatactgctctagatacgtatttaaaacccatcttagcaagcacaacaacgaactctgcgattgttggacaaactatgcgggatacgtttaaggcgtattacacggctcgtacagacctgttaaacgctattgcatctaaagctaaggaattggctgataatgcacaagataccgcagataatatagctgtcggtactcgtaaccttttaatcggaacacaggacttttccaaaggtaaatatccgggtaatgctaacgttaccattacagatgaaaagctgtttggaaatgcagtaatgaagaacgattacactacaggtaccggatattcagatatgtaccaaatgacgacctcaattattccaacaggaactcagtatacactatcgttttatgcaaaggcagacctagaaggaactaaaatgtcttgttacttctacaacccaaatactacgacaagtagtgtaaacagtcaaggtggcaaacttagttctagtgacggtcgtactgtatttgttttaagtgcagaatggactaaatactgggtaacttggacacagacacaggcagacaagcctaagtcagtaattattggtcgtaagactggtggggaggaacctaactctgctttctatatgtcttctcctatgatggtagaggggaacaaaccacaaacgtggatgaaagccccagaagacattgaaacagctataaacggtaaagaaggtgcttgggtttactccccaacagcaccaacaaatccggctgttggtttagtctgggtagactcttctaaaactccgaaccaaccaaaacgttgggttggtggagaaactggatgggttgccttaaccccagaagaagtaaaagatttaccttggggtgaagatggttctagtcttgctgactgggtagcacaagcagagcaaaagatttcttctgatgcaatcattagtactgtactaggttctgaggactttaccggtatttttgactccaaagcaaatacagaagacttaaataaccttgcttcttacgatgacttagatgctatgcaagctgagtatgaacgtctgttaaaagaagggattgcaggaattgacttctcaccatatgtaactaacacagagctagaacaattgaaagatagcttcactttctctgttcaacaagccggtggggttaatatgttgaaaaactctctaggattctctgggacagacttctggcaagcctcttctggtatagatactactcagaatgaacagttgtctaaattaggatttggttccggatttatgataaaccgagttcaaaatgcaacactagctcagacaatcgaattaccagaagcaaaacaaggtttgcagtatgctttatccttctacatgaacgtagctacttttggagatgtcactgatttccaatgtggggcacatatctacgaagaaggtgtgttgaagtatactgttggggtaacagatgctacacaagaaatcccaagtgactatcacttgtataaacttgtatttgaaccagagtctccgaatactgtcattgaattatttgttacaaatggtgcacaggcaactgtaatcatttcaggggttatgtacaatattggtaacattgcgttgaaatggcaaccatacccaagtgaaatctataacacgaacgttaagattgatattaatggtattactgttaaaaacaatcagacagatggttatacaatgattactccgcaagagttttcaggttacgcaagggttaacggggagatggaacgtatctttaccctaaatggtcaggtaacagaggttaagatgttacaagcagagaagcgtattacaatggaacctatttccgtgtttgcgatgaactctaaagaaaccaatacaattggttgggcgtttgttgcttccggagaggttgcacattctgccatagcatctagtacacaatagaaagagggagccttatctgtaaggctctcttttgttgtgttgtgctataattatattatgagaaacaaaacaagaggtgagaaaataaatggctttaagcggtagtacatacacagcttttgcacggcataggcttgtgttagaatggagagcctcccagaatgttgcgggcaactactctgatgtaagtatttggttatacttgcagtctatggattcctatggtgctttatatgctcctgctgttggacaagcacaggtaacagctaatggagttaagcaaaccgaaaatgcaacatcacaattgaatgcttatcagaaaaaactattgctagccaaagtttggcgtgtaaatcataacgcagatggtagcaagtctttttctatatctgctagttactttgtaaacgtaacctattcaggtgtttactacggaacaatctcgataccgtcattctcggtttcattaaataaaattccacgtaaaagttcgttaaaccctgtgccagatttaaatattcctaataaactaggggtaagtattacccgacaaagttctagttttacacataatttaactgtttgggtagccaatagaacaaaccctacattagataatgactcccattgggtgtatttaaacagtattgagaacgtaggtacaagtggtacattcacatttagtgtagcaaacttcacagaaatgttcaagaggatgggtacaagtaccgaatgggtaggcaaggtgaagctctggacgaatggtttaagcgagtcagtgccgagccaacaacgaaccttccgaataaaacctccaatgaacgcacaggcttctgggggtaagttaaaagtaaaagcaggagaaaagattactgttagtctaagtaacttccaatctgacggtaactttaaatatacaggtgtttttgattatcgaggggtatccataccagtagcaacaaatgtacatgcaaactctatgactcttacattaacccaagcaaacgtggattctatcttgaaagaatctccggatgatgcaggaacatgggggcaagtacgagtaacaagttactacaatggtgtacaatatcgaactccttggactggacagcatattgattgtaccattcctaaagaagattacttacctgtaataaacggaacaccgacttatactgacttaagtgccgaagctactaacgttaccggaagtaaccaagtagcattacaaagtaagtctaatatccgtgtgactattccggctaactttgccacaggtcaaggattctcaacaattaaaaccgtgcaagcttcattaggtggggctacaaaaactgctaactataatgcttctggttttaacattgatattggtgctccaaatgaaggtactgcttcttcattagttgttactgttctagacggtcgaggatttagtacatcttggacaaaaacagttcaagtatatccatatagcaatccagatgttaactatacgattgcccgtagaaacaactttgaagtagatacagaattagctgtttcaagtagttgggcgcctgttactatcggtggtgtaaacaaaaatgcaattacgtcagtaacctacgcaactaaacgttcaggtacaagtacatggggagaagaaacaccagtaactttctccacagatggggctaaagttattgtcccaacaaccgttgttcagttacctaatgagtacagttggaatttcagactaactatcaaagataagtttggtagcttctctaaagaagcaaatatttctgccggaaaacctattatgtttattgatgctgttcgtgaatctgtaggttttggtaacctgacaggtacaggagaaaatagaaaccttaatggtgtaattgaaattgaggcggaacgctaccatactacaggtaaaactggtatccaaatgaataacagtgatatttctggtttgaatggaatatatttctcaaatgacgtaatggataacgatggtgaaggattgcattttatcaagtcagggaaagacgttaactcttccaataaaaaagactacgattatatgtatatgagagacggcggattctatgttaaccatgatggtactccaatctttaaagttactgataacggtcgtatgtattatcctgcctctcatttgtggtctggtggttggtatatgtctggtacacaaaatataaccccatcgaaaccaatgtcagagtgtagaaatggatgggtactcatgtgggctaagtatcaaaatagcacacagacatggaatgatgttgtacaggtatatttaggtaaggacttagtaacaacacatagtggactaggtgtaagattactatttggtggttatggtaacgttgttatccataaatatttaacgattactgatacagaggttagaggtaatgcttcaaacaccaatgctagtttaaacgctgacagagctattttagttcgtgttcacgaatggtaaacgaggtggaaacgatgaaaatatacgtagcagttgacgaatataacgtattgactggatggagtagtagttacgaagaaaatctaattgagacagagattgacgaaaatcacccacttattgtctctaatgatttttttggtaattataaactcatagacggtaaattagttaaagatacatctattgaattgttaaatttaaaagacatgttaaaggtagaattagaccaacaatgctcagaagctattattagcggttttagctacccattaacggatacagaaacacttcacgtctcttattcacgaaataaacaacaatactttgaagagattaagtctcttttcgaacgtaaaattgttactcgtattaactgggagtttactactgatgatggagctactattactaaagagctaaatgaaatagaatttttaaccttgtacacttttgctagtttggttaaaacagcaaaaatgactaagcttaaagaaaaactatatccactagttgataaacaaacaaataaagaagacctgttgagtattacatgggattctattcctgatgaaccattaccagaaaaacctgttattgatttaaatggtgatggtgaaataagtcaagaagagttcgatgctttggttaaggaaaacaaagaactaaagcaaaaagtagagtttaacgaattggctttaatggatgcaattaacatgctatcgagcatgagtacaggttaattttaaggaggtgataacatgtatccacacttagcaatgctctatgcaacgtatgtcatgaaagaccctaaaacatggacgatggacaaagttcctgctatgattcgagaagatgtacaaagaattgtagatgaaatgacaaaaaaagaacaagcacccgagtagtctttctaacactaggggtttccattggtttagtcgcaggactagctattgggttcttcctataatgctcggggagaggaagagggtggcttaggctgtcctcttttttcttagttaattgtactatattaatggacgaaaggacgtgataagtgtgggacaatcagatggaatgggtggaacattaaaaagaattgctattcaagttggagacgacccaaacacaggttggtatagatttcaagttaacccaactcaatataaatacagcaaaccacaccgtgtaacaatctttaaaacaaagtctaacattatcactgaggactttggtaaagatattgagaccattcaattctccggtacaactggatttagaaaagactctagaggaatgaacggtgctgatagattaagagaactatctaatttgatagatgattatgcaaatcaaggcggtaatggtaaccgaccgaaagtagaaatgaagttctataattttactgatgaccaatattttgtggttcatttagccccagaaggtctcactatagaacgttctgcggaacagccattactatttacttatacattaagcttagttgtattaagaaaagcgggagagcctgctgaacgtgaccaagtaaacccagaaattgggaacaaaaatccaagtgtaggagacaaggataaagaaacaagaagtggcataattcaaactcctgcacaaatactacatgaacagtataaaaattctgtgttgccaaatatagcagtaaaccctagtggtacatcaggtgcctataactacggtttagttgaactaaaaagattaattggttacggaggtggtcagtaatggcaactgtatatcaatctgcggacttgcttagattctttcgttacttaaatgtaaacgtgcaaggagatgtcgttagtaatgtcatagacgaccaacctaactttatttctagattttacacaccgcacacaagagtgaataaaatatctaataccttattggatattgtgaaagacaataacattagtgaaacaaacaaagagttatccaaggattcactaacctataagttcttgaagagtggactacgattaacagctcctgacatttaccagttagctcaaatcgtagtacttgaatcttttgctttgatttatgcaattgaagaaaaacctgaaatgttcaaaatgattaatgaatcagatgtgaaacaaacacgggagaacgtaaaatatcttgtagactacttaggggagaaaaaagattatactgatattgtaatggatttacattctatggatattgcccttggttacatccaagaacagattccattaattcaaggagggttaccagtaaatggcacgatataaaaaacatacaatcgtttatggagaaaccatgcaatctattgctcaaatggaaacaggttcagtaaacgactggataaaaattgctgagtataactccttggtttatccatacatagtagatactatgcaggagaaaatggctaatattgaacatttagcaacaccgggggatactttggtaattcctgtcgaagctaacctactagacatggacgtaagtaatctaaatcaaagagacatggattttctattaagtttatctctaggtcgtgatttagacatgacaagtgagacagaatactatgaaaatcatggtacaagtgatgaagtgttctcattaacccataacgggcacggagaccttaagacggctaatggagcagataatataaggcaagcaactatctctcgtctaatgaccgctaaggggtctttaatgctacatccagaatatggtagcaacctacacctactttttggtaaaacaactattgaacaaatgaaattgattagcttagaagtatgtgaaactgtattaaaagacactcgggtagctgagtgtgtattggttagtcattatatcgaagaagaccattatgtaggaaactaccgagcaaccatacaatcaacaaaagaccagttcgagtttgtagtacaaaatgatagtgtgggcgcaattgttatagaatagaaaggagtatccctgtgagactaaagaagatttcagaaattttaggtaggctaattgacgtaaccatgattaatactcatgagttaaacgacttctctgtagggtctacaatccgttccatttacgaagctgtatcaatggaacttgaacaatactacatcttaggaagagaaaatattttatggggtatcgaacagggggtactcaatgcttttgattttagaaaacgtgaagctaaacgggcttatggtatggttaccctagaatttcataccgtaacgcaaacccctgtttatgtgccgacaggtacgacctttgactctagcttgtctggtgcacctagtaacttgacatttcaaaccatgcaagactatgtgattcctgccggagttgttactgctaaagtagaggtttactgtacaacagttggttcccaaggtaacattgccaaaggaagaataaatcgggttattaacaacatctctaacctgaaaaaagtgtataatgaatatgacatacttacaggtactgacgaagaaagtatcgaatctgtaaagaaacgtttccatgctttcgtagaatctcgtggtagagctacaatcaaagcattagattatggtacacgacaagtcgaagaagtatctggtgtgtatatcaaagaggaagttggttatgtacgtatttacgctcatgacttaaacggagatttgaaagacgaaacattagctaagattaaaacagctattgaagattatcgtcctgcgggaattaaattagacgtgttccctgtagtcaaattaacagtaccgattgacgtaacaatcacaattagtaataaaaacagaattaacactgcattagaagaacgaatcgaattaactattagaaactacttaaacagtcgtacagtatcagaaacattggtaaaagctgatttacttcaagctatcatgaatattgatgacaacttaatctatgactgtgaaattaataatctgagtggtaacttggatattagagacgaggagattattcgtgcaggagacgtaacgatagaattaatctaggaggtaacattgtgagtaattttttcagaaatatacacccactcttgcgaagaagtaaacgtccggagaagtatgacgatacgaacttcgctgtgttgaatgcgttaaattacgaattaacacaggcagagcaagaaaccattgctagtaaaatacaatcctccttagagtctgctacagatacgtacctagacacttggggagattggttcggggtgtaccgtaaggacggttgggacgatgaatattatcgtgcacgtatcatacgggaactacttcttaagcgtggtacaattcctgctatcattgatgcgttattggatttccttaacgacaatgatgcagtcatccaaatctacgaaccttggagaaacattttctatacaaataaatcaaaattaaacggtgacgaccatttaatgggttactactatcgttttgcaattattgatatttcaattgatagaccgtttcctcctgaaattgtagagattattaaggctttcaaacctgcgggagttttattctatctaagattagacacaagtttaaataagaataaaacaactgtagaaagtccatatgtatatctagacgtgacgaataagacagaattagagttctttaatggtttatattatgacctacgaggtaatattaacctgtctgaccaacgtacacaagttgtagagaacaatatcttccatacgaataactctatgttaaacggggaagatgtacttgcaggagcatttgaccacggaagaggttacattcacttagcaagtacaacattgcttgattacacaccaaaacctactgactctatgagtgacttaaaaacagctctaggagagtcaggtgctgacatgtataatcagacaaaagaaaaggatggaagaacagcttctattcaagtacctgcaacaaggaatgtccatacgttatactcaaatagtatagattttggtgactatgattatagcggaaaccctaatgtagctgtaaccgatgcagatacgttcaaattaggaacaggtggaactcttacctataataacggggagtacactgttttgatggatgggacagctagattaagtaaatataataccgatggtaaaaacagtgtatacttagaagataaggtaacttatacaatttcttgtgaaatgtatgttggttctgattataccggaaatgttgaccagatatttgctaactatgcgtatcttgatggaggctatactgtactgcaaacaacaagactccctgcggatgctcctagagatacttggataacagtaaaaggaacatctactatgaactatcaagggagagtacctaaagtattgtactttagttggcaaacaattgctagtgatgttaaccctactggtacacttaaaatgcgaaatatgaaaattgagcgtggagaaattaatactccttaccaacctaatttattagtagagccattccaattatctaatgttcctttaaatgataatttaggagacccaaacgtatctttcccaattaacacacaaaattcctacttagtgtatgatggcaccataaaagaaaattggcaagctaacacggtgtataccttaacattaaagggtaagaaattaaatacacagagttggaaaccgtatattgatactaaaaatacttccacgcttagtaaacctcttttaactcctgtggaggggttaccgaatgtttggcgcagtacatttatggtctcccaaaatgatatagacaccggacgggttcaaaaacagttaagtatctaccaagcacctagtgcaacaaggggtacagcttcaattgaatgggtgaaacttgaaaaaggtgctattgctacaccacctatcgaacagtatgcctacacaggtactcttgtttcaggtacaccttctaaaaaccctaaagattatacatggggaagtttatctcctgttttaggtaaaaaagcctatatggtgtttgatattaagacatttatcgaagaaaattatgctatagaatttgaaaaacttattactgacctaggagaagaccaagcattaaatactgtgtttgaaaactttaacatctccacagcacttaaggctttagtaagtccaagttcaccaattaatttttcagttgaactatacgatttttctacgagtgcatggcacaaactaaacacggatagcttagacctacgtatgcgtacattcaacttagtagcaaaccgtatcacagactatctaaatgattacaaactattatttgttcgttatgtgtttgataacgaaactgataaagatgtaacagttgaactagacatgttaaatgtattgttcaactatcgtttaggtgacggatatagtttagggctacaaagtactgtagaatgtttaagtgaaattccgttaactggtattaccctttctagtgatagtgttgaagttgctattggtgaaacagcgaaagttactgctactcctgttcctgccaatgcaactaacaaaagtttagaatgggaaatagcagaccctaagattgctactgtagatacttctggtaatattacaggagtagctattggggaaaccacattaaccgtgtatggtgaagacaaaaccattagtgctacttgcagtgtgtctgtaaaagctagacataccctatactcaaacagcaccgacttcggtgattatgattatagtggaaatcctaacttgctaagcaatgtaaccaatgatagttggacggctgagggtgctatgaaggtgaccgcagtagatgattacctagagttagtaaaagatactgctggacgttttggtactgcaaagatttataatataccagcattgcgctcagactcacaatatactacttctttagaattttatcttaagtcaggcacctctgttgaggatttaaaaaaatgtaatattgctatcgaagcaactaatacaagtgggcaagtttattatagtgttatttatatgaataatataccgaagatggatgaatgggttgatttaacaagtacttttactacaaacacctatacagataatcttaccgactggaagtttagggtgtatgtccatccagatgtttccgcttctatgagaattagaaatagcattaagattgaaaaaggttcgacggctacagcatatcaacctaacttacttgatgacccttactggttgggtaaagttcctttgggtgagaatattgctaataaagatattcagttcccaatcaaaaccagtgaatatctcgcatatattgctagaatgatagaaccttttattgtaggagaaacttatacaatcaccataaaagcaacaaaacccgctagtcaaacatttatggtttataacagtggggaaggaactacttactatggaaacctaaaaccagttgagggattgacaaacgtatggtctctaacatttacaccaaataatgtttcgtcaagtaatcctagcgatttacgtatttttcaatatccatcatcaactaaaggcgatgttcaaattgactggttaaaaatcgaaaaaggtgacactagaactcctaacattgattcctatgcttatcgtggtacagttttaactacatccgaagaatcaccaaaagaccctaatgcgtatacatggtctagtatctaaataggaatagcagaataatatgctataatataaatagggcacgatgctgtgccctattttttaattgaatgctatattatctaatgaaaccatagaagaaaagaggttataaagtggctattgcaactaataattcccgagtgtatgcttcattacaacttaaaaataaaaaagatagcatgtacttagttatcggtaaaacctcaccttggacaaatgaagatgccccacctgctacagaccctaatacttcaacattacaagaagttgttggttacaaaaaagtaagtaaagcatctctatgtcgtgaatacgttgcagatgacgagaacaagtacccagtgattagctacggtactcgtaaatttactttaataccagatgaggatgcttataaagaaaaagcatggatggtatatatcgaatctgaaatcgtaggtgacgaattacctttaggtacatttagacaagtaggacttcacactgacctagtaccaaaaacaggtgtagataaagatgcgttactacctacagaagtaacaaatgcaggtattttacaattctttgaaaacagacaacaacaaaacagaactgccgatgtaacaatccgagaaaaatttatcgttacaatggaaaacggcaaaacattaaaagcgtaagagaggatgacaagcattggcaaaagaaattacaaatgatgatttaaagaaagcgccctaccttgaccgctttgaccctaacaagaatagaacacgagtgctattcaaaccggataaacctcttcaacaagcagaacttaatgaactacaagcaatgcaagattatgcgttatccaatgtagcagagtccgtgttcagtgatggggacatccaaacaggtatggagtatattcttcaaggaactacgcttactgttaaaaaaggtaaagtattccttggtggtaaaatgcgtaactttaacgagcaaagtattgagattaccggtacaggtactgagtatattggtgttaaacttgttcaaaaggtaattaccgcagaagatgacccaaccttgttagaccaaacaagtggcgttcctagccatttctcagaaggtgcagaccgtctagaggaaacagttgtactaggagtaaacgatgatgaagcttcaaacatttatcgttttgagaacggtcaattatatattaacccagatacaccagaaatggacaaaatcaataaagtattagcagaacgtacttatgatgaatccggttcttatcgtgtacgtggatttgatatgtatacagaagtacacccaacagaccctaataacaaaatccaattagttattgactctggacgtgcatatgtactaggttttaaagtagacaaacctacaactactcgtattgatattgataaatctcgtgatttagaaacaatcaataacgaaggtttctactacagtaacgaaactcgtttaaacaaactaggtaacgcacctgtatctagcgtagaccgtgtaacagcccaagtggaagttgcaaaagaacaagtgtctcgtggagttgttggtggaggtactgattaccttaaaaatacttcggtaacaaaagttgttcgtgtatggacggaaggttccggagcgcacgaatatagacagggagaagatttccaattagttaatggtcaagctatctcatgggcacctacagggcaagaaccacctgccggaggtacctactttgtacaatacgtttacaacaaaacaatgattgaaaacactgattataaagtaactgttaaaggtgaaggagataaccgtgaatggtatattgactttaacgaaatgacaggttctaaaccagtagacgaatcattagttaacgtagattacaaatacttcttagctcgtaaagacttaattgtgttagaccataacggaaactttactgttcataaaggacagcctaacgcaatgcgtttagtagattctcctaaccatattgacccattgacactgaatattggtacagtgcttgtttacccagattcgagcacggcagaagctaagcaatggacaatcactcggttaacgatggaagagctacaaaaattatctgtacgtgtagacaatatggaatacaaccaagcggtattctatcttgaccaacctgcgatggcaggagaaaacccaatctatttacgtggggtattctcagatgcgtttatctctcttgataaatacgatacaagtcatccagatgctacaattgcctttgactttgatacagcagaaatcacactgccttatgcagagattaataaaactgtaccatccattatcgaaggttctagtgaagcacatgtatggggacggttagtaactgcaccatttaccgaagaagtcggaattagacaaccatttgctacagaagcaatgaatgttaacccatacaatacgttcaataagcaaggtgttctaacactaaatcctagtgcagataactggattgaagaagaacgtatcactatcaccaaagaagaaacatctacaatgactattcgtcaatggtggagacacggtggagcttcttggacaaatgatgaaatgaaccttgtatctaacgtagacctagacaacggtatgaattggagcgacctaaaagacgactaccgtaagtctggattgtctggtactacactgtctagtggtggacaacaaacaaaagagtctatgattgagttcatgagacaaattgacgttgaaatctacgctgagaacttagagccaaatgcaaacaacttagttgtgtcatttgatggactacgtgtccctgtaacaccatcttctggttaccgtaaaggttcacaagagggtactggtatggcaaatgctgatggtacgttcaaaggtgtattcaagattcctgcgggtgtacgctgtggtactcgtgaagtatctattcgaaatgatacgaacttagcaagtacaacgttcactgcacaaggaacaatgaaaactactgaggacatcatcatccgtactcacgtaacaattaacctagttgacccgttggcacaatcattcagcttcaataccaaccgtattgctacaagcttcgatgtgttcttcgcttctaaggatagcagtacaaacattatctgtcaagtacgtggtatctcagaaggtggtcaaccaaacaaaacggtttatgcagaacgtgtattaaaaccttctgaaatcaatgtatctgacgatgctagtgtagcaactaagattacatttgatgacccattgatgtgtaaagcaggtcaagaatactgtttagtgttcattactgactctgataaatacacaatgtggattgctacaatgggacaaaacagaattgatgacccaacgcaaagtgtgaactctaacccttacttagaaggtgtgctttacagttcatctaatgcgagtgcatggtctattcaccaaatgtctgacttgaaatttactgtttacacagctaaatttaacgaagaagctgtcttggagttcgatgtaatgagaaacatcaacgtagaccgtgtggttcttatgtccacatatttaactcctgcgaatacaggatgtaaatgggacatgaagattgttcttaacaatgaaccttccggaacaaccgtcaacgacaaaccttgggttccaattgcgaactatgtagacttagatgttaaccagattgctcgtgaggttaaacttcgtgcaacgtttaaagcaaaccaatatatttctccaatgcttgcattagacgatattatgtttgccggtttcttaactgccttgaagggtagctacgtatctcgtacaattgatttatccgaggctccatacaacactgttaagatgtcttacgaacagtttactcctgccggaaccactgttgttgcaaaatacagtactgacgaaggtaaaacatggaagacattcactactcagcctacaacaacacaacgtacgcaagatttcgttcgtgtagactacgttgagaagattaatacgggtggaacatttaaatccattaagttccgtcttgacatgtcaacccagaactcattcctccgcccgagggtgagacgcttaatgacgaatatgaccgacaaatagaagatgtaactgtaatgtaacatttctatgcctcttactgtggtatacttattgtatacgaaatagtaggaggttttttaatggttaaagcattacaattagcaggtactacatttggtaaatggtacgtaaaagaacgagatacttctaaaaaaggtagagcatactggatttgtgaatgctcttgtggaagaacagttcaatctattccgagcggtactcttactacaggctcatctgtgatgtgtaaacaatgtgcaaatgagaaatctttagtgggtaagacttttggtaggttgaccgtcattaaggattcaggtgaacgagcaactaatggtagtatcctttgggagtgtaaatgttcctgtgggaagacaagccttgtcaggggttcagagttgacagggggtcgcacaaagagttgtggttgttactccacggatgtactcaaaaaagtagccactaagcatggattgtctaaagtgaacggaaaacccacaaaattattccgggcatgggcttcgatgaaacaacggtgttacaacaagaaccatgcgagttataaggattacggtggaagaggtataaccatatgttctgaatggcgtgaagactttgaagcttttcataattgggctatgactaacggattttccgatgacttgtctattgatagaattgacaatgacaaaggctattcaccagataactgtcgatgggtagatgctaaaacccagattcgaaatagacgaaatacagttacttatgagtggcaaggaaaagagtatactcgagctgagttaagtaggttgacaggtataaatgagcaaaccattgcttcaagattgaacaaaggtttttcccttgaagaagccctttcttcaaaaataggcacttctgtattacttatgacctataaaggggagactaaacctgtcaaacaatggtgtaaagaactaggattgaactatgcaactgtacgtaacagacattataagggttggactgatgaagaagctttgactggtatacgtaataaatagtcaaccaagttgaatagcctctatatgctatactaggcatataggggttattttttatgtaaaggagacttattgatatgccagaatcatttagacaaaaatcatcaggagctttaatttttagacctacagtttctgagaaaatccattctaaccagatgaaagctcttgctaaagataaagagaaattgaacagagacatacaagaggttaataatttaaaacaagaattgactaaggaattagaagaaattagagaattaaaaaacaagttaaaaggataaaatgtcctattttaattttttgacctccttatatatttaatattatatatttaactatttatctaagttataagtatttatatattatatatttatatataagggaaccaaaaatggaaaataggacattgacatacacttacagtactggtacaatagtattgtaaggtgtgagacattattaggaggacttatgagactagtaatagatgtaatgcacactcagattagatttgatgaaaacgaaggtagtcttcgtagcactatacatagagtaatgcacgaagaacttggagtaaaagcagatggctatcaatttagtcctgcatataaatcaggttactgggatggtattattgatttttataataaagacaacgatacatttcctacaggtctagtacctaaagtagaggaaatcctaggaagactacaaactgctatgggtagtagaggttacatgtttcaatttgagattattgatgacagacctgacaaattcatggaagttgaagaaatggactcagaaattaaattgaatggtgacaatggagaaataattactctacgtgactatcaatatgattctgtaaaaagtattattgagaagcaaacaggtattatcaatgttgctactaatggtggtaaaacagagattgcttctggtttaatacagcaaatcctacctgctttagaatcgggagaaaggattgcattctttacaaacagctcctctatcttcactcaatctatcgaccgtattgaaaaacgattaggcattaaagtaggtgcctttggagcaggtaaaaaggatattcaacaagttacatttgtgatgattccaacaattacctctgctatttcagcagacccagaagctaaacttaaacttacaccgaaagagcgtatgtacaaaaagttagctaaagagattgctcctaagttccttacaggatttaatcaaaaaggactacttgaaggttacatccgtaacttccaagtgaaaacaaaagctgatttacagttgaaacatgaattggaagaggcttactacagttgtggaaccaacaaacaggtagtgatgaaaatgcgtagttatcaagctgagtatgaaaaggtagtcgagaaaaagaacgggaaggtcttgaagaaatacaacgaagcaaaagagtttttagaatctgttgctgttatgattgtagatgaggcacaccatactagttctgatacttggtaccaagcactaactgcttgttctaatgctcagtatcgtatggctttaacaggttctattgacatgaaaaaccatgtgttatggcaaagaatgcaagccatttttggttccattactaccaaggtatcaaatgacaccttaatcagtttaggtcactctgcaaaacctaaaattaccattttcccaattattgcccctacagacatcgaaaactccaattacatggatgcttacaagatggggatagtggacaatgtatacagaaactctttgattgctaaacttacaaagaaaatgtatgagagtggcagtggtgtactggtaattattaatcgtattgaacacggggaaacgattagtgagttattagatgcagaaggtgtaccacattacttcattcacggggagcttgataatgacttacgtgatgaaaagttacaagaaatgcgtgacggacatttgaaggtgatgatttcctcaacaattattgatgagggggttgacatctccggtattgataccttaatattaggtgcaggtggtaagtccttacgtcaaaccttgcaacgggtaggtcgtggcttacgtaagaaaaagacaggtgaaaacaaggtatctgtttttgatttttacgacttgacaaataaacacttgaagaaacattcggaagagagaagaaaaatctatgagaaagaacaatttgagattgttgacatccctcttccaacgaaataaacgaggaggtacaagatgacaagtcaatgcttaacaaatgaaattcgagcacaatatagtctaggcaacggaattgttgagttcgttgaaagattagctaaaaaagcacagcaatggggagaaacatttgctacccctatacgtaaaacaactgtagctgaggagatgggacgtgacacacgtactgttactcggtatctaggacaacttgaagagttgggtcttgttagtacagaagcaaaacgtggtagaaatggaggaactgttgtcgtgtttaatactgatattttaaattttgaaccaactgataacccgattacttcggagacaaaggaagctaaggagattcgtgaacgtgtcttcccaaaagcaccaactccgaaacctaaaagacggtaccgtacaaaattagagattgcagaagctcgcattttagaacaaaagcaaaaaagctttgaagaacgcttaaacgacttacttgaacgtaccttcttggatagagacttttttgataatttcgaagaacctcgtttgtatttccaagggtatttaattgcacaaatgtacaatgcttatgcagttattttcccaaagaatagacacgagttctttaaagatattgatgtgaaaaaatcagaggaaggtttacgtagtatgaacaaagctaaatcatacaacgtgttacctgctcgttttgtaggaaccccacagtacaacaaatttgttgaagtagctagatactgtaatgagaataatattaacccattatcttatctaactgttcaatttgagcgtgcggagcatttagccgacattggtaaagctcgtgtaggggctattccttatgtaaacactttactgtgtgaagaagctcgtaaagcttattctgacaatgtaatgttttatcgtaaaatgcgtaatagctttaacttattcggtatgagtagtagttctgttccgtataaaggggctaaatatgagattattgtagctctacgtactgcgtacgaactagatagaacaacaagagatacgtttaactacttattagatgaattagttagtggtgcacaacaatcagtgaaacaagcaactttgttaggttattacaatactactttaaatgctttatcagaaagtgagttagtagacgaagaccaacaattaattagagatttcttaaaagagcaagtattgttatattcacgtaagaactcattgagcagtactatctatgctttagctttcccattacaaattaacgctgttaattcagttgcgaccctaaaaggtcttgacaaagagatgtattacacttatattggtaacatgtacaaggttacagatgttaacgatgatgaatacaacagtttcacggaacgtggtcgaacaattgatttctcttacaatgctaatgatactttctttagtacaatgcgattaattgcagattgtaagggtctaggagttccggcaggtaaactaggaagcgccttacaaaaattcggtgaagaaaaagttccgttagatacttttggtatgttagatattgaacgtatctacgataaattgattgattcagatgagttagccaaagaccgatatattcaagacaaagatgcaaccatgatgagtatggttgtaactgacgaggggtagggagaaaagcagaatgagtcaaattcacaaacaaaccatttataaagccattagtgaacctttgttcgcaaaggatgtttttagtcgattaccaattgaagattttaaagaggatggatacgacatgattgtatccaccttaaatctttattatcgtacacatgatgctccactagaggaacaaacgttgttaactcttgtggaagacaaaatgttgaaacaaaataaaagtttagaagcacagcaagttgcttttaacttagtaagtgacctttataaattagaggaagcagaaacagattcagaagcaatcagtgaaagtgttcagaattacgtacgtaagaccttaacacgtgaagctatcatggaagctgtaacgaatgatggagcattaggttctgaccaaaacattcagagccttatggagtctttgcgtggaatcatgacaatcgacacaggcggacatggagcagaacttttagatttctttgctgatattgataagaaaaaagaacatctacgtaatttacaacaaaacaaatatccaacaggttttatggctattgatgctatctctgatggtggtttagcccgtggtgaggttggtatggttattgcacctacaggtggtggtaaaactacttgggcagtaaaccaagctagaaattatgttgtacgaggtttaaacgtattgtacgttcctctggaagaaaaaattgaccgtatgattgttcgttttgagcaacttctatctcaacaaagtaagaacagtatcctagttgatggggagttaaacgaacagttatatgaacaaattcaacaagcctatggtgcatgtaaagaacaattaaactgggggaacttatggattcgtaagtacaaaccacaagaattaactcccagtggtttgtcccaattgatttctgatgtaatgattcgtaaaggacaacaaattgacgtagttatcattgattatcctgatttgatgaagaatccccattcaagtggtggtaacggagagtcggatgcgggcggtaaactatatgaagatattcgttcaattgcccaagaatatgattttgtttgttggactctatctcagttgaaccgtgctagttatggtcaagaagtgaagaatgccggagcaattgagggttcaaaacgtaaaatgaatgcggtagaattaatcttcacacttaaccaaacaccagaagagttccaaagtgggtttattcgtgcttacgtagacaagttacgtaataacagtggtgtagcttatgataaaatgttgtactttaaagttattccggaaacaatgacaattcgtgatgagacccaagaagaacgaatggctcatgcgaacttgttagaacaaacaatggaagtagctagggataactacaagaaggaaaacaattttacaccaaaggatgcccaaagtaaaattaacaatttaaacgcacagctagcgggaggtctaaaataatgaaacacattattaacttttctgattttcatatgcacttttttaaggacttctctaagccagatgctatttatgggactgaccgagcaaaagaacaaataaaggttcttgaagaattaatgaattacgctcgtgaggttaaaggagacgttttatttaatggagacctgtttcataagcgagtttctattgatgtcagaatattcaatatgatgttcgaggtatttagttcatatccagatgtaccaatcattatggttagtggtaaccacgataaggtaacgaatgctctagcctctgacagcgccctagaagcgtttaacgctttacccaatgtaactgtcatctctacaatggaaaagcttgtacgggacgaatacacgctctatggagtaagctacggggaagaagtagatgaaatgaaggaatggattgcagaggaagctaaaaagctagaccctaacacaatcaatattctttgtgctcatatcggtgttgatggttcttctactggacagtattctcatacacttagtggggctttcaaggtagctgacttatatcctgataattttgatattgttacgcttggtcactatcataaacgacaattcttaggtggactatctaatgtattttatgtaggtaacaccttacagacctcttttgctgatgaaggtcaagctaaaggctttatggatattaccttagatggtaaagaatggagtatggaatttgtcaaagcaaactataccccatttatgactgtaacagcagatacagtaccagaagacttaagtggagcatttattcagtttgttggtaacgttactgaaaccgaagctgttaaaaagcttaaagaagacaatgacttgtctaacttacgaattaaagtgcagaaggactattatgtacctccacgtattgagattacagcaggttctaccccagaagaagttgtacgagcattcactgataagaaataccctgacttacaggataaggctttagaatgtttacgtatagctacggaggtgtagaattgaaaacaaccttagaacgtaatagacaagaacatattgattatatactcaatgtaaacaaagaagttggtattatgcaagatgacccattcgttttatcttatttaaactctatttctctagacgaattatacgaattgagtgaacttgctgaacaaatgtataaagaatacaccgaagttaaacttttagataaagcacttaaagagatagaagaaattggtgtaactgcttttaaagaaaaacatggaatttaacaagattttaagcccagaacattctgggcttttttggcatacacccttgacatgtaagtgcttgtaatgtatacttatgttagtaacagacatacacttacaggaggtaaaaatgttaaagtttaaacgtgtaagcgcaaagaactatctctctattggagaagtatctatcgacttagataatcgaggtcttgtcttaatcgagggaattaatgacacgaacgaaacgtttcagagtaacggttcaggtaaaagtacgttgctttcaactgtcacttatgcactatatggcactacacctagtggtttaaaagcggatgctgtaattaacagacaggtaaaaaagaacatgtctgttattttagagtttgaaaaagacggcattccatacagaattgaacgttatcgtaaacatagtaaatttaaaaatacaacgaagttatttcagggagatactgatttaacacaaaaatctgtagctgatacagacaaaaaaatcttagacattttcgggattgactaccttacatatgcaaatagcatcatgtatggacaaggaaacgtagaaatatttgctactgccacagataaaggtaagaagcagatattagaaaatctggctgatattggtgtataccgatatgcacaggatgtagcaaaagaaaaagaaaaagaagctaatgccttagtagaagaacttggtagacaacatatgaccaaggtagctgaaatcgaaacattaaaacaggtttattctagtgcattagagcaatatgctaatacagaaagaatgattgttgctcggaaacaagagtatgaagaagccagagtaaaatacaccgaggcagaagacatgctcactcaaatggaacaagaagtaacaccaaagattgaacaactaactaaagagttggaagcttgtgcagttccagaagatagctttgcaatatcagaggaattgcgagaacagcaggctaacctgtttaagttaaatcaagcaaaaactactacacaacaagctattaataaagcacaagtagatttgagtaacactgagcaagctacaaattgtcagttatgtggtgcacctttagatgcggaacatcggcaaaaagagatgttacgattgcaacaagaaattcaggagaaacaagctttcattacacaattggattcagcaattgttgcttactctgatttggaacagaaagctaaagaaaaacaggcaagggtacagcaagaagttaacgaagttgttacaaaacaacgcaatatacagtcagctattaatgaactaaacaatcgtttacgtacggctgaaaatgctgtagcacttacacggaacaatgtaactaatctatcaggagccttagctcacttagagggcattccgaaaccagaatatgacacggaagcggaagctcgtattaaagcagaaatggaagacattactaaacgaaaagaattagcagaacaagaagcaagacaataccatattttagcactagaagtcttctcaaataaagggattcgttcggaggtattagacctagtaacaccattcttaaatgaacgagctaatcactatttgtctactttatccggttctgatattgaaattagatttagtacacagacagaaaatgcagacggaagtctaaaagataaatttgatttagaggtaattaacggttctggtggagacacctaccaagcaaactctgagggtgagaaaaagagaattgacctagctatttcttttgccatccaagacttggtacaatcaaaagcaaacattgctgtgaacctaggcttatacgatgaatgttttgatggcttagattctatcggttgtgaaaatgtgattaagattttgaaagaaagacagaaaaacattagcagtatctttgttattacacataatgacaatctcaaaccattgttcgaaaatgtagttactatgcaaaaaacagaaggaaactccttcttagttgaaaagaagtaaggatggtaattacatgaaattatattcagtagataaagggcgtaaccttggaacggtactcgtcccaacaaatgtaggatacacacaacgtttagacttcccgcttgacacattgtttgattggtacccatgttgcccaagatatgattacaagtacagtgatacacgagataagatgtacattgtaatgattgaggaaaatgaaaagcttccgttacgttacaatgttccgtctacaaaaaaacgtgttaagtcaaaaacagcttgctttattacagatacttggtataatcaagaagtagctaatgacaacaagaagttatttagctttgctgaaaactatgacattgtaactcctaacaaagagaattatactctggaagacataaacaagagtattgaacgtgtacaggacattttagacatgctgtatacagttcaagaaaaacaagtagaaaaagacttgattgttcgagttggcactttggaaaaagaagctcctgattcagaagaattgaaggcagtgcatcaggaaattaaagaatacatgcagttagaccgagagggaaaagcttcacatgtattaagcttattgccccaacatgccgaagagttatatgcaaactttggagaagtttacacaatgttaaatctaatgaagaaagtagtgtaggaaatgttctcagaccttctaacaaatgaactaggcataccaaaagacattgaacacgaattgcgatataactgtccgttctgtgaaccaaaccatgactataaactatatgtcaaggttagtgatgatagtacgaatggattgtggatttgttttaagtgtggtcgtaaaggtaaccctatatcgtttgtaatggaatactttggtgtctcttttgaagaagcattagagattctagagggttatggttacagattccagaataagaactacattccaaaagatgattcattaacggatgaagagtacttattgttactacttgatactgtagggaaacctaagacggtagaggaggaagaagaagaaaaactcacgccccctcctttaccacaaggattccaactattatctcaaaatctatacaatccggaagcatacccatttttagtttattgtcataaacgaggttttactttaaatgacattatccgacacaatattgggtatgtactagacagcacagtcaatcttccatcaggaagacagattaggttgaagaaccatttagtatttcttacacatggtgacgatggacagtatcagtattggaatacacgtgcgattgctgatagttatataaagtcctttaatgcacctagtaaggacggagagtactccaagaagaatactatattcaatcttaacattgcatgtaaaactccacaagtagtcattactgagggagttcctgatgcactaactttaggagaatctggtgtaggtacatttggtaaacaggttacagatgcgcagattaatttaatacttaagagtgttgctcctgagcaaccaatttatgtgtatctagataaggatgcaaagaatgagataaaaaaacttgcagagcgtttgtatgaacgacataaagaaacttatattgttataagccctacagacaaagacccgaacagtattggtaaagagagtgcttgggaaattattaagaaccattctgtaaaggcagacggtgtaggtataatcaaattgatgttataggaggtacgtatgagtaacattaagtatgaagtacattgggtgcatcaccaattaggggtagataaaacacatggtgtatttggaacactagataaagctattgagtccatctatgattggtggacacagaatgactacaatccaccatatgttcgtatgtggacagtagatggtgtaactacattggactatgggtttcaccacatgttttataaaatcaaagaaataaaggagactaatgaattgaatccagtagttaagtttactaagagtgagggagccattgccccaaaacgaggacgagaagctgatgtagcacacgacttgtttacagacaaggatgctgtaattttaccgggaagactgggagcaacagtagttactacaggaattagaacagcttttgaccctaatttatatggtctgtttatcaacccacgtggtggcatgatgaaatacccattaactctaggtaatacacaaggtgttgttgaaggagaataccgtggggatgttgggcttcctcttaagaatactttctctttacaattcggagaatatactaacgctactcgtgttttagttattaccgaagacggtaagcttgtaggaaaaccagttaaagaagtacgtgaaagctatccagaatttgataagctttatgaagaacagctaactaaactaggtaatgagctagatttaatctatgacaatatatttactggtgtttctgaaacccatgttgttgcaggaactatctttattccaaaaggtactcgtttatgtcaagcattcttgcttccacgttacgctactaattttgttgaagtagacgaattagacgaaacagaacgtggtgaaggtgcatatggttcgtctggtgttaaataatggctagtcgtataccggatttaaagatgccacttctttatcttgtaggaagtgcttctattggtactcgtgagcgtggctgtgatgtaacagttaccttacgagacttttatgtagacacccctgatgacaagttagagcaactaataactttgacgtacaaagaagacaaaattgaaaattttacacgacttagtgcagataaatgttcatttcgtgttatactaggagagtaggcaatgaaagaatcaccaagtgtaaaacttacagaaactcatacagttactcttgtaaacactgacgtacttaaaataggacaggttattggctttagagttaacagtcctaagcaagtaggtgcagaagtagtagatgtttattccgaagctgtcggggttattgaacgtatctggtcagaacgaattgaggtcttaaacctgattacaggtggtcgtacagacctatgggcaaatacgttcgattggagagaaattgaaatactgtcagatgcggaacatctgttggaggcatataagaatggaatttgctgagtatttcaataaaatgcaagagcactatgcaaaaggtgaaactgttgaggtagaaaagcttgttaaaagcgatggttcaaaactagttacctatgctgagtttgaggatgctttagctactgtagcacaggttaccacacttgctattgaagaagcattccaagcacaggaagctaagtttggtcttgtactaaaaacattaagagaacaaaaagttatctcagaagatactgaaaaagctattcttgctgagtttaataatataaatgaacttatggaggacgacattaatgagtaaaaaagcaaaacgtgtaggatttatttctgaggaagatatgagaacatggacagagtatttagctacaggacatgttcatgataaaaaccatgcaaaacagttagaacgtttaagtaaacgtgatattagcttaggggacgtagctactgtcgtagatttcatgtcaagacgtaatgatggttatatcactgctctaatcgaacaaaactctgttaatgaaaaattacttaataaattgggtgtaacagatgaaatgcgtaatgaagcgaaagccgaatacgaagttgaattgaaacaagcacaggaagaaattaaaaagttacaagaagagctagctgaaaaactacaaaagggtgagtaatatgagcacacatgaggaattacgtgaacttggtttagttgacgaacaaggtagcttaaagatagaagctagaaaaacaatggaaattccgttacaagctttagccgatttattaaacgataaggtatccagtgattctggggtatacgtaagcgactgctttcaaagtgttatgattcgagaggaaagaccttatcgagtagttaaggggttgcatgatattcctacgttggtattttcgggaacagtttacccattggatagactaacctgttatccagacattcataatattaattatcaggatgtaagtttatttaaacctgttaaagaggagcatgtagaccaaataattttcatggtacaaaacctttataatttgaacaatagaaacaacaatttgtatatgcagtttaagagataccaatgtggaaaagttacctatgaagaaataatgaacacacttaagtctaatatggagttctggtctgtacctaattatgtagaatcattagttgaagagtattatgtgaacccacatctattcgatgttaaaacacctgtagaacaactaattgaacaagtagaacttattgagtctagacgtaaacgtgttaaagaaagggatgacgagagtacccatgactgattacagtgcagtaggaagaaagtcaaagtctaaaggtgctcggtttgaactagaaacagctaaaaatttatctaagtggtggggacatgactttcaccgtgtccccgcttctggtggcttacattggaaagggagtaacaatgttgttggagatattgtagctcctatagaggcaggatttccttttgttgttgaatgtaaaaaccgtgaagaatggactatagagaacttatttctcaataataaagaaataaaaaattggtgggcacaggttgttggtgatgctaaagaatctggtaagattcctatgcttatctttacccgtaatcgtgctaaaacttttgtgatgatggcttacaacgaagacctcatcaaagaaatcgaagaccgtggttatcctcttatggtctctaatgtagagtatgtagacgggtataaagatacccattgttataagacatttactactgtgttagaagctattacaagctttaaacctcgtaagagccaaggggaagaacatctactccattattttaacccaaaagagtatgattggcaaaaatctggtcttgtccgagaaacaaaaaagatggaagaagcaaaacaacttgatgttgaggagtctttggacttacttgttaattcctatttagaaggagaaaaataatggcagaaagaaactttccagaagctattaaaacttactattcttacttacgtgttcctgatttaaaagaacaagtatccagtatctctattgattttgtagagaactggacaggtcaagaagaacggtatgtacttgatacgctcacttctgaaattaagcctcgtttatacagcttagaaacagcgtatatcattgagggcttttcactaccggaaaaagaagttgacgtaaacgtagatgaattgagtaaagaagtagccgagttctttaaaaaagcatctacagacttgaaagaagcaattgaggcatctaatgacaatcaaccaagtcattcagaagatactgaaccgattaacgattgaccaattagaagtcactcctgcgatggtagacgttgttctcgaatatctacccgcaggattgcttttaacagccaataacgagggttgggatgcggtagagcctgacctgcaagaagtggttatttccaatttggaaaaaatgagaggagcatctaaatgattgaatcaagtaatgtaaatcatccaaaacactatacacagggaggtacagaagtaattgacgttattgaatacctaacttctaagtatcccccatcaatccgttactcattaggtaatgtgattaaatatgtttgtcgtgcaccgtacaaaggaaaagaggaagaagacttaaataagggtcattggtacttgaatcgcagtcaatcagatattactgcaagcgtaagtaaaactacgtgctctattcctacttttgacatggaagctttcatccaagatactgcaaaaggctatcgtgaagaacagcaaccattctttaaatccattatgtacatgttggatgatacagaaggaactcctgtgttccgaatactaaaccttgttgagcgtgaccttaaggctcttaaaattgcatagttactactaggtagtacagagttttactccttttgcttgtaaggcgttcctgtcagttatgttataatagagataggaaaactaaatagcaaaaggagtttaattatgagtagcacacctcgagtaaagcggttaaatatctataataccgaccgacactttaatataaacttaatgaaacgtgaagacattgcgaataaaattaaagtgaatcggttaaacgaaaaagaaattgagaaagagatggatgaactaagcgaagtatcggttgtcacaccagtgtggacaatgaacatgaagaatgaaaagtcctatctattataccaagaaaagtatacaaatgatacattgatacagaaattattcaaacatgcaggttctgtttcttattatacagatacaattgtaccttattatgttattgaacagattgctaaaaatctaacaagtgaagtaatttatccaacaaaacctaaatatgaaaatagagagattgaaaatattcagctagcatttacggcttgtcctgtaaccattgattgtccagtagttattccagatgttagtccttatgacgttttatttgctttacaccccttaaaaacaagtgtagacaaagtacaaatttcatttccgtggctgtcagaatcagaaatatctgatagacatagacgttattatcataaggttggagaccattatgaggttaaagcaaaatataaatatcaattctttaaatatgtccagacctcactatccatctgggctatgaacatttggattgtttgtgatagtgatgaggattttgccaatgtcgattactatgtacaaaaagaaaaaaataaaagaaacgtcaatagagaacgtgctctccaacgaaaggagaagtccgatgagtaaagataaaacaatgaaccggactgatgttgcacgtgccatctctcaatatacaggttatcgtatgaaagacgtgttagctatcttacaaatggaagatgaggttatcacacaagcaatttcacaaggaatatcaattaaaaaccataaattatggaaattgaatattaagaaaaaacctgagaaggtcgcatgggatggcatttctaagaagacgtttattcaaccagaaaaatatgtagttaagtttgtgccactttctaggttgaaagaagctatagatacttacaatgaagagaatgattagtcattctctttttttttgcccttgacataccttacaaaaatgctatactgaaatagtagaattacagaaaggggaagagagcttgaaaatactgttcttacaagattatatcagagagacccatgtacataacagtcagaatggacaatatgtagactataaacgtactgacatgggtaaaaagcttacaagtttacttaacgacataggtttaacaggtcgtgattatataattgactacgattatgacctaattcctgaaccacagaaggtaaataataaaacaggtaaagttattaaatacaaggagcctgtattaaaacttcggaaagaacctgaaaaacgtttattaaaacgattaatgaaaacaaaaccagacatcattattcctatgggaggaatgggatgtaagaacttattgaatagtacttctattacgaaagcacgtggtgttcctgtacaaaaaacaattactgatgaagaaacaggagagttttttgatacatggattttaccaatgtttagtatggaatacttgtcaatgaatcctaatattgagaacttggtaaaagcagacatttctactttatctcgttttattgcagagggtgcacaagcatttgagccaaagaaagttgagtatgagcttgttatgacaattgaacgagtgaaacaaatctttgagttcttgtctcggtttaaacctcttactgcatgggacttggaaacaaatagtctacgtggagatgtattaggtgcgaaaccactagttatgtctcttagttgggaagagggtcagggtgttacgattcccttagaacatcatgaatccccttggaatgaagaagaactagctattgtatacaatcatttacaagcttttgtagctgatgcacagcaaccaaaggtaggacacaatattcagtttgatattcgtttcttaatgaacacaaaagggtttgcttattttgagaataaccgtgatacactgattgggtattacttaatcgtagcacagaaaattgaaagctctaaacgtttgtcagaccttgcttatgaactaactgatatgggcggttatgataacccattagaagattataagaagaaatacaaggaagactacattgctcgtaagaaagctgaaattgatgagttaaaagcttctgagaaagcacgtgtagagaaggagtataaactagcacaggctaaatacaaagaagaagtggcaaaagctaagaaattaggtaagtctaccaaatcaattttgaaacctgtaaaagaaaaagtagttgttccttctaagacagaagttaaaactgtgaatgaaattgatggtggagactttaactatgattggattccattagaaattatgcacccatacgcaagtggagatacagattgttgcttacgtatttataacgtactataccaacgaattgctcctcatgaaaagattctagctctttggacagacttctatcctaaacttacacggacacttgctcatctagaagcagaaggtatcttcgttgataaagaatatgcgaaagttcttgaaaaggtatatgcggaagaggaagaacgtcttatcgaagaattacgtaagttccctgctgttaaagagttagaagcagagcatatggcactttataaagcaggtctagaagaatggaagaaacccaagtcagaacgagacgaagaggttgctaaacttcgtgataaatataagatttctgataaggaaaacaaagttaagttcaatcccggctctgctgtccataaaggaaaagttctttataagattcttggactaacattaccttatgacaaagagtccattaaagaaaaaccttttgataatggtgttcctgaaaacgagctaacttgggaagactataagacagataaacatgctttgggctatatcgcagagcacgatgaagatgcaaaagaattagcagaaatgctactagaatactctaaagtaaacaccttgaagaacaactttgctcagaaacttccgttactagcttcaaacaaagatggaaaagtacatggttcgtttaagattactggtacagaaacaagccgtttatcttctaaagaacctaatatgcaacaagtaccatctaaagttggagaccctaaacgttttgactatacgtacccaattaagcgtatgtttaaaacaagctttgaaaacggagctttattacagctcgactactcagccctagaaatgcgtattctagctttagtagccggagacgaagcgatgacccaagctttcttagatggagaggacttacacaaatcaaccgcttctattgtttggaaagtacctgtatcagaagtatctaaggatatgcgtaagaacgctaagagtgttaactttggtattgcttatggtgaaacacctttctctattgctcctaaattaggtgtaacaccagaagaagccgaacgtatctttgaagactactttgcaaacaaaccacgtattaaatcctttattgatgaaacacatgagtttgttaaagaaaacgggtatgtagataccttacaaggacaccgtagattgattcgtgatgcgttctctaaagaccgtaatacattcaatggtgctttacgtaagtcagtaaatacgattattcaaggaactggtgcatacttaacaaacatgtctctggtgtatattgacgattatctaagaactaaaggtatgaagtctcgtattgctattacagtacatgactccattgtaattgattgtcctcgtgaagaagtagacgaagtagcaaaagtagcttgttttatcatggaaaacctaccaattgatttcttaacaattaattggaaaggagaacaaatgagatttcctattgtagctgatgtagaaatcggagaaaactacaatgacatggttgactatgatgcagaagaagtgaacaaatttgcttcttataaaggatacgttaagtattacaaagaccaagctaaatttgaagactataagaacgcaggtatgattagtgaggaacaaatggaagccggtattaatgctgttaaagcttgcatagaacagtacaaactaattgcgtaagtcttacaaatttatttaaaaaaaattacaaaatgacgttgccctaacatgtaatgtgtgctataataatagagcagacaagttagggaatgtctgtaatattggaaaggagaataagacagtgtgctagacttacgagtgaacgaccttgaatttcgtaagatacgagttaccgatgaaaacggtgaaactattgtgtttgaccttacagaggaactacaggtaaacgagtttagtgttcggcaagcgttcttagaacagcctgcgaaatacacgtattggacttctttacttgaacgcttacgaatgtaccaagaaaactacgagttacaagctgagaagcgtaaagcagaactgtatgaaccttctagaaagtctttgattgagcaaggggtaactaagccaacaaaagaccaaatagaagcacagattatgcttgacgaacagtattatgctctgagacagaacataattagtttaacatttaatgttagacaagtgcaatatgtagtaaaagcctttgaacaaaggaaagacatgttgattcagtatggtgcagacttacggagggatttcgagtatagccagaaagtgtctatgccagacccactaaaaggtcaaaggacaagttataacaatccatataacacataaccttagaacctagttgaacaacacataattcgagaaaccaaaataaaaaaacaaaagaatggagaaattaacgtgaactttcaagaacaattaaaacaacaacttgcccaacaaaaccgaggagaacgtgccgaggtagactatccttccaatcatcttaaacacaaagagctgtttattccaaaagaaactaatcaagtattagttcgtatcttacctcctagtgtttctggtgaaaactataaccaaatggttcgtgaaatcttcttacaagcacataaccgtaacggtaaagaactaaaattaaatgctgtcttatctgcattccctaacgtagaagacccattagaccaagcacttattaactggaatgcacaaaaccgtgttcctaacaaatggaacaaaaatgcaactccaactaagaagtatcttgctaatgttatccaattaattagagacccacaaacaggtcaattccgatatgaaacggatgaacaaggaaacttgatggtacgcctattcaagttatctcattcagcttgccaagctattaatgctaagttaactgatactatgttaacaccaaactttaacccagatgttcctgattctgttaaacaatacagcttcatttcatctgcggaagcattcccagtaatgattagcaaacccgctaaaggttctggtcaaatgtcttacggtgttgatgtttatagcaacatgcctctaggagctttaccacaaggatgggaaactcaactagaagacttagcttatcaagctacaccttcatacagctacaataaagagtacattgattactttattgatgtagtaaacggtgttgaacctgtgagccaagcacaaggtggacaacaagtacaaccacaacaaggttaccaagctcctgcaatgggacaaggctttgcttctgctccacaacaacctgcttacaacatggcacaaccacagcaaccaatgaatactggttttaaccaacaacctgtagctccggttcaatcacaagctacaaacatgggtactccttcatttggtcaaacaaatatgggaacagcccctacaatgaacggtggatttgcgcaagcaccacaacaacctgtacaacctgctccaattgcagaccctatgggttttcaaatgccaatgaatcaagcaccagtaactgacccatctactatttcagatgctgatatgccttttaacatgcaagcaatgccagatgtaacaccgcaagcaacaagtgttcctgagcaaccagtagttgcaactcctgaaccaccacaacaagctcctgtagcacctgtagaaacagctacaaatactactttaccagatgttgatagcttgctacaacaaatgcaaggttagtaatagaggaacagggggctgaaatagccccttcttctatttaaatttgatatgtaattcattactaggaggaacaaatcttggcaagaaaaagacaaagtgaaacagtagaagcaggtacaattgatttaacaaaagaattgggcttaacttcttttagagatacaaaattttctagtgtagctgaccgactacctacaatgattcctcaattagactacatcttaggtggaggacttccatttggacgtatggtagaggttatcggaaagaactctagtggtaaatctacttttgcagtacaccttactaaaattgctcaactattgaaggtgccaacattgtggattgacgtagagggaactgctgaccctgaccgtttagctgaactgggagtaaaccctgatgcaggggatgtattcatggtagagcctgctttgaaaaaagacggtactaaggatacaatgacagtagaacgggtagcagaagaactacaacgtatcttaccagtaattaacaagacaggtaaacctattttaattatctgggattccgtagcacagaccgccgctgaaaaagaaattgaacgtggtgtaggtaatcaacaaccgggtattaaagctaaagcaatggcacaattctcacaaatcattgcacctttaatgactaattcgaaagcattatttgttgcaattaaccaagctcgtgatgagatgggtagtatgttcggaggtattgattctccgggaggacatgcacttcaccactgggctagcttacgactagaagttcaaaaagcaagtaagattgaaaatagtgaagtaaacgcctttggtgtagaagagaagtcctatatcggacatatcatgcgtattaaaacgttaaaatctaaagtatccagaccacagcaaaaagctgaaatgtatctaatggctgattctggtttagaccttgaagaaaacatctaccgtgcatgtttcgcaactaataagcaatatggattcattagcggtggtgcatggaaagcttacacaacagatgcaggtcaagaaatcaagtttaattctgaaaagaattgggtagacttcttgaaatcagaagaagggcaacctgtacgtgatgagctatttgctaaaatgatggctcgtagtttccctaatggatacgcaccttataaaaatgaagagattgatatttgtcaaataccattatataaatacgttaaagattacatggaaactcataaagaagaagcacaacctgtagaagagcaaacagctcctgtatctgcaacagatgtttcagacctattagaccaaattaagtaaggggcgttatgcccctttttataagagatggaggaaacctaattgcgtaaaactacaccagttaacaccgtactagaagccttagaaatgtttcaacaaggaacagcaactacagaggttcgtacgcctatttctttacaatctgtacgtaaacgtttcttagatgctaaagaagcaggaaaacgtgtattgattgaaaactctgatttaagtagtgcaaactctgttgttgttgatattgactatgtaggtagccgttggtgcttaggttatcaaaaagtattgtactttggagaagaggtacgcattcctcatactatccacttttgcgatgtatatggggcttatggcaacgaagcacaaagaagtaaacggcaagtgaaaatcatttttgaaggagagaacccttttgagtagagaccttaacaaagaggaacgtgagattagaaacggaaatcgtttcattactgaggttcacggtaagggggtctttccacgagatgttgatagactgtaccaccgttatgccaacttacgttacaaggtctataacactcataaagactcttttcgaagtgaagcctcacgaaaagaactaagaagttatattgatgaacagtttatcaagttaacgaaagaatatgatattaacggagaggtcgattttccgggatatatcaaaaaggctcttaatttaagagttagacatagctttgtgaaaggacgttttcgtgatagtgctcgtgaacgtctgggagcagaggacaacgagattgaaacattactgggaacagatacctcttctcaggaagcaattgaagatgctgaactaattgatgatttactatctaaagcgaagtttagccctgtagagttagccgtgttcagctatctactacgaggtaaagtaaaagatgctaatatcattaaagaggtgtcagcgaagtataaagtatctcaaaagtctgttagagatgcaatcaaaaacgtgcgggagtacgttgcgttaaatcttaaagaccgatagaattagttaaaatcctccttgtgtgtatgctatattagcagtagaaacacaaaggaggatttttgtaatggaagaacaaaacaacactggcaaatacgctccatttattcgactaattgtaatgggtatctccttcgtggctactggtttaacaactatgtttggttgggaaccactaccttttacagacgaacaaatgaaccaaggtttaatgcttgtactttctgttggacttgctatctataactggtacaagaacaacgctgttactaagtacggtaaagctaaagagcaagcaggtaaagaagtagtcggaactcgacaagacttcaaacaacaaggctaagtttgagggggtaaaacccctccttagttgatattaaaggagtatgacaatggaactaacaaatttaagtgctaaaacactacccgaattaaacgggaagtttcttgttgtagagactctatcagacggatacacaggaaccgtaaacggtcattataactatgaagttgttactaaaggtgaggactatgaaatctatcccacactttggaacaacgaaaaagcgcagtttgtaaaagctgacgaaatggttgtgtatacaaacggagatactgtattctatgtaacaagaacaacaaaagacccttataaccatgctgttatcagtgagttaatcgttgaagaaggaatggacaaggataagcgtacccttcaagctttccggctattcgcagacgatttattctctatcggaaactataacgtgttcttaacacaccaaattgatgtagtggacagcccaaataacgtaaaagttgaatcagtttccttagacaaagaatccggaacattatatgtgggtgacacagtagacttaacagcaactgtactaccagaaaatgctacagtcaaagacgtaacattctctgttgttccagaaggaattgctactgtaactgctactggtgccaaggcaacagttacagctaaagtaaaaggttcagctaatgttatcgtaactacattagatggagacaaaacagctcaatatgctttaacagtgaaagaacacgtttcagtttctggtattactttaaataaagaagctacttcaattgttaaaggtgctacagaaacacttgttgcaacagtaacaccaccagatgcagaaaacaaagctgtaacatgggcatctgataaacctgccgtagctaaagtagaccaaaacgggaaggtcacagcagtagacggtggtacagctaacattactgcaacaacagttgatggtaagaaagtagcaacttgtgttgttacggtaactgtgcctgtaacaggcgttacactagatacgaatgctattactttagaaattgacggtacacaaaaattagtagcaacagttgctcctgctaatgcaacaaacaaaaaagtaacatggaaatccgataaaccggaaattgctactgtagaccaagaaggtacagtgacaggtgttgcagacggtacagctaacgtaacagcagaaacagaagatggtaagaaagtagctacttgtgctgtaacagttaaccctgcgcaagcataatatactaggaaaagaggaatactaaaatggctaaagaaatcgcaaatattgcagacttattaaaaccaagcgtaaaaactgtcgaactagacggtaaatatcttgtagtacctaccctatcagatgggtatacaggtacagtacagggggcttacgcttatgaagtgaagaaatcaggaacagactacaaagtgagtgaacttatctatgataaagacaagaacacgtttactcctgcggatgctccaattatcatgacagatgatgatacaattttcttcgttactcgtacattgattgacccttacaactacccagtaattagtgaggctacagttaaggctcatgaaattaaagaaaaacaagtacttcaagcatttattgcttttgcagaagacagattcaaactaggggtatacaacgtattcttagcagatgacccttatatcttgcaagataaagcagaagactagtttgttctagtacaaaaaaactgtacaaaatttaaataaagtgttgacgacttacacctctcttggtatacttagactatactaaataagagaggtgttttattgtggttaaagctaaaaatcctgtacaaagacgtagaggaacttacaatagttgtgatgtgttagttgaagaagagaacggtttcttttactatagtgtacttaactcagatggtaaagaaatcataggtggctttagggataaaggctcccaagacatatctacattttacaactacttgcttaagttagtagatgactacgttaaatgtccagagggttttgttgaagatgtttaaacgtaagaaatactatgtagtccaactagttgttcaaccagatagtaagccttggtacaggtcaatacttgtccaaagagaagacgggtatctgtttacagaaggttacaacagaaaatgtcgggtagagccaatgtatacacgtcttggtatgaaatataaaaaagtttttactgaaaaagaaatatgtgcaatcaacccagattacatgtattttgcagtggaggtgaccaaggatggcagacctattaatgataactaaaaagaatgttcagggttatgtattaaactacttatttaagcaattagctgtaaaaagtgaacataactacacttgtgagtttttagataagtttaacttacctgatattaaaaattatgcgaataaagcagatgtactaattatttcaggcttccctttttatgagagccaacgtactactgtggatgaagcattacaggtaatgaacaatccgtttagtcaattctttcacttagcaacttttggggatacctatagcaacgagggcagttttcattcatatgtagatgaattagtaagccctgtaggaaacttccctaaaataattaaagaactagagaacttcttgaaatttaatgatgtaattcggcacctgcttctaagtgatatggaaagtatcatcgaagcaaccgatgcgtataatcgttatgaggtaacagatactattctagactgggtttctcttgtagaaacgtacagagagcagttatacgcaagatacggagtaggtacagacctagaggaaatacttgataaggataaaaccttggtcaaatcattgcgggagaaaaaagacgattatatcaaaagaacacttggcagaacatctgcacaggtaatcaatggtacagtcgtatgttttacttacgcagaggaatatgtaaatgaggtagcccataaactgattgagttttatcaatcatacaactatacaaaagtagctgtctttgttggacgacataccaaaggtgatgatatgttcagtattcgaacagcaggtatagatgcgggagaacttgcctataaggtaaacagaggtagaggaaaacctactactgcaactgttttcttaggtaattcaggtcaatccacattcaacgcattacttaacacacttgctcaaattgtataacaagtaagtgtgttataataatgttaggtataaaacaatacacagggagtgtgctacttgaaaaagaataaaatgctagaagacctaatgaaacaattagataacccatacgtaattggggcaattattgcaggaactttgcaacatgactttaaccgtatacacgttagcaaatataataaatatgctcgtgagtttggtttagaccgagagaacaaagaaagcttagaagcactaattgaacatttcgattctgataagttattaaaggaattgtacatgtcaagtattgcaggagaaattaatgtggacatgcttcgttcatttaaagataaaacgaaaaaatccgcattccagactttatctccattcgtggtagacaaccaagctgttttagctcgtaatcgtgagttcaacaagattcaacgtgagggtgcttacttagaccacttaattgaaggcttgaaagagcacttatccgaagaacttgaaaatactaatacgcttaaatatattgaaccagaattacgagtaaaaggcaagccaagtgaccgtgaaatgattctatgcttatctgactggcatattggagcatttgttaacaatattgatacaggcggatataattacgacattttccgtgaacggctaaacagtctattgtcagaagctttccgtattgtgaaagaacaaaacattcgaacagtacatgtttatcatattggagacattattgaacatatcaatatgcgtaatgtaaaccaagcgtttgaagcagagtttccggcaacagaacaaattgctaaagggattcgagtattagttgaaacactaaatgtcctagctaaagcgggtctagatgtaacctttggtatggtaggtggtaaccacgaccgattccaaggaaataaaaatgataaaattcataatgataacgttgcttacttagttgtagaccagttacactttatgcaagacttagggtctctacacaaaaatgtaactttaattgataacagacaagatgtttatagctttaaagacactgtagcgggtaaacgcattaaagttgttcatggagacaatgaaggtaagaaagtagacgttaagattccaaaacatattaaagaagaagttattgagtatttaatcatgggacatatccatacaacacgtattattcaagaagactattcacgattccatgtatacgttgggtctcctatgggtgcaaataactattcagcagaaaacaatctaccaacaacaagtccggcacaattaattatggtcttagaccctaaagtggatagcccacaatttatgccaatctttttgtaggagagtgatagaatgaacccgatttactttttattatctatcatgtatgtattcgagtttggacaagcattcttgaatacgaaacgaaaagaacgatatatgattgaagatggtggagaacctcttcctagaagctcttacgtgttcttattcattcaatatgtattgcgtactcttttcgcaatcttgcttatttttattgtaccagagagcctacagttcaacgtaggaggtattactgcctttatagtagttttgcttattattccatttatctctcggttcattgaagttggtattcgggtattgattattaaatacttgcaagccaagcacataaaacgtattaaggaacaaggggacgaaaaagagactaattagagtctcttttttgttatgttatattaagtattgaggtgaaaagaatgaaatatacagaaatccaagtaggtgacggacaaagcaccttattagatgtaaaaagcaaacctgccttaattcgtagaggcacattaacaatgaaagttaaatcaagagatagtctaatcagtaaggtagaagagaaacctgtatatattgttgagctagcagaagaatcctatggtacaagcgttgtttctgtttttagtgcagtacaggagggaagcggagaccatgtagttgttcagaaggcgtacacagagaatattacgcaaccatcgtttaaaggcaccacatttttaggtaaggttgctcaaaaggttcatgaaaagagcttaaaaccaaaacgggtaatcacaactaaaccccctgtttttttagcgcctgttgtcatgggagtagatacttttacacaggaacatggactaggattttatgaacgggaaccagataaatttgttatgaaagacggtcatcctagcattgagtatggaaagaacacaggagtctttatttgcttaaactctattaagtgggataaagcttatgtcaatgcaggacaattgattcaagactatgtagcagacaaacaactatggtttaatctgggaggaactaaaccacaatttaagagtgaagttaatcaatgaccgataaccgtttctatgaggcagacatacaagagttaatcttgaacaaaaaacgtatttttggagacatcggggaaagtgctattgtatttgagaaagcagttatgagagggaatactatttgtgattgtttaatctttacagaaaaacgaggcgttattggtattgaaatcaagacagaacgtgactcaacaaaacgtttgaataagcaacttaaagactatgaaaaagtctgtgattttgtttatgttctttgtcatgatacacatgtaccaaaagtggaacagattctaaatagatacaatcatagacatgttggtattttagcttatacggagttcatgggtgaagctatgttaggaatatacaaagaagcaaccccttcaccaagtaagagtgcttatcatatgctagacattctttggaaagaagaaattctaaagatgttaggtacgttcagacattacggtattcgagtagagactgctacaggaaccaaatttatgcacacagctaaccgtagcggaggtgtgagtggtctttatacgaagtctgcgaccggtaggacgatgcgaaagccagacttgataagaaaccttataaatcgtgtagggggtgctgaggaggctactagggtcttctgtgacgtgttcattcataatagacagcatccagagaaagctattaagttaagacactttaaacagcaaccaataaggagtgataacaatgagtaaacaaggactgccttttggtacttgggagaactccgcaggaagaaactacacagggctaggtaacacagataacggacataataagaaacgaatgtccacaagaggatattatcacgtagctctgacaaaagagtataggggactaacagagagggactttgaactaaaacttgaatatgggaaagaccttgtttctcaatatacaggtgtaccgattgacatgcttgttcttcgtaaaaaaacagaaaaacaaacactttcgtctatagatagtgtatactatgtttgtcgaggaaaggaacctatcggtaagctgtctgtaagggcacagagacggtttaaagaccttggactcacatttgtatacctagagaagaactacgcccctaaagtggtgagaagggtgtctaagggacagcgtagccttctgggacaaacgaaatcagataaacgtaaagcaaaccgaaaacaaaagaagccaaaaacaacaaattaggaggacaatcatgctaagtaaggggaaacaagttacacttagaaagttaaacaatattattacaaataaggaatacatccttataggtgctcgttacacgaacgattctttagaacgagatattcctattacaactgtaattgacgatatacttatagatttgaagaaagagacaatggcaggttgtgttttctttagaccagtaggagatgcacaaagaaatgccttatctctattaaaagatgcgtgtatgcactttggttacggagaatttttagatgaagctattgaacgtcctgcattgtatgcggggctaaaagcaaacgttatgctacctgatacagccttctcaaatatccaagaaatcccattcaatttttatttcacagaaccagaagtattttgtgaagaagtaactatcaagggaagaaaacatattcagtacactgtcttagacagaatcagtttagatgatgtacaacatgtagaacaatctcttgttgttcttttccgtaaagcagagtatgatggagaaaccctgttaggtgcttacacggatacaaaattaacaaagacagaagcaatcaaaatccttcaatttgttagtaacggttccttacttgaacaggtagttggggcagttactgtattctcagataaagtagtgtctacacttattcctttgtttaatgatgtagatataagctttatgaaatcaggagaaggaaatcctgttgtctctattacagcagatacaggaggcattgcctttgatgaaaaagatttggatggtatgtctattgaatctcctagtttcggagcttaccgtcttgtgttacatgtagggaaagacaccgtaagtattttaattggataaatttttttgtaagggagtcaaattatatattgactctcttatttttgtgtgctaagataaattcagttgttgtacaaggttacaatgacaacatgtacaggagggaaagaaatgagtgtagcatcaagtttagatagagctgatgaatggttgttgtcgcatttgtgtgataagcgtttagagtatttgtctcaaaaagaagagttaactgcaaatgaaaaagcagaaatattactaattcaagagcttaatatgaaactaatatgtaataccttacaaaaagagacacctgctcaaaccgtacagggttctgacgttactagtggcttattaagcaaagcttacacaaactctgttaatattacatcgcaagaagcgtggtatacatctttgttgaaacgtacgcttgatgttgttgatggaataccttgtgtagggaatgtcactgtatttgtggactcagatgagattagtatttcgattatggggcacatacgacacgacaatgatttagcctgcgatgtctacgaaatttcttttgaaaaccttggaggtatcgaagattttctaattcatgttgagggagtagaaatagctttaccggactatttagagtttattaccgaggaactacctgccattttaaaaaaatcattatgaggagagagaataatggatttaaaacaagcttacaactatgcagtagaacatttaaatgaaaatgccaaaacagaaagtgaacgtatctatgtattgggtgtcttccaactaggaagccgatatgccggatacgatattgaatcaagtgattacgattttacagtcgtttacatgccgtctgcttatgatttattaaaccgtgagtatggacgtagcaaaattaagtttgaatacaatgattacgaagtagaaatgtctttcatggatattcgcaaatacctaaatcgtttattatcaagttcactagaaacattacaaatggtgtttgcaccatctagcatgagctactatgctaaatttggagacgataacctatcattgcgagcagaagagcttgtagattttatgttaaaactacgtgataaccgtaaatcctttgtctacttgaacacagataagctatatgattcaatttcaggaagagcaaagtcttctatgggtaatgctagcattagctacaaaaatgatgaatatggtcgaacaatcaagtatgcgattggtgttgaatacatgcaagacttacttcaagcattatactacaatgaagacattcgagaaggtttgactgtttcacctatgcaagcacctgtttataaggaacatcgaaacaatcctagctatgaaattgctcgtttgtaccattctcgtgctgttaaccttatcgagaaaatggtcttaaacaaagaagtggttcgtgaaactttacgaaaactacagccaaccgaagacactattaaagtagttcgagaagtatggacagaagagtttgtaaacattatcttgggaggttatgacgactaatgatgacaacagcagtaaaagaaagaacattagatgaaatcttaaccaatcctaagaaaccgatgacagagaaactggttgaagctgaacaactaatcaagaacagtgagcatgtttatgactttgggttaggtacagttaaagaaactatggtgatgtctggtaaaaattggttagctagtcacttatatatcaaagaagttactacttatggatttatcttgcaagccgttgtatataaacagtctttagttgagcgggctgttactaacgatgagggtgaagaaataaaacctgcttcttatgactatgagctaaaccgtgtttacgaattagagtacagtctacgagataaatatactagactacttaaaaatggtagccctttgaaattctcagagaacaacattaaaaacatgttttctggtcaagaaggtgttattcaaaaactagattcatgctgtaacaccgagatgtactcttctatgtatgacgtgtttagttgtattggaaatgaatcagtaccccaagtagctcgttttcttgttagatttatgcaattgaacgtggttgaactaatctataaaagtggggttcctattccttttgctaaagactttgctagagaccaagctaggaaacttgaaaaaggtaatggttggtatggtagtccagagcctaatgctaactgggtagattgcacagctactgcacctgcaaaggttcttgatattccaaagtctttatttaaaattatttgtcaaggaaatgttagtttcagtagatatgtttcaatgcacagagctatagaaagagctgaaagtgtgggttttgaagaggaacctcgtgaggaatggaacagggaactacggatgtatattaaacccgaagaagacgaagctattgtacaaaaaaggaagaagtacaatgaaaaatgtctaaaacgaaataaacaaggaatcattcgagcttgtggtgcactgtatcatttgttcacctttgctgtggaactagatagtgaatatggaattgagaaagctagtaatttagcttctcatgagttcgaagatatgttatacagggaagtggtacctacccgtgtaaacagcctacagaataactcagcagtttgtattgccttttctttaggattggagttaaatcgtgttgccagatacatgtactatcaattacatgtagaacaaggatttactgatggatattataatgcaacttaccgtgactacctacgtatgatgcgacaactagagattgcggataaaggtaactaccctaaatcattgaaaacagtgcatgatgtagctgaaatgaatactagaatgattaaggataaagaactggcagataactttgcagaacaagtcaaacattaccgagagtgggaagacgttaaagttcgtggtagcaagtatattatgcgtgcacctgaaagtatagacgaccttgccaaagaaggttctagtctaagtcactgtgtattcagttatgctcgttcagtagccctaggagaaactacgattatgttcttacgtactaaagcttgtccagatgatagcttggttacagttgagattaagtacagccctagccgagaatgctatagaattgtacaagctcgtggtcactctaatcgagcattaacggctgcggagaacgagttcttagagaaatggtgtaaaaaatcggaaaatgtggagagaaaataggctattttaaaatgaaaaaatactactagttagttcattttcttaagttagctaaaacgattcatttcaaataacaattttccacctacaaatgtttcatatataattcacagaaaaaacacaaaaaaccctacagttatgtggggttttcttgcgtttcatttatatctgaaatttaacagttatgtgtgctatattaacagtagaacctaagaagggcgggctttatccgtgttcttagaatatagacatgttgaaggagtttgtatttgaaatggctaaaaaagacttaaataacagttcagtattgctgaacctatatcacaataaactattggtatcaaaggttgatgaagccctagacgagggtaaaccttatgattttattattgctttttgtaaagagaaatttgactttgaaatcagtaaacccgcattatctcgttataaagaaaaacgcagagaggcaattgagacaggggtagacctagaaacactacttgacaaaagacgaaaatctggtaaagttatagacctaaaaggaaaagaggttgaaactctaccaaacacgaacacgtcttatgaccaaacatttaacgcagtagagcaaatttataatgacgttgaagtgttagacactatcattcaaaaaggctttgctagcttgaaagaagtcgattatgtagaagcacctcttgccatgaaagctatcgaggttaaagcaaaagttacaggtaatcaactgcaagggttaagtctagtgggattgcgtgaactaagattacgtcagtctgctaaagaacaagcaatgaccgaagttatcttacgtttcatcccagaggaacaacacgaagaagtttaccaagcaattgaagaagcagaagcagagttctatgaaaacttagacctaacagcagaagatgcacgtatcactagcgcactcgaacaagcgggcatgaacattatctaagggggctattcaaatggcagaaaatctagtggaagtagactatagagggctgactttacaagaagcacttcaagcgctactagacaaaaaagtattgctagtcaaaggactagaacaaagtcggaatttagatgtattgatacgtctttacaccgaaggagtcgtacctgttactcaaatcagttatgatgttgttcctgctgatggacattggagagaagaatactggcagatatttgatatatctgttaatgctctaagtacgtatccgtgttacgtgtatgatgctgaaacggctaataaagcacctaagttcctgattggaacaacagtttattacaccagtaagatggatagcactcgagattccgctatcgttattggattgtacaaagacgatgagggcaattggcattacaaattaagtagagaccaagaaatttacgcagagacagagcttacagcagacaggttgtaagcctgtctttttttgtaattaaagtattgacaataaacagtaagcatgatatacttatggtataaattaataaggagagattcatatgaaagaagaaaagacttatactttagaggaaattagagaggaaattagggaaaaagaaagaaaagctaaagaattagaagagttgcttgcaaaactaccagaagatgtcttatgtgaagaatattatgcaatggaaaacgacatgttttatgcttgggaaaacggttcttgtgaacaagtgcagaagttgttgagtaaacataagtataacttagactcaattcaattggttcacgacgtattctatacactgaacaatttggtagaaggggaaatagaatatggaaaataagtagttgacagtactagtacaagatgttaacatgtttatgtacaagaaaacaaatcaaggagagatgtacaaatgaaaccattcgaagacatttttgatgtgttaaataaagcacgtcaagacaaagacaaggtaacacttacttttattgaaggactagacaatattgctagacttcaaattgaggattcttctgctacagcaggaatcactcgttatgtaaagttctacaacaatgacatccgtaagttccggtacgttgaccaagctgactttgaagaaatgtatgcaggcttagaaatgaaaacaggtaaaccaaaagaagaaacaattgagtttccttctgaggaagtaggaattatcagtgctttaaaaatcttgcaacaaagtggtgtctttagtgatgaagacggaatgcgaactttaggaattaacacgtctacattggaagatgctcactatatcttacagtatattgagcctgcaattgaccgttacttcgaatctttgaataaggatattgaagaattagaccgtgtaatgattaaccaatcagatgaacttaaacaaaaaatctgggaaagctttgtatttagcaaagataatctaagcaaaatgctagatgactttgaattggcaactctagacacgttcccaaatgtaccgtctaatttgattgttgagacttgttcagaagtgaagaaaactcttgaagggttattgattgaagatgcggaagaaaatcctattgagtgtcatgattaccttgttcgtggtttcgttggtgctgttatccgtattgaacaatttattatttctgttgcaacattaccttaccgtagaacagaactagaacttagagaatcaagagaagcttatatcaaagagcttgcttcaaatctatttatctttgcagaagctattgctcaggcgtatactagacttgtatgctctatcttaatggaaaattctattgatatgcacaatgctactgagtatatccaagttatggaaacaaaagcggttcactgggtaaaagaagaagcattaggcggaactatgttagctaacaatgaggaagacctcgttgagttatcccaagctttaaactctatgacactagatgacgtacgtgaaacccaagaagaccctgagaaggctgagtttaaagaagctttggaagaactgcttaatgagttgataggtgttttttcagaagacgaggacgaagaagaagttgacgaaacagaagacgaaaatgaggaagaaatgaaacaagccttgttagaatcattagaagcatttgaaaacctgttacgttcaattcaagcccctactatggaagaagaagaggaagaagacaatgaggtgcctttcgaaacacctatggtagacatggatgaccttcttggatacttattatcgggggaacctaaagaaaaagaagaacctgtagaactttcagatgatgcaaaagcagagtttgaggaatactttgcagatgaaatcggtgagttacaagaacttcgtgaaaaagggaaagatgctgtagccttgtataataagattaatggggaactaccattaaccgagataaaatcaatggctatgaaaaatatgggatttgcactgtcaactctgcaaaaaatgttagatggaacagagcttgactacactaagaggggtctacttgattccttagatagattaaaaggaagcaaatacaatttatttgtagaatatattgagtttttgagagaagcatataagttgtataaaacagtaggcatcggtattgttgcttacgcacatgcaattgttgaagatatagaaaatacggttgataacgtgatggacattgactatgaaactgcttaccttgttaagcttgcagttaaacagattaatcaagacattaaagcctttgaagaaaatgatggatactctgatttattagccttctctttagcatttacactcgttgttatcatgagagactatggagaaaccgacttaagtccaattagtgtagaggtagaagactttgtgtctaagaaaaaaccttccgttgttgtcgaggaagatgaagaggaagaaaaagaaggagctattgacttagctaaagagttgaaagacttgattcgtgggactgcattagacaaagacaattctttaaacaatagtgtagacgaagaagccctgattactgattataagaatggtgtctctcaaagagaactcacaaaatgttataatataagtacagggaagttctactcaattctacgtagacatggtatcgcagtagatagctctaaagtagctaaaaaggttgcacatgtagaagaaaacccggaagtacttgaacaggttcttagagattatatcgaaggtaaaacattagcttacatttactcaaactataatctatacaagaacggtttgttctatctactagataagtaccaaattccacgtagaaacaaacgttaacttccaaataactttaggcagtggctactatggtcactgcctttaataaggagaatatttgttggaagagacggtttataattttatacaaggcttaagcgggacacaattaactatattagaagatacatttgctttactaggactaatctttatacttataggaatacattttttagtagcagatacagttgaatgggtgaaacttgttaggaatccaagagtatctacatttgcaacaatacacatgtattttactttttatctaccgatgttcattttctttttggtagatggtagtacggttactacttttgttgtttcattactgctttttgctgttgtgtatacatggattgtctggcttcgagtgggtagatacacagaaaattggtcagtagtacgtccgtttgttacctacattaaagcacaagaccatgtgtgtacgctagttattggttcagtacttttaagaatagtactattttttataaagattaggataggttaagataggataggatggaggataagatacatgaatgaaataatgagttatgtttggttgggtgtgtttattgctatacccgtaattggctttatctatgtatataactacaatagaaaaaacccacgttggtaccttcgcaaaagctactgggcgccactagtgctagacttagttgtttttggtgtttgggcaatggtaggcgtaatcacactagctgttggacatacagaaactactactaaaacatttaatattgaaccacttacggtttatagttcaccagaaaatatttatgcaaagataggtagcacggatgacagctatgttaactttgcaattacaggtaagggaactcactctgcaccacttggtaacactagtatccattacgttgagtccgaaggtagaccgaaagtcacagttacttactacaaattaggttcctctttctcagcctttatgggaatgcagggagaacttgtaactaaaaaaactcgtgtagatattcaagtacctgtaggtggggtggacgtcacaaatacaggcagtacctttgaagagcaatcagtaaatgatttacttagataattccctaagtagcgggctacaaaaatccgctaagtagcaggctagagacatcttttataggtgtctcttttttattgacaaaactgtacagctatgctaccatatacatgtaaataaaacgagctaaaaaatttgagcttacctattgacattaaacaatgtacaggctataataagcttgtaagataaaacgaaggaggaatttacaatggaaaaacaaaaacaagtgattacaagaaaacaatatgaggagcttatggcacgttataacaaaatagactatgctatcatcgcagggttcgttatctttggtacaattatttttggactttggggagctatttttatggctgttgtaggtgcatttacattcccaaacatgcaacgaaaaagtcataatttaatagaacaagactacattgttagagatgacattcaacagtaagcttaattgttgactatggaaattacaggtgttactataatggtacaaggaggacaaagaaatggcagaagcaaaaaagagctattctgacatgacagaggaggaagcacagtatgcaatggtattaggtgctagaatcgctcatgcacgagaagggttaggtattagtcaaggagaactgggtaagttagcaggtttcaatcaaacaactatctctttaattgagacaggtaaacggctacctaacttaaagacccttatcagattgagtaagattcttaaaaaaagtttgaaaattacattggaatgaggtagagaaaataaaacagggggagatttattatgacaacgaaagtaaaagaaacaaaatcaaaagtaaagaatggtgaacgtacaccgaaggaatttgtagcagggatgaaacgtagtaagaaagacttgtcacaaacgcaagtggtaacttctttaatggaaaactatccagaacttacaccaaaagacatccaagaaattacaggtattaaacgtggaactatctatacaatccaaagtcgtctacgtagtgctcatcgtaaggaacatacaaagaccgcagatacgccacatatggataaagtagagtctattagtgaaaccatgagtccggaagctattggtaaacaagacttattcaatcgtttagctgatgtatacttaaagaagattgaagaaaccgaagatattgaagaagctagcaaatataacacgttacttattcaagtgatggaaagcttagataaatgatagcaggattctatttatataatttaagagtcctgattctaccgtatatttaacaggaatgtgcggtagaattttatttacataaacctattgacaataaacaatagataggctattatatacatgtaagataaatacggggagatgtttaaatgcaaacagcaactaaaaattttgaagttatacgtaagacagatgatttaatttattaccactttgcaaaagaaagtagttacgctatcagtaaggcagataaacaagagtgggaagaggcaatgactgaatatgtgaatgattttcttgaacaggcttacggaaacatcccacctatttcagtgtatatcaactctaggctttctagaacattaggttggtttcaatattatttagaagacaatggcaaacctccttatattgaagtaagtagcaggctagtaaaaagtgcgattctgctaacagatactgagcacaaagaacttgcatacacagtaattaacgacctgttaagacatgaagctattcactatgcgttgcacgtactagataaaccttctagtgatggagacgatacttttgagaaagacttgtttgtaacagggacatctcctagtctaagtacaccagagtataaagtatataaaaacgagtttcctagactactatgcaaatactatgcaaagtgccctgtatgcgatactgtgcttgcttatgagaccagaggacgttactattgtattcatagatgtatagaagagggaaaaacacatccagtcatctttagacctaagaacgaattaatcattgggatacaaccccacgtatcttatgggagaaagctactagaaggaaaatacgatggagaagttaagaagtcttacagagaaaaagtaaaaaaagattaaacatatctattgacaataaacaatagaggagttatactatgtatgaagataaggaaagggagagatgaaaatgttaaactttaacaaacatgtaacagcagaagatattatcagagatggagaatacaatgatgcagttgtagaacatattatcggagaacttgaaacaagtgataagaaaaaattagctttattcaaacaatggattgcagacaaaaaagaagatggagacacggaagctgttgaatactttaaaggtatgacagataaagaaattttggtttacatggacttagacgaaattgtagaatattatgaagaaacaggtcttgcagactttgcagatagtttagacattgactggacaggtttactagaaagctttggagtagaatagggggaactaacttgaacacagaaaacagagtaagaagagggagacctcgtaaatatccagagggagctaaacgggtagacaatacaagtttgatagtcacaaagaaacaaaaagaatacattggtaatatcgcaaagttaaacaaggaaacagtaaaagagacaagtaacaggctactaaaagaagttttagacggcaagtttgattacttgttaacacctattgtagaggaagatgtaccatctgtgccagtaacagtagataggaagttgacccatgaggtacagaagtatttagagggttacaacgagaatgcttcggaagtaataaggaaaatagtggaggagtttatgattatgacagacagaacactgaaagtagttgggggttacgaactgggggtaacttccattacaaaagagcttaaacgattttggttgaaacctacagaggaagcagaagaaaatatgttctttatggatgcttccattcaactagatgtagataaccgacatgtagtcattcgtgaaaaatctatgggtgtccgctcaatcagtcaaatggaagagcttaaacgttacaaagaccaactgatagagacagcttcacaattacaggatgcactggatacttacgttgcgaaacatttaggataaacttttaggatataggataggataaacaggataggatgcgtttaggataggataggattcacttaggataggataggataggataggatgaaaggagataggatacaatgttaagtacagcagaatacgattcacttagagagtatttagtagccgtaattcataaccaaattagtgagtatggaggagacacgcaaagcttagacgtatggaaagaagaggttaataggtacgcagataatcgaatgggttggtatctccgttgcatgagtctagcagatttgttatatgtagatactcccgcttcactggtagacatttacaaagactataaagaggagctaaacgaaatacttagagattacacagatgagttgcgtgcaggagctacgttcgataaggaagctgacgagcgcctagggtggatgtgggaagattatgacccattaatactagaagcacataatcaaggtctagtggctcgtctagggcttctaatcgttgctgaacaacttgctactcaattagaacaagggacgtttacaataccatatgataactaagtaacaggctagcctaagtagcaggctagcttttttcttctaagtagcaggttagctaaaatcttctaagtagcgggctacagtaaaaaaactctaagtagcaggctacaaaaaaactctaagtagcgggctacaaacagcttataaaatcccgaggcgtaccatccgacagccagacccgccacctttgcccgttcgatatgccaccactcaaacccgttttttccttatatatagaagaaaaaagtttttcatcttttttagtgttttttattgacattaagaaataggcatgatatagtatagacagttaaagaaaggagaaacaaaaaaaaataaataaaaaaatttaaaaaaagttattgacaaaagacaataaacaagctataataaacatgtaagataaataagacaaaagaaagagggaactaaaaatggaaaaacaaattattgtaaactttttgaaagagattgaaaaaaatattaaaatggtaaacagaggcttaaaatctgaaaacgaaactcacagcgaacttgttggcatgtatgacggcattaagttagcaatgaaaacaatcaatcccgacaccgtaaacattgacttacattatacacgtacaatcatagaaaactattttgtaggtactaatgaacaaaaagaaaatgctctagaagctttacagcttgcgttatcagtcgcaaaagactaacatataaaacggcgggacacgttcccgccttacataaaaaaagttaaaaatttttatgtttatctattgacattaaacaatatagatgataatataaagacatagaaagggaggggaaaacatgaaaagcaaagtaaaagcccaaaagaaagaagtaaaagagattttacagacaagaaacaaggcaataaacgagcttaaaaatttaaataaaaaacttatacaaaactattgacaaaaagaaataaacattatataataaatatgtaaggtaaaacaaggaggaaaaaagaaacatgcaaaagaaattatacaagaaaagagatttttataaaaagttagcttcattcgctgttatgtttttacttggttcggttgttacggcggtattttcattttcagtgtcacttattatcggtttgactttattcgtttttgcttttatgatttttgatgacttagactatacagtaagaaataaataaaattttttaatcaaaactattgacaataaacaataagcatgatattataaacatgtaagataaataagacaaaagaaagagggaactaaaaatggaaaacacaaaaaaatatacattagagggcttgaaacaactagcaaaagaaagcgggtttgaaattgaggaggtaaaaccaaaattacacgatattaatcgttattattggagtggtagcatttacggcggttcagacttcattttcattgaccacgatttaaaaattattgtaacaggtaacacacgagcaacaaaaagcgatatgtatacaagaaacaacacggaatgtaaacgaaaaagagacttaaacgaggaaaaagcttactatgaggggctagggtatcaagtatttaataatggggctttctcttatgaggctttgcgattattacagaatggaagtgttaaccgctcattaaataaagaatacagcttacaagaattgcttgacatgaaagactaacatataaaacggcgggacgtgttcccgccttacataaaaaaattaaaaatttttatgtttatctattgacaaaaagaaataaacattatataataaatatgtaagataaagaaaggaagtaataaaaatgattattgcagaaaacgaaaaatatttattaaaacacccattaaattcttgggacatgaattatcatttaatcgaaaaagaaacaggtaaagacttcttaattgatattgacgacgtagcagacaacgaggaagaaagagaaaaatatgatttagttttattgttttcagacttgcaaaaccttaacactgatttattgattgaaaacagttggaaaacgttagaagatgaataaaaaaatttaaatttttttattgacaaaagacaataaacattatataataaacttgtaagataaataagagaaagagggacttaaaaatgacaaaatacggaaaatttaaagcatacttttataatggatttgacaaaccaaaattggtggcaacaagcgttacagggcttttaagagatgttacagtatccgacacgtaccaaggagatgtaaccaaagaaatgcgattagaagtaaaagcgtataaagaaggacaaaactcttttcaagaatttaaagagtatttacaagactttaatatctttatagacccaacttattcggaattaaaagaagcttcacggcaatggttcggaaacgataccccagaacaccatttcacggaatttagacaagcagaagcacaagcaaacaaagaagaaaacaaggcgctagcattggcaaatgtgacagaatacaaagacatgaacgactataaacaagactatgaaacactagaagaagcgcaagccgattttaacgaaaaactagaaaatggctatattcaaaatatcacattagcaacgtataacggcgctacacaagaaagcacattttacgagctaacagacgaaaatattctagaagctatttatacagacttgcacgaaactgattcttatgatatgttacaagaaatagaagaaagcaccgatttaacaaaatgggactatatacgagcttatacagaagtttataacgtgtttacacttaacgggcttgtatacattgaaagagactaaaggggggacggtgtgacgatatgaaactaaacaagaaactagaagcattaaaacgggctagaatggaaaaattagcccgtgagacaatcgagaagcctatagaatttatttacaacggtaactatacacaagaagaaatgtattatttcatggaagaacgaaaacgattgaaaagaattaaaaaacgagaataaaatagttgacaaagaaaaatatacatggtatattatacatgtaaacaagggaaacacctattcggacgaactcaaaaaaagagtataaaaattttagtcaaaactattgacaaaagacaataaacattatataataaacttgtaagataaataagagaaagagggacttaaaaatgacaactttaaaagaagcatacaacgaaattattgaaagcaacgtaaacgaaccagaagaacgcaaaacatacttacaagacttaacacaacacggggcaattagcggaatggttagcggtttgatttactacaatgaaacaactcaattctttaatgaacaccgtgacgaaattcttgcaatgttacacgaactaaaagaagaaacggggctagacgaaaaagggctattcggtgataagtggacggattgggaagacttactagaagaagaggcggacgacttagacccgttagcagacacaaacaatcaaaatttactagcatggtttgcggtggaagaactagcaaagaaagaacttgacgaactagaagaagcctagcaaacacggcgggacgtgttcccgccttacataaaaaaaattaaaaatttttatgtttatctattgacattaaacaatatagatgataatataagagtatagaaaggaagcataagaatgttagataaagaatatttacatcagcaactagaaagaagtttctaccctataaacgatattaaacgtttatcagtgctacacaagcaagagcttaacaacttgaagaaccatgtaagaaagggggctacaccggaacacgtagccaaacagttggaagaactaacaaaagaaatgaacgagctttctaaccttgcgtgttcattagagttatatgttagaagtgtaaagaaccaactaggcaacgaactaggcaagaacgtaaacaaacacgaataaaaaaatttaaaaaaagttattgacaaaagacaataactattgtatacttaacttgtaagataaataagagaaagagggaactaaaaatgagtaaaacagttgaaacagttattacattgatgaaaagagcagaaaagaagggcgtagcaatcaaacgagcaagacaacgggacatgtggggcgtgggagacttacaagaagtgtatcgagtagaaaacaacggtaaaacagtaagcttataccactatgaaacactaaccgcaaaagttgaccttgaaaacatgcaactaatagaggtatacggggaaagccgttctgatagtgatagcgtggcaactttcttatctgaattaggtttcaaaaattttgactttggttttaaaccagtaaacgggggcttttggttattcactaacaaagacggggaaagacaagaaacctatctagacgaacaaggagaaaccgccgttataaatgaatttaatcgggtacaggcataacaaaagaaagagggggaaacctctctttctaaaataaaaattttaaacttttctattgacaataaacaataaggataatataatactagtgaggaatgataaaaatgcaaatcgaaattatcgaacctaaaaaagaatttaaatttttaactagggaggaacttaacacctatcaattagaagcgggggaacttgtggaactaacttatatagtaaactacacaaaagaaacgcctaaagaattgacaagtgttttcatgtttgcggataccatcggggcaagctcgtatcttgtagacgtagaaacgggcataatgacaaagacacaaacaaaaaacccgctttctaactgtaatctagctataacaaaagtagactttttcaaaacaagcaaacttatactagaaaggaaagaaaactaatgaatttaaaagagtggggctatacatgggacggcatgaaagaaattacacgggaacaagcaaagaaacaatacaaggaaaaagaaacatttattctatatagtgatgacacagaaagccttatcgagtcagaggaacaatttaatataaagggcgttcgttacggtgtggaaaaggagggggaacaatgaacaaatttctagaagaaagaaaatcagacttgcttattcaacaaaaagaacaagctcaaaccttattacactatatagaggaaaacaaagaaccagaccaaaccatcatacaaagacaaacaaacaggcttaacaggttaagcgctcaaatatacgaaattaaaatgatacaaagaaaactaaaaagaatataaggagaaaacagacatggaaacagtaaaagacattaaaagaatgataggaacactaaaagaggatataaagcataaagaaagctatataaaggaattagacgaacaaggaagaatgatagagtcagaactattgaaagcagaagtaaaaggaatgagggacgttatacgggacatagaacaagctatatactagaaggaggggaaaacatgaaagaagttaagcttattcaattagacaagaaagaaatagatagttatcacacatggggcatatttgacacaacggaaccaatagaagacggggacagaatttctatatatgaccataaaacggggggcgttttacttatagacgttataacagtaatcaaggaaacagaaggctacttctttcttattatagaggaatagagagagaggaaaagaagaaaaagagcaaagaacccaaaaaccaaaaaaaagaccttagagcctg

SEQ ID NO: 10 - DNA, 56991 bp, synthetic construct
  misc_feature 1..56991: note = Efs7_kvarM
  source 1..56991: mol_type = other DNA
ctaaagaccacactcacaggcacacgacaggcattatagaggtgtgcgaatggtgtccgaaagctatccgaacagccctaacatggcgctagtttacataatacacattattcaaagtagaaagaccctgactcaatgcaatgttaacagcaaagagacagagtcgaagtgaagtcgcttgtgtgagcgtgtcggacggcgtgacgtgagagcgtcgtgaagcactcgcaacgcctctcgaagcgtgagggaaggcgcaggggcgcaggcgtggccacggctggcgggggtctttaggaagggcagggggtagcttttccgagggcgggcggggcgcgcgactgtccatctcacacagtttttgggaaaagcgacattataggccttccgatttattttttgctaaaaatcctctataaggcgtcccgacacacttcccgacaagctttccgaggccattccgacaatctatccgataagcattccatcaatagacgtccgaaagctttaaagctacctttcctgatacctcttccttagtatcctttaagaatagattccacaaatagagagggcgccgcttgtcggcagccctagaggcttcgcctctttctagtggagtattcacacaagcgtttattaagttgtaggaagcttattcaagccgttgcaaggccgttggaagaggcaatcttccgaagcatttccttaatgcgttctaacatactgttcaacacccctttcttatcgtttcttatagtataccataaaaaagaggccgtgtcaaggcctcctgaaggtttattttagccatagatggattctctaaccatctcgaaaaggtaaattaggacagtcactgccacagacactgctgcaacacctttccaaaagtttagggcagcatatgttggagccttcttatggactatcttaagtcttgttaccctgtgttgctcaaagcccctatagtatcttaggttaagctcctcagaaactatttccttagcttggtcaaaggcatcctcttcgtcttctgcaatgccttcccactcataaggcactccacaatacttcatcttaacaacgtaataaccatcttctaaaaatccattcatatcctttacctccgcttttaatataccttattatagcataaaaaagacgccttgtcaaggcgcctctaacattatttctctaagtcttgcttagctttattgtactcttaatgaagcatatcccagattagtttaaggagaattaagtttgttaaaatccgtccaatagcaattgtaacttctcctccaaatactgctgtaatggctacaataagcccaaatgcaatcaccaatgctaataaataagagaatgatactagtctaaaagctttccaattcatattaaagttcctccaatgtcttatgtttatccttgttatagcgactataggcgtacttagtagtttcccaaagtaggtctatcacgaatagaatcccaagatagaagaaaagctgttcccaaccagttattaatgatactagccaaagtataccgaagattattccaatagttatcagataagctatgataacggctgccaatataacgcgtttagtaagtttatcagacaatataatttccaactcctttaacaagctttctgcaaagcttaactttgactaatttactatagcgtgttgaatatatctccacaggtgtctctgaataagtttcaataatcacgtctttaggctttttacgtgtaaccatttcaataagaccttctgaaagtgttaaaatacctccataattaggtataaagtaggcgtagactctatttaatagttgttgaggtgactcgcatacttggcatctagtggaagaccatttttcttcaaaccaatactcatactcaggctcttctttaatgcgtggggaatactcttccttaatctcttgcaagtaattctcaagcatttcctgaatctctttagtatcaactttaatagtagctgttggttgaggctttctaggaattgcttcttgaagctttctatactctcttttaaggctgttgtaatcctcttgaaggcgtcccatttcctgttcccaacgcttgttttgctcctcttctactgaaagcttttgacaaacctcttcaaatttcttaccaagtctatcataagcctcttgtctaagcaatctctcttcagcggactcgttagccatttcaatagcctctacttccttatcagaagcatatttaagacgctctttgtagccagcttctttaagctttaaggcgtctacctctctttgaagctcttcgttagccatctctaacctatctaaggccagttggtagacagcttttctgccagtcaataattcaatctcttgtttaagctctttaataagcttgttttcgtccttcttaaataacatcttatcaatcctttcctaatactccactagtatagcataaaagaggcctgttgtcaagcctctcctaacactttttaaccatctaaccaaaaatcttccatacggcagaatccataaccgttctcatgagcgtaaatgccctcatgatagaggtcacaaagctcttggataacccctttaggtaccccatacttagtggaagctttctccattcgtgtaacctcttctaaaacctctccagtagcatcgtcaaagactaggatgcgcttattgttgtcgtagtagtgtttaaggttatcctcatgtgttaaccattccaagttatctaggttgttattaagcttattgccatccatatggtttacagtaagctcttcccaaccttctattggattgtaagtggaaagcaatacccgatggagtcttttcttattcccatcgcctagtccaatttccgcatatcccttatcatttataaaaggctttagaatcttaccagttaggttattaacgaccttaccagtctttgttatggagtagttaggaaacccattaacaaccttccactcaccctccaaatactttttgatgggctttttagaagctagtggagaacctttctcaaactctcttccagtataactccacacatgccctgcatacaccttatttttagcacaggcgttgcggacacttgttgaatccttccctaaatccttagcagctgcatgagcgcttctgtaaactgtctctaaacctgtctcaacgtctactgatttaacctcttttataagcttcactaaaaaccctcctaagtcctcttctataggcatattgtagcacctttcaggtgccttgtcaatatcctttatgttacatttgtgttacaaacattaaatttactttacagttataaaatattccatcaaatagtgagactaatttaaagcatgtgggaaatactgtcgtattagttaagagttagttagcgaagctactaacgagcggtctccagcgagttagtaattacttgacctttcctaaaagcttcctgaaacgttctcctaagccttcctaaagctttgagacgtctaggttacaggtcggggatggagtcagttgttaattactttaaggacgagtttgtagaaagcttattaaatcgtatggcctcacctaatgcaaagtgccagcagcgacctttagtaagcttcctagagactcgttttaatgtgtaataagaaaagccttcaggatagcttcccgaaggccttatttatgctttatttataggcttccataattccagcaacgaagtgccattcgtcccagccttcagtacgcttttgaatagcttctaaaaggcggaagaactcactttttggaatcatgtctgaaggattagccaaaggaatttcatcttctatgataatgtcttccacaaagtctctgatagaggagattccgtcaaggaaaccttcatcccaaccttttccgaatgctgaattatcagcgttatcggttgtatttaattcctcttcggtcttttcaatgtgatttaacactacttctgcatcgataagcttcataaaatcactccattaccttttggaatagcttggatagcgcctttcaacaaggcttgaatcgaagaggtatcaaagaagtcctcagaagcctctaggagagcttctaaaacgtctttggtataattgtgaggcaaggtgttaataggcgttacagagcttcctgtaaaggattctgctacaatgtttccatcaatagctaatttaataggctctggtgcagcctcttccttagctaccgataaagctgctttaatttcgtccatacaagtttctacagcgtcctgataaccctcatcgtaatcatcttctgggtattccaatttgtttttcatagtggttaataaagcttctccatcgattagtttcattaagcttcctccttaacagtttcaataaaggccttcaaacgaggtgggtggaatccactaatagctgtgtcgaagtcttcgtccaacatcaccactggaaagcttcggaaacccgctaatctaagcatctccacagtctctgtatcattgcggacgtccacaaacacttcatcaaagcttactccgccttctgtaagcactcgtttagccatcttgcaggcttggcacatgtctttagtatatactttaatacggttcattcccattcctccatgctttcaataatctcttcaagctcttctacacgttctgaaagcgtgtcaacttcttctgtaagctctgccacagtttcttcaaggctatatacttcgtcttgcaagtcagagttctccgattcaaggtcttctacgtcttgttcaaggctataaatctcctcgttcaagtcttcgttttcccatacaacactagtaaggcgctcttctgcatactctaattcctgttcagcaatcagcttatcccaattggaatccaccaaggcattttgaagctttcctacaagctcaattaaagctgtttcatgttgcgttaatgtaggctttgcacaagcctcttttaattctttctcaaaaggtaggttactcatactaaaactatccaatctcgttttgtttaaactcttcaacaggaattgctaatggtgcatagtgaggtgaagtcttcttaatttcatctagcgtcattgaacctttttcaattacttcatatggcgattgagtaactgctatactagctgtaagagtagtcaagtaagtatatccacaaggcgtaccacttccacgcccactaggaaggactagtacatactttttctctgcttcgttagccatgatttgtaaagagtccgcaaggtctcgtgccgctctaggggtaagggtcattgaagcacatatagtagaaagatatatctcaccatgctccttactgacaattaattcaatatctggttgaaaggctcgtttgactgtaagtgactgcattatactttctcctcccacttcttatcttccttagccaagtatcgcttagcatcggtaaacagttctgaaagtacatctaaagaattagtaaggttatcgatggcttcagtaacttcatctacagcagcctcgaactcagattcggtgacgtcagaaacctttgcaccaagcattcctgtcaggttgtagacagtcgtttcgacatttgcttggtctccttctaaatacccattctctaaaaagttatagtaataatctaattcaatgccttccactattccttacctccagactccaactcttcagtaatcttctgctgctttctaatggttcctaagtattccgtaagctgcttttcgtcttcctctgcttcgtcagaaacgatattctcaataagctcatggtactcttgaaccttttgggaaagcttttcaatatcttctgcatactggttagcgattaattcatgagccttctttgaaaagctattattaagctcgaagtctgcggccgcttttcgtactgtaccaagcttctctaaatactgctgataactcttgatggagtacatcttaattgccctcatctgtattcctccttaaatgcctgtgtaaggcgttctaatgtgttcagggataattaccctagaagctactcaaaagctctcagagagcttcctgtggcttttaaggtatgctttagcgcctgtttgtcttttacataaataactataacacggttgcattaaaatgtcaagcactttttcataataaattaaaaatgtgacaaaaagagctagataaggtctaatctaagaggctcttaaatgagcttgaataaatactccagaaaggaggaagcacttatggtaagaattggaaacagagagttggaagaacgtcaacgcaagtatttaactacttctaaggagccagacgaatacgagggagttgacttaactacattaaaacctaaaatgaaacgctttgcgagacattatatgcaaactatgaatatcgctgaaagctgccgttccgtaggctataatgaaagctcaggttatcgtgtgttaaaacgtgaggatgtgaaagcttatttacaatggcttgtttcagagaatgctgacgcagctattatgagtccaacacaggtattagaagagctaactaatatcgctttacgaaacagctctgattacacggttactgtaaaaggagatgtcgtagagaaacctattgatacaagcgttcaattaagcgcactaaatagcttggctaaattccatgacttattagcccctgatgtcaaggtagaacagtctcttaatatcgtggtagacattgctgacgacgttccaaatgaagctgaagaggttgaggaagaagagtttgtagaaggagactttaccgaagttgaagaagaggatagtgacgtaagttatgacttcctttctggattttaaggaaggagataccaatgccatttgaagagggtaacttagaggttatcgtcaacgaccttattaaagacgttaacactcatgccaaccagattgcttctattcagtcagacttaaacagaatgacaacagacatttcaagcgttcgtgacttgcttatcaaaaacactgagcgttcggacgttctaatcggccacatcaaaggccagtctgacgaaatgcttaaactacttactgaggagcgccgtagacaaacggaaagctacctagctgacgaagcttcagaccgcaagaataaagagtttagtcaaaagcagatgtgggctgtggccactgctcttgtcacaggagtagggtcagctttagtgaccattgttaagctaatcatgagctaattgaaaggaggtgcattaatggacgtagtaatttctatcgcagttgttttaggtggcgttaccacaggcttagttaacttagttaagtctatggatgtagtctctcctaaatacttaccactagtttctctagctatcggaatggtgtttgggttagctatgtcaccacttcttggaatcacattatacgtaggtgctattagcggacttgtagcagggctttccgcaatgggattctacgagttgacaaagactccagcagaataaccttcacatggccttgagggagtttccttgaggcctttacataattttaaggaggacacacaatggctgaaccaataaaattaaccataaccaaaagaacatttaacgaagcctatttaccttacatgtacgaccagcctgaaggacagcatcggacaatggtattctatggaggcgctgggtcaggtaagtctaagttcgtagtacagaacgctattctaaaaggcttatcagaacgccgtaagttccttgttcttcggaaggttgacaacactatccgtgactccatcttccaagagttcttagtctgcttagaggaatggaaccttctcgacttctgtgaggttaaggcttcgtatatgacaatcaagctgcctaataaaacagagttcatcttcaaaggattagaagaccccgagcgaatcaagtctatccaaggtcttacagacatcattatggaggaagcaactgagtttacccgagaggattacgaccaacttcaaacacgtttacggcatcctacagcacggcatcaacaagtgtttgtaatgtataaccctgcctctaaagacaactgggtttaccaatacttccacaaccctgccactaagcgtcctaaaggctctaaggtaatctgtacaacatacaaggataatagattccttcctaaagcttacctagaccatttacaagacttgaagaacactaacccagtctattacgaaatctatgccttaggtaagttcgcaagcttaggtaaacgcatttacacaaactggaagatagactctgagttcaagcctaaccaactagttaaacaaggctatgagcctcgctttggactcgactttgggtttactaacgaccctaccgtaatcctttccacattagtatctgaagcagaccatgtaatttatatatttgatgagtttgttaaaactggtatgatagctcctgagatattcgatgtgattaaacgtaagaagcttaccaaccagcttatctatgctgactctgctaaccttgaaaccatcgagcagattaaacgcttaggggcacgcaagattaagcctgttaagaaaggccgtaacacagtccttcatggaatccaatatctacaaggctatacaatctacgttcatcctcgctgtgttcacacgattaaagagcttgagaactatgagtggaaacctgctaaaggctctgacgactacgagaacaagcctaagcaaaacggctttgaccactgtatggatgccttacgatatgctgtcaacgacctcattccacgtaacagaataagaaccattaacaagtcagtactaggcctataagacgtctagtatctgtcttgggtacaagtatcagcgaaaaatataaggaggattctatatggcaatcccaaacggacaaattaacgctggtgatataatcactactaacatccgacgtaaacatttcattagacgcaactacgatattcgagaattagtaacccttgctgaaatgcactctcgttcttcaagcgcctatggagtattgtacgactattacaaaggcaatcacattgctatccaatcacgtactttcgacgacactaacaaacctaactctaaaatcgttcataacttccctaaactattggtagacacttccacagcttacttggctggtgaaccaattacggaatcaggcgatgagaaaactatcaaagccatgcaaccagttatgaaagagaactatgtaacagacgttaactcagaggaaattaagctctcaggaatcttcggacactgtttcgaaatccattggattgaccgtaacaacaagcatcgcttcaaagctgtttctccaatgaactgtttaattgcttactcagcagaccttgacgaagagccattagcagccatctattacaatactgttatcagtgatattacaggacacgtaattagaacttatgagatttacactgaggataagattcttaaattctctaccgacgacgagagagacgtctacaaagagattccagaagtgttggacattagaggttatgaagaacatcctaacctacttaaaaagttccctgtattagaaatcattgctaacgaagaacgcttaggtgactttgaagctcaactatctttaatcgatgcttacaacctagctgtttctgacagcgttaatgatattgcttattggaatgacgcttacttgtggctacaaggatttgaccttagcgcagacagcgattcaattagcaacatgaagaatgacagagtaattgtaacagacgatactggtaatgtcaagttcattacgaaagatgttaacgacaagcatatcgagaacattaagaaccgtgctaagctagacatcttcagcctatcacaaacacctgacttggtttctaaagacttcaccgcagcttcaggacaagctttgaaagcagctacacaaccgcttgagaataaatcagctgttaaagaatctaagttccgcaaagtattagctaagcgttatgaacttatctgtagctaccttgagttaatgagtaaagagaaagacttgaaaccaaatgaagtaacacctgtctttgtacgcaacttaccacaatcttatgcagagttagctgacatggctgttaaacttcgtgacatgcttcctgacgaaactatcattaatcagttcccatggattactgacgctcgactagaagtagagaaagcggatgaacaacgtcagaaacgagctgacatcgccttgcagaacttcaaacagactagtgctgtacagggagcctcaacggcagctgctaataagctagataagaaccctgctaacacatctactatcacaactactgacccagtggctgcgaaggaacaagagaaagctatccaaaagaaacctaagactgactaggaggaataacaatggcacgcaagaaggataaagagaaacgtcaacaggaaattgaagacgccttagttgctctcatgatcgctcagaaccacaagtaccatagattcactgaccgcttcactgtccttcttgatggctttgttaatgagcttatagtaaacctagctgaccctaagttggatgcttttgcaatccttcaggtgagtcagtatgaggctatcagaaagcttcaagcagcattgatagactatcaagaagagttcagggagatgcttttagagagcatgtcagacaccttagaagagaccttgggacagctttttacaaataaggctataccttcagcgacagataatgcctacatcgaacaagttattgcagaggcttacgactactttgaagaaatcttcttgcaattattagtagagattgaggccatcgctgttggaactattccatcaacagaggacatcgtaaccactatccaaaagcttcgagatagattgtcctatacactacgtcgacacattgaagctcaaatgtcggcagtaattaacctcgctgttatcgaagcttctaaacagcatgagattgaattatggaaatggtgcatccgtccagagcttactgaaagcggtacttgtgcagattgccgagagcttgctgaaggaggtattggtaatgagggtctatataccctagccaccatgcctttgctacctagacatccacactgtgtttgcatcctaattccatacgtcttatagagcggtaatgttaaagggcgctcaagaggaaaagaactttacacaaactaatctaaacgcacgcacagggcttaattgaactgtggagggcagaaggagaatcttatattatgaatccagaagaacaaggacaaggacaacaagttgatttgacaccagaggttatcgttggagctattgaatctaatccagaattagcacaagctatccaacctcacgtcttaacgaaagacgcagtatctagtttcttaaagacagacgaaggtcttggcgtagtagcccctatgattgaccaaagcgtttctaaaggcattaacgcttggaaagaaaagaacttagagaatatcgttcaagagcgattggctgagttaaaccctgctgaaacacctgagcaaaagcaattaaaacaaatgcaagctcaaatggcagctattcaaaaagataagcaaatgttggaaatgcgtggagtagctcaagaagctttagcaaaagctggtttgcctgcctcattagctgggtacgttttatcagacaatcccgaagccgttaagcacaaggtttcagaattagatattgaaatccagaatatcgtttcaggactagttgaccagaaggttgctggaatcgcagctaaagcagctccaacaaactcagacgacatgtcaaacattggcggttctaaaactgtagaacggttaacagatttaactgttgaagaagcgacagaacttgctcgaactaaccctgctaaatatcgccagttggttcaacgtggataacaacagataatcatataaactataaactattagaggagactattaaatatggcacacgaagtaactaaaatttcagacttaattaatcccgaggtaattggtgcgttccttcaccagaaaatgttagacaacttagtattggctccatttgcagaaattgaccgtacattacaaggacgtccgggtgacactttaacagtaccacaatggaacttcattggattagcggaagacttagctgaaggtgcagaattacaatcagttaaattaactgctgctgaacgtacagcgactgttaaaaaagttgctaaatcagttacattaactgatgaagctgttttaaatgcttatgttcgtcctgttgatgaaacagttcgtcaattagcaatggctatcgcaggtaaaattgacaacgacttgtttgcagctatgcgtgcattaactccgtcagatgttgaaatgactgatagctacgagtgggttattgatgctcaagtagcatttggcgaagagtttgatgaagaaacttacttattcatctcacctaaacgccgtgcaacaattttgaaatctaaagacttcattcacattcaacaaggcgtgtctgtaatcaaaggccacttaggtgaaatctacggaatgaacattgtagtttctaacaaggttggtgaagacgaagcgttcgtattaaaacgtggagctttatcattaattatgaaacgtgactacatggttgaagaagtgcgtgaaggtatgaaacgtcaaactaacatcactgctgaccaacactacgtagcattcgttaaagatgctaaacgtgcaatcttcatcaacaaggtagctgcgggaaagtaggaggaggtaaatatatatgtcagatacaatgatcgttgttgctacaccaacaccaggtttctcatacgcttcaggtttaacatacggtggtggtgctttcgctggtgctccagctaacggtccatcagaaggtcaaatcttcttccaaacagttttaccagcttaccaatcaccaaacttatgtatcggtcaattagcttggatgacagattacatcaacaaaaacggtgttggtaacccaaaaacatgggaagttatctcacaaaacgttttaatcttctgttcagctgatacagctttagttttaaacccacgtatcgctgtttacgatggtttccacaaaacaaaatgggctccagctaaattcaacttcaaaacacaatcacaagaaaaattctcaggtaacgttacaacaccaatcgctgctttcggtcactacttatggggtgaaggtaaaccacgtacagttgatttatcatcagttggtttaaaaatccaagctaaccaaatcgatccagttatgatcgctgttaaaaacaacgctgctggtacataccaaatctcaggtaacttcaaccgtaacacattcatcgatggtgatatcccaggtttatacttaggtaacatcacaatgaaaacagaaggtacattaaaaatcgatgctaaaggtaactggaactacaacggtgttgttcgtgctttcaacgatacatacgatgctaacccatcaacacaccgttcaaaatcagctgaagatttaacaacattattacgtttaacacaaggtacaccatacgaaatccgtatcccaggtgaattaaaagtttcaggttcaggtaaaaaataacagcccccaagaatcttcaatctagcggggttactgaggactcagttactctgacttgggaagacggaggggcaagcctctagtaagctaaacgagaggttgcggaaacgttccgtgacctcttttactttatcataaatcaggaggaaaagcaatggcaaagacttataatatttaccaagatggagcgaaggttcaggaaggcattgcagagttaactaaaaccattacaggccttacgccaaacacttcatacaagtttgaggtaacagctgttgaggacggcgtggagagtgctaagtccacagcggtaacagccaaaacaaacccgcgtaaagtagctacagtaacagcttctcaaaagactatgtctctagcttctgacggaagcaaagcattgactttcacagtggctccagaagatgctactaacaaagaattagaaatcactaacagcaaccctgagtttgctacttatgcagacggtacagtaacagctgttgcagaaggcactacaactatcacagcaactgctaaagatggttcaggcgctactgcaaactgtgttgtaactgttcaggcaccagcttaataaactatcccaaggaggctgaggcgaatcgccttggtcttcttttaaggaggaagctaaatggaactaattgagaacacggagttgttcaagtcgtttgaagacgttaccctaccacctgaaacagaagctattgacatcaccgacttaaagcttatgcttggctatggtaacagcactatccgagacaacgttctgaaggttttgaagaagcgtgctagacaacatatatgcttattcattaacaaggaagttacagcctttccgatggagttggattacattgctgacgagcttaccgcagggcgtatgtcacagcttaactcagaaggccttaaaacagagtctactgacatcactcgttacgactataaagatgacatctacgcaaactggtatgccattcttaaccgctggctaaaacagcaaggagagtatcgcaacaaggcattattcatgctttaagaaaggagcttacaaatgcgttataacgacattgtggatttaatccaatttaatgattgggacgaccctgacgacgactacggaacaatctcttataagactcgtggaacaatcgttgttaaagaccttcctgtaagtgtaggctccctacgagttcaaggaaagctattgcaaaaccaagaccaacagtgggagaaacgctacttgatacagcataaagtattcgagttaaagaaccttcgggtagacgctgtccgacgccactccacaggagagattctaaatgtctattgggataacactactggaacagaccagacagtttcttataaggttgagtacagagacatccgaagagacaaggaggacggagttatatggcagggttcttagaaataactaaacgaatcgatttcgcaggcttagagagagagtttgttaatgaggtgaaaggcgttgttgaaaagaactccgcacagatggctacagctgttagatttaatatcgttcgtagaggcaacgtagacacaggaacttactacgatggaataaagtctaagacggaagtagaagggaagggtaaaagcgttacaggaattgtagagtcagacgtttcaggaaacccttatggacacagaggttacgctgtttacctagaggaaggaacttaccgacatcaagcattccctaactttacagacgctttagaagagtattctgatattcttgtcgagcagcttagcagaatcaaagtgtaggaggaattatcaatgagcaatagaccacctttccgtgcaagaagttcctctgtagctttgcaaagggctatcgtaaaggaaattagagcgcaaggaatcaatgtctgggacggtactaataagtttccagaatatccattcattaagattggtgaggagctaacttcaggtagaacaatctctaaggatgctatcgggaagatgcacaacctaacccttcacatatggagtgactacgacagctcttttgaagttaagagtctaaccgactttcttgtagacttacttaccaactctcctcttaacttagaggacggcttctgtattggagagaaatccctcgaccacgttcgttacacagaagctgcaaacggaacttataaaaacgagcgtgcatatctattcttagacttcgaggtaatcgactctacgatagagccataataacacacataaaggagactgacaaatggaagcatgtaaatctagctacattcgtggtacagcagtattaattgaggttcagaatgaccttggcgaatggattaaagtagcagcacaacgaggaggtacattaaaccgtacagcagcaaccttagacgtatctaacaaagaaggattcggatgggacgatgcagaagcaggtaacaagtcttggtcaattgactgtgacggattgttcgtagaggataacgctggtttccaagcattgaacgcagcttgggttaacggagattgtgtacgtgttcgtgttaaattccctagtggattaacttatgtaggacaagcaatcttaactgacttcccttacgagtttggttacgaagatgccgtgacttactcattaacattccaaggtaaaggcgctttagaagagcaacaagtagctcctacaatcttacctaagaaagttgagttcacgaacgaaactaaggaagttaaagttggagaaactcttcaagctacaattaaattcactcctgaaaatgtttctgacaaatcagtaacttacactgccttgactccagctttagcaacaattgatgaatctggtttaatcacaggcgttaaagaaggtactgcatcattcaacgttcgctcaaatgtcaacacagctgtttcagcattgattgatattgaggtaaagcccgcggggtagtagaagccccgaccgagctttcggcaagtagcgttagcgaagactcagtaacattaacttggaaatagactgcacagagggggcttgggataaattcccttgccctctttttacataacaaatataaaggagattacaacatgattataagattccaaggcaaagaccttaacctacgcttaacatacaagtctattcactttctggagttagcctttgaccaagactacgcttctttcatcgctgagcaaacgcctttcaaccagtccttatatatcttctgggcaatgcttcagaacgagtctgattacgaaggagtatccgtactagatgtagcagagcttctacaagactctctggatagctatgagtttaccttagaagaatacttcgagaaagttaacagctcgtatgcttcaagtattttagttaaacagctattcaaaaacaacacaagctcattacccagaggaggcggaagacgaggacgagcttccgaagctagacgtaagatactttatggtattgtgtacagacttaggaataccttccagcgacttttggacaagtacaccatatgagtttaatggaatgttacgaggagcttaccaaagacaatcaagagaagcttcgttattcctttctctagtgcaatctaagaagcctgtcaaattagagaagtaccaaggctttgaattagttaacgaaaccaacaaacctaagactactagagacatggcggaaacaatggatgaacttgatagagcagcctttaaagaggaagagctatctaacctgttcgactactttgactaggaggaaatttaaatggcagataaggaaatgcgaattaaggttagggtagacaactctgactacacaagtaaaatgaaagatatggagggcactcaatcacgcttagggaaaagcactgagcagactacaggaatcttcggtaagttcttcaacaagttaactggtggtgcgagcttagctaacagctctatgctaggacttggtaaaagctttctatcaaccagtgttggattcggtactctgacagctgctgctacacctatggccgctgctgttatgggagccgctgaagctactaaagttgcaggacgctttgcgatggattccatcaaggactatgctaactttgaaggaacacttaaacaagtacagattattgcaggtggtactcaagccgacatggacatgctcggtgacacagctatcgaaattggtggtaagacttctaaaggtgctcaagaagttgctgaggccatggtggactttgctaagctaggttttacagctaaggaaacttcagaggccatgaaaggtatcgtatacgctgccgaagcttctggctcaggtgtacaagagactgctggaatcgtagcaacagcgcttaacgtatggaatctggaagcctctaaggcagaacacgttgccgacgttttagctaagaccgctaacgaaacggctgctgacatgcaggacatgggatacgttctacaatacgctggttcatcagcttccctagcaggagcttctctggaagacctttcagctatggcaggtatcatggccgacaatggtattaaaggttctaaagctggtacatcacttcgtacagcattcacaaaccttatcaatccaacagacggtgcggccgctgcgatggaaagcttaggggtacagtttaaagatgctgaaggtaaggctcgtcctacaatggatgttatctatgacttacaagatgctgttaaaggtatggatgatattcaaatccaagagctttcaacaatcctgttcggaaagcccggggcggctggtatgtcgttcgtccttaaatctactaaagagcaagtacaagacttatcaaaagcattagtagactctacaggtacagctgctaaacaggctgctgctatgcgtgagactatggcaggtcaattagaccaactaggagactctgtggacgccatcaaattaaaaattggtagagcgtttaccgacatgtttgcactagacgctgttaaaggattcaacaaggctcttgatggagttgatgaaggcttatcaaactttggtaaaggcttcaagcgtacaagcgatttactagaaacttctaatggattaatctctggtactaaggatgccaacaagtttgttgaagctgttcgagatgcaggtactaatcttacaaacattcctttccaagagtctttagcacagtctcaagtatggggaatcggaatctctaaaagagcttatgaaactaacgaggttatgtatcagcttaacaaaagcattcaagagttcagcttcctaccagatgactgggaaggcaagtggggacaggcttcaacaatccttaaagactcagtaggtcaaatggagttgaaacttgcttcagcagcggctaaaggtaagcatggtggagaagccgatatttcaggtattatgaaccagactatccaagagaatctacctgccttgcaagaagctttaaatgagcaagtagcagttttcgggacagctaaccaaagccgtttagatgccttgcagacattcttcactaacgagaagactttaactgacgagcagaaatctattatgatgcaaggtgaactaactcacggccaacagctttccgataccattcaaacaaataacaacaagattttagaattgtatcaaagcatgggtcaacaggattatgcacagcgtcaagagactggtgccgctataaatgcattgcaacaacagaactctgaaatcctgcaaaacatcgctacaactgagtcaagtagtattattgaaacactgaaagcacaggctagtagcactggaacaatcactcaacaaatggccaatgattctattacagccgctaatcaacaatattctgaaactgtagcagcagcctctaaacagtatgttgaaactgttagttcaattaaccatatgtcagatgaatctatagctgccgctggaacaactagggacgagcttatcgaaaaagcacgccaacaaatggttggaacagtagaccatgctaagactcagaaagagcagacagtagaagaaatcgagaagattgctaaaaagtctgaggaagttgatgggacacacattcaaataaacgctgacgcagatacttctaacgcaatggaagagctcggacaattagctgctagaattaacgacgtgtttagagcctttggagaaactgcgggtaagattcaaggcggtattgatggctttgaaagcaagcttagacaagcggataaatgggttgcaggaaaggttggcggaatcttcaaggctcgtggaggacttacttcaggcgttggttacggaattggtggaggcaatgcacaatactctccaatggctaccgcagtaggtgtcggaacccagctaggacagggcggtattaatcagggcgtaatccataacgaacgaggaagagaagttacaatgcctattcaaaacgctacttacatgagacctttcgcagcagctgtggcaaacgagctgcaagcaatgggtgaaggacttggtggaggaagcattcctgaagttatcgtgccattgtacatcaacgataaagagtttgcgagagctactaacaaagctatgacagaggaacagcaacgtgttaaacggattgctaaccgagctgtcggtaaaaagtaaaggagacgtttaaatgacctgttctaataaacctaattatacaccttttaaattacaaggtctagcccccactaagcagtggggattaggccgttctgcaagttatgaacgatttaacccaagcgagttccatgcgctagaggacgaagttaagattacatttccagtagactttagaggaaaggttaaaggaagcaatacacctaacccttcacgaggatttagccacgctagtcaaatctatcgtgagaacgtgttaagaggtagccaattcctttctaagccttctttgctttttaatggagctgtatacaatgagaagacagtctacaatggagctatggttgcttctactcaagaagttaatcaaggcttgatgttctattgggaagactttatcaatcctgacccaagaattaaagaaggggatatggtaaccttctcagttgatgtacgaagcactggggaagatattccgacaggggctgtggccttcaaagggacttctaactttgaggaatactataaagtccttgaacagcctatcacaaaagagtttacaagagtatcttttactacacgattcttgtctaaggactgggaatgggacgaggcttttggaatgttctggggagtagagaatgttcctgttacagactatccaatgttccaatatgacaaggataagttagttggttttattcaggctcaagaaagtgttcaactagagttctcacggcctatggtttcaactatcggaaagactgcttacattgagtctggggacgacatgttctctaacaacaaatgggactggtctaaagccgtatctaaaggccgtttaaatgaatttgatggtaagtataacacaaacggaatcaaacaagactgggcaatgcctgagttcattcctattttcaaaggctctgagagaatccacttctacaaaaagactaccttaacggaaacaactgacgctggacatggctatggtaaaatcctattctacagcgctgctaacgaggattcttacatgaacgtatataagaagttccctcacgaggctggtgtatatggtggatacgcagctgaagtagaagtgcctatcggagctactcactaccgtgttcatataacttcagaaagaggaaaggccactacagaagcctatgtacaatcttctgctaacgactggtcagagtttagtcaagagtggtacgacggactgtcaggaaagctagatggaaagactgccagagctgagacattctatcgtaaagaaatggttgagatggagtttgagctacactttgcagaagctgtacagaaagctttaccagacatctttaaaggccttactactgacgctgagaagcagcaaagacttcgtgacattgcttatcaattcgattcaacaatgattgcacgaggccgtggccaaggcaataacttagctgattggattttctatagatgggctcctgacggctctattgaagagcagacaatgaaacagtttagaggtgagggattaacttcagttacccatccatcaagctatcaagagtggattaatccacaaggtaggattgtaacatctcttcgctctaaccgaatcattcctaactcaatgtacatgggaactgatacgctaagcggtaagtatgaccctaaattaacaacgcttcagctagaagttaatggggagcttgttgataagaaggctaccttagataagacctcagaggtatttacatttacaggtcttaaaggattcttaaagcctgaagataaagttaggattgctggatggattaatcgtaacaaccaatggtcaatcacctactctaatgttcttatgggaaacactcccgaaaacgttgctgagtttaacgaacgagctttcgtcgaagctgattacctagttacaaacatgtctattatcgtaactcaatcacagatggatgaatggggatttaaccctaatctaccagactaccgaattgaatcattagaacgtccagcaagtcgtactgaggagtatatgattaactcaatggtacaggtaacacatgcttatgacatctacggttttgttgaaagtaactaccctgagtttttcggtgactgttacacgttcgatgatagaataagaaagattaatgaacgcatcaagcagtttaacttagtggctactacttattcagaagagccttgggaagcaggtaatcctacaatcttcattagtgcggaagctaataatcccgacagagactacgatgttaaagcagagataaaccaaacagttgaactacaaattaacaattctaagggacactttatccatcctaatggttatatatacgtgggatttgcaagaatgcctagaagcgaccgtgagactggaatatccgttgactctgagttaagctttgagttcacgatggatagacagtacgacagccttccaagagtattccgctacaactaccagaaacagccttggttcttgtttgtaagaaacattaacagaagtgttcttgcgcctaaagtaaacactctaactcctattaacggaggcactagacgttataactttggagctacagaagacgctcggtatatctcaatggactgcttcatcaaagctcctgcggaagaggttatgcctaagttgatggaagagcttgctgacttcctagacgttggggaaacggtaatccaattctctgataacaaagaccgttattacaaggttatgttagatggctcgacagacctttctcaaacgcttcatgtaggaacgttgacgctgactttcgtactgcttgagaatacagccatcggtgaagaggttgtagaaagctttgacatagacagtacaactggttcagttccattcatcgagcttgagaacatgggtacggcggacgcttaccctacctaccaactgacctttgaagagcctgtaggatatgttgacctaatcggtacagatacctcagccaacgtgtcaattggaagacgtcctaaagatactgaagacgaggttaaggtagaccttcgtccacgtaagttttacagtaagtttacgtctacagatggagctggttggactgccatgaatgacacacagcttcctcaaatcgaaggataccaaactaagcttcagggaactgttcaaagagttaacggaatggccaatcaaaacaagtggaattacggagacactagccacagaggatggcacggagctggtatcgtagctaaccttcaaaagaaccttgacgacttctatatggaagcctctatcgtagctacaggaaagccagttaaaacttctgctaatgctattttcttgatattctatgacgaaaacaacaacccatatgcttacactaaggttggtacacggcctcaagagggtaacttagacagctacgtagcttacgcaggtgactggggtaaacgtaaagtagttaacaatggagctaagtggaaagacttctggggtaaggtttctgtacagcgcagagataaccgatggagacttattgtaggtaaatacaaagaccgtagatacagtccttcacctgaagcttcattcaactttggtcagaacatgttgaaagacacaagagacacaggatggttcgacttgcctcctgaaacttggggtaagaagtttgcaagggttgggatattcttcggacagtattcacatagacctaagctaggccacttatcagtacgtagactaattgtgtgggaaaaccttgaggagtatggagaaactcctttagaaggaactccaatcatgttccatgaaggtgacacagttgtaattgactcaagcaaagctcaaacataccttaacggagagcttactccatcacttgtagaccctatgaccgactggttcccaattaccaaaggtgataactacattggagtaaacaacttcaaaggcaagattgacatagtatataacgaacgatttaaataaggaggaaaaagtatgattacagtattaaacgcaaacggacaaacagtagcacactttgtcaacaacgttagcgaaggagtaccatactttgagcctactttgacggagaacatagagacgttggtatcaacgttctctttctctgttcctttagactgtgacgaaagccagtatttaaaaggcttgaataaagtattagtaaaggataaggacggagatttaagacagtttaacatcatccacactgaagaagttttccaagaggttaactcacgtatcttagtggaatgtgaagacttctcaattagtgagatgaacgatactgtaatctatcctttcaatgggcataatttaggagacaccttaacaaaagccgtaaagggtactggatggggagttgagtattcggcagacacttggcaagaaggagaagagcctttcatactagctgagtatacgaacatgcgagaagtgtttggaaacattcagaagacgtatgacgtagactttaaatttacagctgagagaacagccttcaaccaaactaaacggattgtcaaagtgtataaaaacagaggtcttcaaacaggccgttacttcacctatgacagagacgttctaggaatcactcgtgacgtgcagtatgatacaatcaaaacagccatcctcccttactacacaggagtcgatggaaaagtatggacgcttaaaggaatggttccagttaaccctatcgaaggcattaccaaagataaggaaagccctttggtagtccacaatcaagctcatgcagactatgacgaacctttcttcttcaaagcaatgcctttcaaagctgcatcaacaaaccctgagcaagtatatcgacaaggtgtagaagagcttttaaaacacattgcaccaatctatacttacactgttaatgtaatccttctaaatcgtgtccaaggatgggaaggggaaaccttagcacttggcgataccgtttggatgaaagagcgtgtaggctctcgtgaaattggattggaagcacgtgttattgaatacatttatcacgaagacgacccaagccttgatgaagtaacctttacaaacttccgtgaaatagacacttacgacacctctgacattgcaggtatccgagacgctttgaacgaccttaaagaccaagtaggctctaacacagttattattgaaagcactagagaacaaatcagtaagcttgaagaaggtcaggcaggaatcataacagaccttaaaggaaagaactccataagcattggagacacacctaagccaaatcctattgacggcgatacatggttctctacacgtgttaacgaagctggtcaaacaatccatgagattaaagtttgggatggtgttgagaaagtatggaagctttcaatggatactgagaaagcattccaagcagaggaagctgctcaagctgctaagaaagacgctgaggaatctcttgataaggctaaccaagctgtagctgatgctgacactgctaagacggctgctcaagaagctttagatagatacaataagcttatgataagcggacgtaaccttgcgctaaactctcaaaagattactattccagacacagatggagctactagcataaaccgtcgcaaaagcattccgttatcaattaaattaaagcctaatacacaatacttgctaaggtttaaatacgaactagaatcaggaactcttcctgaggatattacagtggtcttgtggcacggctctggatttgcctctaacatagtccatgttccaactaaagcaaataatgttggggaaggttcagcaacctttactacaaactctagcgaagctaatatattgtttatgtaccaaggtaaacgacttgaagttaagcaaggagataactttgattttacagaagtctaccttgtagaaggtgataagataggcgactggcaaccagctccagaagacgctattgcaagcattacaaacatcaatggtgaaatcacttccctagtaactaagacagatggattggaaacaagctatagccaaatctcacaaacggttgatgaaatccaattaacggttggtgacaaagccgataagagtcaaatcacacagcttcaagaccagattaacttacgtgttgagaaagacgatgtaatcaaccagattaacgtttctacagaaggcattatcattgatggtgcaaaggttcagataacaggtaagacttacattgaggacgctgttatcacagacgctatggtagctgacctttcagcaagtaagcttacagcaggagttatcgacgcctctaaaataaatgtaacgaatatcgatgccagcaacattaaagctggtactatccaaggtattgacataatcggttctaagattactaaccctttctcaattggttctgaaggctatacgctagtcggtcagacagtaatggaaagagctcaggttaaaatcgattataccgtatctgaaactggtcaaaaaggttggtcaatacttcatgcaagaggtattcaaaatcagctgcttaaccaagacggtaccattaactcattttcatctcttgcttcagacggattatctattcaagattctttaggaaatagaggttacttatcagccgagttgctaatgcagttctctaacactggcaagaagatttaccccggaaattcatgggtaactaacactgatagaattgtaccatcattgacaatgaacaaatgcgctattggatggctgttcttatggcaaccttacgatactactggcggtaagccttatacatgggactatacttactatttagttcctaaagctcatgctaactttaacaatggtaaaggtattaatatgcggctacaaggcgcaggtaaaggtggaggagcagatgatactgtgtataaatatgtatacgtatctaatgactctataacaggaacggccaataatggtactgggaatggagctagatgggttcttaccagtgtattttcagtttaaaggagggattattgtgagagtttggattgaggataagataggattcttaacaggctacactacagagcctatggaaggttacaagtgtgtggagattgacccttcagagtctttagaaatgcttggtggaatgcttgatttccacaactactactatgatggtgagaaagtatacagagacactaacaatgacttccagaagttcttagaagaggaagctaacaagcctcctgaaccttctaaggaagagatggcagaaagacttgctaagttagaagcacttttagcagacttgctataaagctttgggtgggttgtgggaataatattagaaaggagattcatacatggttaaagtaaacgatgtagtaagctatgtcaacggacttgtcggcaaaggtgtagacgctgacggatggtatggtactcaatgtatggacttgacagtagacgttatgcaacgcttcttcggatggcgtccgtatggtaatgcgattgccttggttgaccagcctattccagcaggcttccaaagaatccgtaccacaagctctacacaaatcaaagctggtgacgttatgatatggggcttaggatactatgctcaatatggtcacacagctatcgcaacggaggatggaagagctgacggaacctttgtcagtgtcgaccagaactggaataacccaagccttgaagtaggcagtccagcagctcctattcatcacaatatggatggtgtatggggctgcatcagacctccttacgaagctgaatcaaagcctaaaccacctgcaccaaaacctgataaaccaaatctaggacaatacaaaggagacgatgatattatgttcatctattacaagaagactaaatctaatactaccgaacagtggttcgtaatcggaggtaaacgtatctacttaccaacaatgacgtatgttaaagaggcgcaagatttaatcaagcgctatggtggaaacactaatgtaacaacctataactatgataactttggattggcaatgatggagaaagcttacccacaagttaagttataagcctataagaaaagccccttggaaggttactccaaagggctttttatattacaactcaaagcattctttaagcttttctaaagctactctataagctatcctcatgcctttacccatatctgactcctcgtcagcaaggtaatttaatctcctatccaagtctaagacaacctcggccaccttctccttgttaatggagtctacagcttgcttatgggaagcttctttaatagcatccacaatgatattgaaagggtctttcggtaagctgcttccaagggttatcttagaacagtcgtcagtatctcttagataaacttttggtacatctagctttatgaagttatcattacggtagtttaaaataggtcaacaacctcctctaaggtatattcagtctgtggagtggcttcgtcagcagccttctgttcagctttctctaaagctacactcatgaagcgttccatgtaaagtagtcgagcctgactgtaagaaagcgttgggtacctcatattgcttcggtagtctgcaacagccatctctaagaatatgcgcaaagcggtgtttccaaatctttccatatccttcttcataatagctcttagagtctgtagtgaagcattaataggagccttaccaaacttctgcttattaaggtgttctacataggctaggaatgtagttgtattccaaagactttcatcaactttccaccaatcctttgtatcaaccttgttcccctcggcgtctttataaagcttgttctctttggttctaatccatgccatcttaaatgccctcctcgtgctcgtctaaatacttccaaacgaatcccttatgcttacctcttcctttagtacagcatctactaatatgtgattgctggaatccatctgcacatgcgtctgaagccttattgtatactaccatttccccagttatctcattaaatcctacaacagctcttccctgtcgtttatacaaagttttcataataacctctcccttaactatttgatgaaccaatcatatcacgtattagatggaatgtcaatacctttttaacaactctcacgaaaaagtttcaaaggcgactgaaaggagtctttaggctgtgagggaactttccgaacgcctttatattatatgctatagctatccttaaaccataagaccttacggtctttaagttcaagagcagcttcgttaacactcagctacaacctcctaaagtcggttgtgaaactatttaataagcttctctttctctctctctaaagacaagtataacatattcctaaaaatgtgtcaagtgattttgcacaagaacttttgtggagttgttaattgtaaggttgttgaaacaattgtaacaaaactgtaataataaactttaacaaatgttcaaaaaggcttgacttatactttataatatgctatactaatgaagtagtaaagatgaataaagaacttattaggaggaaattaattatggctaaaggtttagaagcaattgcacaggcagcacaaacgcaatcaaaaggttctggtgagcaatccaaaaagacttaccttaaaaaaggacaaagcattcgtgcgcgcattccagaagacatcttagaaaacttacacgtaaaccaagtcgtttcagtttttgaaccgcaagtgttaccaacattatcataccatgcagaaggacgtacagacgttcgtgacttgtatcatgaagctactgaaatcatgttagcagaccaccgtgctaaagttgaatcaggggaaattgaacgtggttctcaagctgacaaagactcatataaagcagctcgtatcttaactccaaaaccacttatcttattcggtgtaattcctttggcagacttcacacaaggcactaagaaaactaatacttacccagctggtgagccaatcttattggaaactaacttaggccgtgacaacgctaatatcgacgccttaacgaacttcttatcaaaagaaactaacgctaagaaattccctaagaaagccttcgagattacttgtgaggcggctaatcgatacactttcacaccgttagatgatgaagacttaacgcctgaagaattagaagtattcaaagctacagaaggcgctacagtccctgaagaagatttcgagaacgcaatctttgaaagcactattgaacgccaaattgaagacttgaagaaaattggtttcgatacaactcgtttaccaaacttaccaacagctgctccagccgctaacaaaggcgctgacgaagttggtactgtagacccttcaggaatcgatttctaaaaactatacgaggggcttcggcctctctcctattatagggaggacataaagcatgaagaaagacacaccaaaagtgaatccaattaagtttaccgaagaggattacttccgcctgttacagacagtcgttatgacaaacacattcatcggctctctatcagctggcttccaaggtaaagaacgcttagagaagattactaaaatcgctgagaacatgtttgttcttaaccgcttgatggaatctgccgaaagcaacggcgaagactggggcgacgaaatgttgttagactcattatacacggattcagaagtgcttgtaactaagtataaacacttgctgtcagaagaccagttggagtctatcaataactctatcaaaaactttgcagaatcagccgagaaagctcgcaaagaagcctacgaagaaaaggttgcacaagccgaagtaattgactttgaaaaggccaagaagaaacgaggcaagtagccatggatagattagagttcttcacgaaagtaattgcaatgccttttgatatgcaagaggttcccatacatcctttagcaattaccttttcagacacattttaccaagacgactttccattaagtcagctttacgacgaggcaattgcagaaactttgtggaacgcttcttacaaaataatccataatgaaatggccaaggctaagtcggtaaaagtattaattacaatcttcaatccgaacaccttgatggaaggaacgcttgtatatgaagctattccagaagacttgcaagtagctattgacacaggagtcgtagaagacgttgagtgggaatctagtgagtcggtattccaacacgaccttcattacttctttaaaggatactaatggattactcaaagtttaagttaggcgatacagtaatgtatcagggacagctttgtggagcaggtactgttatcaacggcaatacctacactgttgtacagcttaccacaaagcctcgacacgcctttatcatagatgaacatggcaacaagaagcttatccaaatggggttcaacttcgctaaaataaaagaagcttaaaaagtgttcaaaaacgcttgacaaaagcttttaaatatgatatagtattatatgtaaggcggcactactacggtttgtcgtaacatagttcgggatgcttctcggctatagcggtctagggctacagattgctcccgcctgtgggctgctgtaaaaggcagtaaaaataatagcaggagtacccacccttgaggggatgagagggcgtagcagaggcggtgacgactgcctcgttcatgcgttgtaagtgtaatggctgcacaatggtctccaaaaccattagagagggttcgactccttcacaacgtgttcaaataagtcttatggaggtttgtggaatgactactgaaagtatgaaaagtgagaaagcttggaaccgtgccattgtgaaagctgagcaagaagctgctaagaagaagatggagcgccttgctaaaatgcgtgccaaaagtaaacgtaaataactccattaagtaggtaagatggatttcttatctgctattacataagggactaaccaactgcggaggagagttagctactttccaaggccttgccgaaatccctaaccagtcagttagcatagtttaggttaatgcgcaacagtcttcctatagcgcttgtcggaggctgattgagaaaggggttcgaatcccctactggcgccttacatattcccaataagcacttcggatagatgccagaagtgttccatggagggttggctaggggaacgctcaataatcccttgctgtaaagcttattccgtagcgtgctaaaacgactaggagcggagctacatgtgatttataggagggcagtagcagtcctcagctaaaactagctacactcgtgatggaaggcgaggtaagcgccttggccaaaacattacccatggtggagtaatccacttaggagagcgtcgtacgacaaggtgtccagccaccttataaaagggttgaacattaatgcacgctgttaaccaaggcctgtagggaggtcaccaacagcgcattagccaagaagtccagagtagctccctagtgaagtcttctgaagctggagttggctaccagcggccttatattcgggatacagaatgttgtcccctttggataagttctgtgaggcggttcgattccgtccataaggcattggctgtttatcagctcattccaaaaacctctttcataaagaatcacctcctttcgattagagcagcttaacggctgttctttttttgttaaaaaggccttgacaaagttttaaagctatgttatgattaattcatcaaagagatagaggagaggttttatgaacagtttaggaatatctaaggtaaactatgtgtgtagacactatggaggaacggttcttgaagacgaagttgtagagattgtcggagagtggactagcgctctaggagaccatattatggaagtattgccaatggattcagaatccagagatgaaacggttgttatcaaagcttataatatccatcgtatgaatccagaagaagtattgggttatcatttgaacaatcttgaatgtgacttattcgccaatgtagactatggaggagagcttttacagagtagtattcaaagctaatcaatatacttatggagaagatttaccagtatctcatttcacatcagtccgaatgcttagtaaggaggaatattaatggaaaccatgtacacagttatttataagaacgctgtagaaagtgagccagcgcttgagggaggaagcttcttaacggacactcctaaaacagatggattaaagcttatgattttcgggacaagagtatttgaagtggagtttattgaccatgcggagaagaaaatctacgcaactagaattagataaggagtggtaatatgtggaaccagtggacactttactggacggatagtgaaacatcagaggaaggtaacttcaagattcctcggccaaacgctttgtttattggaatgcctattgacattgatgagtacagatacactgtgacagctgtatcaacacctactaaagaggtttggacagaacgtattccattcgattttggccctaaaccaccttgggaacacaacaattaacttttaactggaggtttttaaatgcttgatgagacatggaagccaataaaatattatgaaggattgtatgaggttagtaatttaggtaatgtgagaagcttagatcgagctgttcctcattccaatggaatgtatttaagggcagttaaaggaacaactttgagtttatttgattcaggtagagggtatctaagcgtaagattaagcaaaaatggtaaaaagaggaataagttagtccataggttggttgcagaagcttttatagataatcctctaaacaaacctcaagttaatcacattaacgaagtgaggtgggataacaacgtgaataatttagaatggactacctctaaagaaaataacaaccatggttcaaggactttaaaagcctctaattccacaaaaaagaaaataaaagcaacctcaattgacggattagatgtaagagtatataatggagcaatagaggctgagcagctagatgggttttcttataagcaaatttcgctatgttgtacaggaagacataaaactcataaaggctttaggtgggaatttatataaaggggattttttaaatgcttgatttaatacatttatcaaaggatattaaaatacatgtagacatacaaagctttctaatggagtttgaatgggagcgggctaaatggacggaagaccgtttaatagcagcttcacctttcagggacgacaatcaccctagcttctttgttaattttaataatgactttgcaggaacttggggagactcagggagtggagagtcaggaaatttcatagagttagtttcaagattatatgaaacagattacgaaacagcttttgaaatgctaaaagaacggtactggactagaccttacgaagctcctgcaatatctgttaagctaggcgttaagaaagagaagtcaatctttgacatacctgtccataatccatctccatacctattaggaagaggaatctcagaggagacacagaagctttacagaacctctgaggacgagtataaagtatgtcttccatacattaacggaatgggattagcaacagctttaaaataccgtcggacagactctaaagacttcttctatgaggcaggtaacaatcatttgaaaagcatgttgtttggctatcacgcaatctatgaaaagcttcctaagactgttgttatatgcgaggctgagatagacgctatgacagcttatgatatgggattcgtgggtatttcactaggagctgctaaccttattgaaaaccaagtggaactcattaagaaagttggtctcgacaacatcatcataggcactgataatgacactaaaggaaacttagcggcagaagagattgaccaagccttttggaagactcataaactattccgatacgatatgcctgatggatacgacttaaatcagtattggcaagagtttaaaaaggctcctccaatccgtaagataagcgaacctaaactgcttagaagaaaactctggtgggtacagtaaaataaactttagaaagaggcttgacaaggcctcttttttatgctatcttaaaggagtagtaaggagatgttaaaatgaaattgaagaactataaaaaaccttggacacaagaggacatagattatttagaatggttctaccagaaccctgaagaaggctccatcaaaagcgttgcagagtttttaggaaggactcctgaaagtgttaaaactaagtattatgaattacgtaggcaaggcctgttagaatacccatcaagtattaataagaaatggactgaagaagagcgccaatacgtattagacaactatgggaaaatccctaacaaggaaatggcaagaaagcttggcgtaagcactgccagaatagttcagttaaattggtaccacacccataaaaataaaggcaatgaaggccttgacaaatagttacaagtgtgttacaatagtgaggtagaaatttttaggaggattccaatgagaaaacagacccttttggaaaagcttaaactagttacaggaaagacagataaagagctaaatccaactctttcacatatacatattcaactatgtggaggctctgggacaggtggtaagttcggcgccgctaaagttccatatgactattcagacaacttcttatttaactctcctgcaagagttacccaagagcaaatctacaagcagttagaagtctatgtaggaagcttcaagagagacttcatcaaagatggtaacgtaaaccaagatgaacggccaatcaagaacctatacttatggagtgagaacaaaggcaatgggaaaacttctacagcagctgccctcctaaatgagtatatgttcatgtcttggcaagcttcggtaatccgtaaaacaaacatgaaacaaccgcctgcctacttccttgacgtaaacagtttccaaacgctttacaataagtttactagaaatggaatcgcaaaagacattgcagaaaagacttcacgagagtattacgaaatgatggaactagctgagtcagctcctttagtagtatttgacgaaattggtaatcgaagcgctactgaagctttccgagcagaccttcacgacatcattaacaaacgaatggtaaacaagcttccatcaatctttacaagtaaccatccaattgactacttggaacaggtgtttgatgaacgcttagcagaccgtgtacgtgaacgaactatcgtgtatcatttcgagggcgattcacatagaggaatataggagggattaggatggcttcagtttcagctgagatgttattatcaaaggttataattgaaaacgatgtacaggctttaaatagatatggagtaagcgaggatttattccagtcgcctatccacaaagaagcttacaactacattattaattacagtagggaaaacgatggaaatgctcctgcttaccaaacacttttaagaaaggttcctgagttcgacttccaaagctctgcggaagagtcttatgcaagccttactaagagcttaaagaactctcgattacaagtagctacagctgcttttatcaatgctgatttaggagagttctgggaaaactcagtcaaaaaggacgacccaacagacttcattaatcagactatccatgccttggaaacaatcaaagcagagaacttagttaatggagctaatggacaccgccttgagaaggcctctgaatggtacctacaagagttctacgaccgtaaggaaggtaagtctgtcaagttctggaatagccacttcaagtctctaacagagcttattggtggaggctatcaatcaggaaacctttacacgatattcggtagaagtggtcgaggaaagtctactgtaatgctagttgaagcattagaagcagctatgaatggggctaatgttctttattactgtttagaaatgcctaaatacgagttcacttcaagagcagtaagcttcttatcagctcgtaaagaggttaagaaaagccgtatcaatggctcagattatctagcaggatttaatatttcagacattacaaaggcttcatttgaggacttaaacgaagaacaagatttcgttgactttgttaccaacttaaatgatttcatagaaggttcattcactttaagagcagtagacgacgacgactttgttaaccgctctgttgcccagcttgaacgagatatagtagaaacaggagcagactttgttgtagtagacccaatgtattatatgcactatgagaagaacacttctaaaacagcaggcggagacgcggcagaaacttctaaagcattgagaagacttgcaggccgtacaaagtctgttattatcgctgtaacacaggcggaggaagactccaatgaaaaaggtggagacgaacgcgaactaaacattccaaaacgttccaatgttaagaagacaatggcgttacttgaagacgcttctgtagtattggcttttgatagctgtgatggaagatttgctttggagattgttaaaggccgttcggggcatgaaggagaaagtgtcgaaggtatcttcctaccagtaattggatatgtagaagaatcattattagaagaagtaggaagtgtgtttgatggaatcgaattttagggaggaatttacatgattatttggtctttatttgatagtggtaacggatgttactcccaagtttttagtaaaaaggaaggagtggaaaattatagtataggaatggataaggagaaaggtactagcaagaaccaccttaatttagatttgtcggatttgagtggatactttggtgaatccaagatgataaaaagtcttgagaatttacccaagcctgacgttataatagctagtccaccttgtgaatcatggtcagtagcgagcgcaatggctggaggtaatgcttgttggaatcaccttaaaggagacccattcactatacgaacagccaaggaatatgaaagtgttcaattcaaacatgagaactcgttttataatagaatgaacggcgaacttacagtatttaatctcattaaaattattaaacatttccaacctaaaatttatataattgagaatcccgcttatggaaagatatgggaatacattgataaggtattaggatttgagttggagtatgaaaatttaacatattacaataactacggatttgaaataaagaaacctactaaatttaaatcaaatattaatttgaacctaaaatcagaaaatgttaaagctgacaccaaatttagagaagcttctaggataggtggctcgtacaatgtacggtctaatatacctttatccttagttgaggaaatatacaaacgaatcaaggaggaagccaatgagttattacctatctcaaatgaacaaccttaaagaaaagattcgctacgagaagacttctgttaagcttatccgagaaagcattgagcgtatcggaaagcctacaggagaatattctctaggctacaccgacgcattgaagatggaattactaatccaccagaagatgttagaagacgctcaggaagagttattgaagcttgagaaagagcgtaataaataacaatagtgttcaaaggggcttgacaaaagcccttttttgtgttatactagtcaggtaggaaggagctaaacaatgaccgtaactaatgaactttggaaacctttgatattcaagggaatccactcagacatttacgaggttagttcagaaggtttagtaaaaaacaagttgactaataggttattaaagccccaagactctggctatttacatgttagaatacctcttgacggcaagtattataacgctagaatccatcgaattgtcgcagagaccttttgcgaaaggcctgtgggatgtaatgtggtaaatcacatcaacggcaataagaaggataatcgagcagccaatcttgaatggattactcaaagagataatgttatccactctataaggttacgtgaagaggaatctaaaaccctctctatgattgagaaaatggacaagcttctgggaaaactattatcgccagaggctaaaaaagagtttatggaggaatttgtaaatggctaaaggactaaaggcaattaacgaggcggctggaaagactctagtagacactatcgcagaggactttgaacgccaattaaataaatggggagcaactggttatacatacgatagcgacgtacatcaccaacttatgcgagactatcttaaaatagttgaccgaaacccttttgaagacttcccagaaaacgttccagtattccgttcaagtggaactggtaaatgcttacgtgaacagactttgttcgctattgataagcttgaaggaagcgaccgaaaagaccctcctaaaatgcagtctcaccaaagccgttgggtacagattggaaccaaggtaggggacatgattcaggaacaagtcttaatgatggagaaacattaccaacgctttactggagaggagtgccacttccgtttcgaacgtactgaagaaggcttcccacacttcgaggagttctcaacaaccttcaagaagtataagtcaggccgtatggagttcattacaggaggctctatggatggcattatgatttggactgacccagccactggagaagagtatcgggtaggccttgaggtcaagtctaaacaaactactccagcagctactagcaagttctctatgagacagcctaactcaaaacacgtgtggcaggttaagaactatgctatgttaaaagacttagacatgtatttaattgtctatgtaaactgcgctcacaagtcttgggaaatgactgaagaagactatgcgaagaatccagacttacaagtattcggtgtagatattaccgaacaagataagaaagacgtccgcaatcgtttcttcacagcgattgaacatgctcatgcaggaacgcttcctccattagagcttagtggatttactttcagcgactataaatatgccttggcaaacagccttacttataaggaattagaagagcttgagaagaaagctgtatctaagtttgaccagaaggccttagaagaaattaagaagattagaggagatgttaagtaatgaacgaaagcatttatgatggcattccagagttcgacctaaagcctgagatatatggagttgtaattaacttctattgtaacaaatgtcagaaacctatagtaatgcgtttggacgaaccatctttagtagctttggatggaatttaccaagagcgtttagcagatgattccaacgtaatcctagaagactgcgtgtcaggctatcgggtagcacttgacttacaggatgttgtgacatatgcctctaaaaagcttgacagagcggatatggacttctcttggagtacctttattgattgggtagacgttttcacagagactgaaggaggagattaatgtgcgctttattagtttcgatgtaagtagtgtttccacaggcgttgcggtgattgaccgtgagccttctggataccttaccttagtccatacagacatcattagcacaaaccctaaacacaacgtagggcgacgcttaaaagacttcgcagaagctgttcaaatccttcttgaaacattccgcccagactatgttgttaaggagcagacaatcgctcggatggccactcaacacatcttgctgaagtttgctggagtgcttgagatgatagcctctaacgaaggcttcccaaagatttacgaatactctcctacgactgtcaagaaggttgtgggaggccatgggcgctccacgaaagaagcagtgctgatgggcactacagaatacattaattggaacgagccaattgaccttgtaattgacgacattagcgacgctgtagcaatctgtctaactcacattggaaaagaatttgtattggttccgttaggtgaagttgagaaagctaaagaagaagctatgattgtagaggcggaggcttctaaatatcttgaggaggctaccgaatgaaacagcagttgagaattgccataacaggaacttctaggagcgggaaggatacctttgctcaagctatccagaaaaagttagttgaaatgggttttgcagaagctatgccgatagcctttgcagaccctttgaaacagctgtataaaagatacttcttctatatggaggacaaagagaagccaagagatgcctatgttaccattggaaatgctatgagagaggttgacgaaaacgtttggattaataaccttttaatacaggctgccaaagactgggacgaaggcttctccacactagttacggacgttcgtttcgagaacgaggccaaaacacttataaacgaatatggatttatcttggttaaggtggatgccgaccctcttattagattaggccgtgctgaagctttaggtgaaacacttgatttaaacaataagggagacattgaggtaggaatgattgagcctcacttaaccttcctaaataatggggagagcgacttaatgcaaatggacaaatacgctgaaataattattaatatggctcaggaggttgctaatggctaatctattaatctctgagaaatcatactacgaaaagttagtagaagcggaaacagcaaatgagttccgtatggttttaataagattgattaatagagttgttatgaaagttaaagtaccacttgaggttagagagcttttttgtgaagaggttttagagatgtattacgaacgctttggcgacgtagcattgccagatagcctagcaaacatcctctcaacatattatatgcaagacgatactagaggcgacttggaaggcactaacaagttcgctcgctgttctaaaatggagtatagctttgcttctgataaaaaggagaagcgaatccgtactgaggacttatataaagaatctccaatcaacttagaagtgttggaaggaaatggttattcacgaaataatattgcctcatcattggatatggagcgagcatctcttagaactgacttgttaaaggcaatggcaaaagccgatttaactgagatggagaagaaagtccttgagctaaatcttatctacgattacactatgcgtgagattgaagtgcttccagatatgccttcaagaagcaccttgagtagacaccttacctccgctcgcaaaaagattatgcaacaaatttaaaatactttcaaaaaggggcttgacgaagcctcttttttgtgctatattatattcatagacaaagataactaataaaactacttggaggaatatataaatgcctagaacaaataataaaatcagccgtaagaaagcgttagaagtgtatttagaagggagtaatccattagcggctatctcagagctaattgaagagcatacttggacagttggtttcgacatggagtcagcaaccttttataaagagcgtacaagcaatccatatgacacctgtaagaatcctcggtgcaagctttgtaaacagattagagaacacgctgaacgaatccctgcttactctttaggtaagactttagctaagcctttcgaggaactttctttagggcactttggtaagctagctgcgaatgatgttgctaaagctgatatgcctaagctattaaaagtaactatgaaagatgttaataaacacattgacatgcaggtagaaaagattggattagacaattccatcaaccttctaaaagactatgagttatctgaacaagttatccaacagcttttaggaattggtgtttatgatatgcgacaatttaagaaacgcatgtacgaaggcaagaagcaacgtattgccgaagctaagaaaggtgagtgggcttaatgaagaaatatataaagctaggagcagccgttttgattttgcttattggagtagctgtgtggttaattgaatttatactgccttttgttttactaaaatgggcattgtagaaaggattgtggaacatggataattcactaagcgtatatgaggtgcaaatcctcaacactaacacaggctgctttgacgttttcttagtcacagcaataagcatcacttttgcatatattaacttttcggagacttttgaagaggatttccacgatgatgggaatgttaaagtaatcaaattggaggagttttagaatgaatatgattttaattttgttaggcgttgtttttttggatgcttcttacttgccttagaaaggagaggttttaatatggaacttttagaaagaatcacatacagcttatttatagctttggtagtagttttagcagtaggagcattttttgtaggtgtttattggctatccgtttggactagtggattaggagaccttggaaccttcgttgcagtaggtattgtaatgttcgtttttacagctttagcggtgtttcttggatttgattaaggaggaattttaaatgaaattgaaagacttattaaaggtagtagacccaatgcaggacatctctttggagattgctgaattaacggctccagaaggtatttatgctaaagacattccagaaatgcgtccaatggccttggaaatggatattgtagatgttcacacagcttggtataatacagaagatagcattgaaacaactttgggagtcgttgtaaaaggaggtaaaaagtaatgcgtaaactatttgaagagaactttacaattgacgaaatgtcagatatgtggtatggttgggataatgaaggccttttatatggctgggaaaatggcgaagcaggagaagtttatgcaatacttgaggaaaatggatataacgtggactccattaaaattatgtatggagcgttcataacacttggggaattgattggagcgatttagacatgcttattagattaaatgaagcagacaattatgaagaatacaaggaatatattgagctttctgaaacatataatggaaaagttcacctagagctttatatagaagaatctgaaacagataattatattagtgtaaaagaagcttacttagacgaagaatctattgacaagcttatcaaagcattacagagctttaagaaaggggaaatctaaatgtctttaggaatgtttgacaaagagcttttagcagctctagcagctttacgatgggttgtagaagaccctgaaatcaaagagcgtcacgatgaaattttaaacactgcgtacatggaaaacgcctacgagaaaggcgaatcattccccaatgaaaagtttgtggagtggcatttcattaatgccttaacaacgcttgagatagaggcggctgcacgagaccttattattgatgatgaatcctacgatgaagaagacgatatggactgggcaagcgacacctattcatgtggctgttgcacatgctgtggatgcacctgtgactactatatgtgggaagatgatggaagctttgacgaagacgatttggaggactaattgatggctaattactatgtgttagaaagacttgacgacggctctggcaaactccatcaagtaaagcagtataaaagcttagataatgctattaaatatgctaaagaaatgagcacctttaaaaagacttaccaagtggctggccaattcgatatgaacaggcttgctaacactgggatactagtttagaaagttgtacgagaggccttgacaaaggtctctttttatgttatcataaggtatcgaataaacaaggaggaagtttatatgaagatttcagttaacttacctgatgataaaaaagctaaggaagcaattaagaaggttaaggggaagaaacctctattaactatggaagaggcgtgggcaaagattctatctatgaagaactccgcaaaggatttagaacgccttaagcaagttaaggaatacctcgaagaaggtaaggtaagccgtgaggaagacaagttaaacaagaacttctcaaaggccgaggctctacgtatttatcaaaaggttcaagaaatggaacgagaagctaagtttgacgaaatccgtaagaaagagtgggagaaattccctatcataaacaatattgtagagcttgctagttggattgacaacgctcttgaatgtgataatgaatacttggcgatggactttgaaacagtcggtgacaacggcggtactgacatatatagggaagagatttcaggattctctttaacttaccgttacaaaggcgaaatcattaatggttatgtgcctatgcgacaccgagaagaagacggctctcctagtcctttaaatatcgctaatgttaagtgggctgaggaaggtattaagagagtctttgagtcagataaggcaactgtatggcataatgcaaccttcgatatggggcttgctaaagcttctttaggaatcgctcccagaacgcttgtccacgataccttaatcttaatgcacctacttgacgaagaccttccaagttatcagttgaaagttttagcaacacgcttcttgaatattccgtcagatacctttgaagaaatgttcggaaagaatgcaaagttcgctgacattgctgttgagattgctcgttattatgccggtaaggatacgtatgtgggatttcttttatttgaatggcagttgaacatccttaataagccttctttcgctaagattaaaaaggtatatgagcggattgagcgaccttgtatcatggccacttttgaaatggagtcggaaggcttccacattaacatggaagaggttgaggtacaacgtaaggaaagcgaggcagagttagaagagatttctgcacgccttcaagcacgctttggcgacgttaacttcagctctccatcacagctgttaaaactgctttacgtagacaatgattggagtaagtatgttacagctgaccataaatccattctaagaggtcacgtaggttatgatgaacatggtataagcaataacaaattgtttgcattaatgcctaatggaagtgttatcctagaccctatggtaaatgctgaaggaaaggtcgttccaaagaatgacagaaacaagttacaagctaatgctaaggctatgaaaaagattgccaaagctgttgacgaggttcaagacatccttgactacaaggacttgacaaagcatttgacagctttcgtaaacaagattgacaccttcattgcgcctgacggaaagcttcatggacagtttaatcaattcggtactgttacaggccgtttcagcgcctctaatccaaacttacaacaacaacctaagaaagctcgtaagatgttcgaggctccagaaggctcattaatccttggagcagatttttcgcaacaggagcctaggctactagctcattcaagtggatgtcaagaacttattaacatctataacgaaggccgtgacttgtattctgaaatggcttcagcaatctttaacaagcctatcgaagagtgtttggatggctcaatttaccgtaagaacactaaaatgattgtccttgctatcatgtatggaatgggtgcctacagccttgctgacatccttcgtatcgacgctcaggaagctcagaaaatgatcgacgacttcttcgtagtataccctgaagtagaaacttggattgaaggcaataagaaaacagttgttaagcaacgctatgttgaaacgctgtttggaatgcgtcgcagattcaagcatgaaaactttgacatccttaaaaagaattggaactccttagatgaaaatgataagaagctccgctcagcagcagcaagagccttgcgacaagctactaacgctttaatccaaggcggagcggcctctcagactaagcttgtaatgaatgcagctagaatccgtttgaaagagttgtcagaggctcgtggagaacctaactcatttggattccttgctcaagtgcacgacgagctgttatttaaagttcctgaagacgtaacagaagctgaggtagacgctattgaagacgttatgattaacactgtgaaactagtagttccaagtaagactgatattgagattggtaaaaactggggtaaaatgactgctagaaaagattggtttaaataaatttcagaaaggggcttgacaagcctctttttgtatgctattattagtccataaagaagagggaggaatcaacatggtattgcgagtaggggataaagttactattaaagaggatttaaaatcttacgaaagttttggtaaaggagttacttttgttccagaaatgagtaagtacctaggcaaggaggctaaagtagtcacggttgcttcacatgatggattagaggttagcctagacattgacaacgagtgctttttgtggcatgaggaaatgcttattaaggatgaggttaagccttcagaactaactttaggaatgcttttgagtaagctaactgaagacattagtgtaaacattgatttaagttttgaagacgcatctaccagaatcgtgtcggaaaactattattcatggcagctagagccttattacagtcgagttgttaaatggtttgcaccagactttgataatggagagttagcaatacttttggaaggagagttttaatatgaagcttaaagtaggagataaagtaactgttaggaaagacttgaaaacaggtcggtatggcaatgatttagtttttccagaaatgcttgattgtaaaggagttacaactagtattaaaaaaatccattctaatggtgccatagaaataatcggaagctcatggtattggactcctgaaatgtttgaggaaactccttctgaaatcactttagaaattggctatcgacactctttagacactattgttcagacatcctctcagacagttatcgatgatgattacgcttatgagaatgcctgtgaacagtttttagaagagtatatgaaggattacaatagtgtagaaaatatccacatctgctttgtgagggaggccgtcgaaaatgcctaagaaatattacctgaaggccatttcaatgtatatattatatactttcatagcagccgtggttatcggcggaaccttcctgttagtaaatgcttttgtatgggtaggtacattcatctacggaagatttggggacactgttggaacaattcttttactctccacagctggactgatagctttatgtacagccctttactatgaagctagaaaagagtttcgagaagacgctttgagagtccgtatccaagaccctgaagatggtattgatacacagcgctttgatattgtttacatgcttccagaagacgctatccgacaagcctcgacaattgttggaattattccagaagacatacaacacattgagtccaaagagcttcggaaaaaggttatccacgccatcatgaagcattcaccagtagagtatggatttacgcttatcactaagtatgacccagaccttgactatatgcttcgtgaaatctgggacttaaactacactttcaagactagaagaaagcttatggaaaagcttagagattgtggagtaggccttgaaggagaatttttgaagtatcttgttgactaattaattaaagtgtgttatagtagttttgtagaagacattaaggaggagattttaaatgaaatacactaagaaagaccttaaagaaggcatgaaattacgtgttattgacggagctgactttgatttttgggaagaaggctcagtacacgaagtaattaagctttttggaaagcttgttattgatggtgacgacgaacttggaagaggaattagaaacagtgatgacatcctaaattacctaaatttagaatatcctgtaaaaatggaagtagtggaggaaggcattatgaaaagctctggggaacgcttaactaaatccaatattaaagaaggcttgaaagtagtgtgtgttaaaaacgcttatgagccgtatcgatactttactgttggaaaagaatatgaagttgtaatggataactgtggtgacttaggcattgaggatgatgatggtgaaggatttatttgggataatgcaatctttaatgaagaccagtttgtcttcgagcttttggaagaaccttcgaaaaaagctgctttagaagctttagatagcaaaattagagagcttaacaatcatcagcaagagcttttccaaaagcgtgacagaatcaatgagcaagctatccaactaggcagcaaagcacgccgtttagaagaggctaaagcactcattgagaaatacatttaggaggcagtcttatgaaagattttctagtagtcgttatgattggcaataagatgcttaactttgctacttctacagaagccatgacaatggagtttgtggaaagccttaaaaaagagctttcagaacagcttagcgaagacttaacacctgctgatattacagttttaaatatcattccaatggataagaaacaaagtagccttattacaggcatttaggaggagtttacacatgttaacgacagattttattgaggcggtagagaagattgggctagaggtagataatagctactcttcggtgctttacgtagaaagtcacgatggcgttgttgtaagtattaacaaaggctgttctgaagcttttacatggtgtgaaggaagagacattcatgtgggaggccttttaaatcttatcccgcttgtggaagagtacgccaacacgcctatcgaagagcgtgagaaaaaggtttccgagaagctagattatgagactattaaagagtatattttcgaaaacatgtctgaaaatgatttagcaagacttttgtcagaggcgcttaaacacagcggcgaaacaaatacctcatatataattactgacagaggtgttgcggttagtcctaagttcacatttttagattaaatactttcaaaaaggggcttgacaaggcctctttttcatgttatagtaagactatagaaaagacataggaggacattatggaagacttattcaaatttgcgtgcacgcttgtgttaatgactgttctaatctctgggtatgtggccattcaattagttattatagcagtggcaggaacctttttgccaacatgggcgtttgtaattgttttaggatggcttgtatacactaattacagagtattgttgaaaggtggagaatactaatggatacagtttaccaagacactcaagacatctatttgaaagctttttggatttgcattgatagagctagaaatagggcaggagtcacttggtcttatttacagcacggagataccactagagcaattaatgggacagctaatccatctatcaaaaagactttgcagcttatggacaagcttgacttagatattgtagactttcaattggacgttgcagaaacttatgaaagacttttggaaggaggactttattaatggaatttaacgaggaagaattattctatttactagctcttttaaaaggcgatataaatgaacttaaggaagcatttgacatgatcaaggcatttggagcaggtggaaatacccttcaccatattaatgaatacatccttttaaaccttaaaataagagcaagcctattattaaagttagaaaagattcaggaggactttgcgaatgctaattaaaaaggaaaagaaggcctacctattcaccatttatgaattgcattcctacccctttgtgataggcgtcgatgcttactccgattcagtggctatagaacgtttctacaagatttggagaaagcattatcctaagcattataaaaagcataaggggttctccgttaaaaagtttgatatttagtattgacaaatccaccgaaaggtgttaagatagacttatcaaaggttaaggaggtaattactatcatacccgaaggaagttatttaaaagattcgtcaggcctcaaccattactttatcgaaggccatatcataggcgttaggacaggagtaagaggctatcagacagttgtttgggataaggaattggacaaaatgtatgaacaaaactttcacgaacagtctctcatgaacgatgttaaaatgtctaagaaagaaattgaagaatttaacaaaaagtattatgaatggagttggggacaagatgtctaaacatttctatgcaaacactagcccagacatggctgtaaactatccaaaaggatggacaagctttttccataatattgtaggctatgacgagcctttgtcagaagatgtcttaacggcttatcagcttaaagaaatcactgatttaggagagcttccagaacaccataagaaagtatttgaaacgctttcagcaatggagtatagcaccgtggagcaggctctaaaaacatttaaaacaaactatgtggagggaatttaatatgaattttgaagaactaattacacaggtagaagaatggtcagctaacaaaggattagacaaaactgctcctgagaaacaattcttaaaagttattgaagaggtgggagaagtagcggcggctatggctcgtaacgaccgagaagaacttgtagatggccttggagatacttttgtaacattaattatcctttgtcaacagcttggagtagagcctcacgaagctttggatactgcttatggtgttatttctaagcgtacaggaaagatgattgacggagtattcgttaaaagcgaagacttgtagaacagttaaataaactactatcaacagcctttccgaagagattcacggaggggctgttttatagttttcaaaaaggcaggggcgaaatttttaaaaaattttttctaaactgagaatttttaaaaagatttttccaaaaatttaaaaaaatttttcttaaaagtttttcctaaaagcgctactggattccattattagcgcttattttacatatttattgaaatagcgtgtcgcacaggcgcattctgagcgcatttcgcactgctttctgcacaactatccacatatttgttgtgtggcgccttatatatgctgctatacatgcctttccactgcttttgataaacattattggattaggctgctatatacacactatcatgtgcctttactatagcctatcccctatgctttatagttagttttcctataggctactttaggttatactactataccttactctactatactccccccccccagtttccacgagaagtgccctataaggggctttttaagcatttttacgcctttttaaaggcttttcttgctctttttacaagcctttttgcacattctttcttaaaatccatcaaaacacctttataatagctttttcagattgtttttaaaagtttctactatataatacgccgtttttatgtaaaagctgccaaaaagaatttaaaaaaagttgtattttattgttgacaggcatttttgaaagtgatatattaagagtgtagcaacgatctactaaaataaattataagaaagaggttttataaaatgatgaaattaatcgaattagacaatgggcggaagcaagttttttacaacaatgttttaatgcaatacgaaagacgtggcagcgatatatatggcaatcccttatatcgagcatatccaattaacttttcttttaaacgtttaaaaagcgtatatagaaattacgaaaaaagttacggagaggaatcctactaccttatccaaagctataacattttagcagatattcaaaacattgctaacgaggtaaacgcaaaaaacacttttccagactttgaccaaactttattgaaagactatcgggaggttttggcgtatgtctaataaaactattgaaaaattatataatagttacatgagtacttgtaaagagttccgagaaacggtaacatttactcaatatgtgaaaggggaatattagaaaatggcgttaacaatgtttgaaaaagagagtttgcaaaaagaaaatgcacgacttaaaagagagctagccactttaaaggctagccaaaaactaggcggaggacttgacgaaaaagaattacaaaaggcattaaatagttgccaaaggattttcaaaactttaaataggggcaaaagaagccttgttctaagtaaatccgccatggaggctagtgtggaatattcgggaagtggtcgctcaaaaacttataaagattgttccaggacagcaataagagaagcagaaaaaagcgcatgggagattatgagcctagaaaatgactttagaaatattcaccacttcttaaaacatggtacaatgaaagcggaggaaaaagacaatgcttaatattattgtaacagtaatttcaacggtggttattttaaaggcattggaatgggcatataaaaagctttcgaaaagacttgacaagtctattaagttttcaagaaagaaatctaaaaagcgctttattattgcacgagtgacggaggaacaagcttatactttgcgattattaaaagccatttctaaagatgatgaagctgtttgcgaagctacaaacaaagctttgctggaatacggttacgaggaggcgggcgggcattcttatgagaaagctcgggaaaagttttcatcattacctgacgtaaaaaacggcataccgttggacgatctagaaagtgatgaagaagcggacgtgcaacctttttagaaaagtttattaaaatgcttgcaatccacttggtgatttgctattataaatgtagttagaaaggaggtaacaagaaaatgagtaaagctttttacatggcactaggcggaatgttgacaagctttttcctagggcatggcacagtagcgtattttatggcaggcgctgcagcgttaacaatagccgtccaaacaatttacaaaaaagattagtcaaaagtgttgacaatggttttcgcaaatgctataataaagaaaattaagaaaggaagtaatgaaatgacacaaaaaatctacgttgacaccattctttacaatccatcaattattgtttatgaatggaataagaaaaacatggaagtatctttctataataagcttaaggagagagaagaaaccaaagaaattaaggcagaccgtgatggcgatttatatttttatgcaaacggtcaaacattctacaaaaggcatttacatgtaattgaatataaagaaataaacttgtaaaaagttattgacaagcggttaaaaaagtagtaaaatatatttataagataacaagtaataaatactcattcgataaggttagggcaatcctttaaaaaagcctaaaataaaataacagaaaaggcggtttttaacatgacaaaaattacaaaagaaattactttagaagaaattaataatgcagagtatacaggttatcttgtgttagataatgatagcattattgtaagggtggaacgtaacaaggtaacaaaagaaacatactgctatgtttatgcagacagcgacagcgacgactttacagcaaaatttaaaatagagtagttaaaaaagtttacaaaaagctattgacaaaaaacaaaacatagtgtattatagacttataagataaagagaggaagttatagacatgacaaaagaaagcaatgtatttttagacgaaaaaggattttttgaggaaattatagaaactttggaaaatggctacaccggttattattgcgacctgcacagtgaaatttttaactggggcgtaaatgctgacattaaagaattagaagaatacggcgtttttaacgcaatcggagaaattcaggaatatgaagaggaacacttctgcgcaattctaacagaccttgggaacgcttcggcagttgctgatatgctttactatattaaaggtaacgagtttttatttgatagaatagattttaatgatgttttagcagacgttgcagaggggctaaaattagataaagacttatggggcgaggaagccaccgaggaagtgaacaaggctattattaaatgcttatcggaggaatttaagaatgtttattgttaaaatttataaagaaaaatcagatcgtcagttaaagcttttccacaactccaaagaagctgaaaactatgttttgagaaagctcaagggaactgacaagaaaactattgaagtttttgaatgggataacatagcgttagaattaagctactggaatcacttcacacggcagcaagaaagttatttactagaatattgaaaaagtttatgaaaaggggttgtaaaaagcccctttctatgatattattaaaccatcaagaaaagagaggaggtaacaacaaaatgacaacagcattaacaatcgctttaattagtttggtagcaactttggcagtaagtattcacgaaattaatcgttaaaaagttttagaaaagtattgacaaaagcagttacaaatgctataataaaggtatagtaaaacacaaataaaaaattatatgaaagaggttttcaaccatgacaaaaacatttaaaaacattatcgcaactttaacaatcctagtaatcgctttggcagcagctacaggaatcgcaacatttaaggcagtagaaaacgcaaatgataaagctatccttgccgaacgtgtggaagctttggaaaaactttccgacaggcaagaatatgatattgcagtaaagtctaatgtaatcggcgcttacctaatcaatcatgaggaagaagcacaaaaggaatataccgaagcttataaagcacacaagccaacgcttcttaaaaactatagagaggcacacaaataatttaaaacatttttttcaaacttaataaacaggaataaggaaagcttttgggataacttctcgagagcttttcttttttgtgttttcaaaaagtctgatcagaaaaggcgccaccttaatttatggaatgcttttctaatccatctaacctaggcatttcttacaacgtatataaagctttctaatggttaactacccaacttctttcttgaaacgttacgagaagccctctctcacacacataataaagcagtaggcaaaggaatatgcaaagagtattcttaaatgctgttattaatccaccaaaaaggcaaggaaagaagcggaaatgtgagaaagaaatggtaaaagcctattaatcctagggtatttttaaaggaaatgagagggcgcctaacaatattattttaaagctttttctagggcgttgttatgggggtttttctgaagggtatctagagggcgtgaaggggcgtaatctcaaggcgaatctaagaagcctaatcgaaagctttgcggtggatttgtttttattaaaggaaataagaaggctttgcggaatgctggtgtggtgggctttggggagaggtggctcgagagggtgtccgatagctttcaccacaggttaaca

SEQ ID NO: 11 - DNA, 170888 bp, synthetic construct
  misc_feature 1..170888: note = K1_colM
  source 1..170888: mol_type = other DNA
tcacacataaaacacatcatatcgaccacgggtagtaccaacatataataactgctgtgcgagagaagcatctgccatgtgaatgcatggagtataaatgaagcttctgtcaattgagatgccctgggccttatggaaagtcgaagccggtaatgctttcactttatgaaacttacgcttagcgtcccagaactcagaccaaggagctttacctcctttattccaattcttatatgtatctgcagtttttgccaagaagaattgaaatttattcatttcttcttcggatgagatgacacagattttctctctagcgtactcttcatcgtcgccataggtttcaatatctaatacccaatgacgaaccagatattcacctggaacacctctggcacccaaaaatgtggtggtttcaactgcatccaatatgcgaacaaactgaccattattgaaaagaatttcgctgaatttcttcccttcaaatttaagttccttggtaagaggttcttgcataacaacaatctcgcctactacgaatggtcgttcagtttcgtatattcttcgtctgattatttcattcaatttgtctacagatttattcgtgaatgcaagcattcggttttcaaataaatcttctggtgttttaactaaattaaaataatttagcataaaatctttaagggcagttcctttcgtaaacccacggacaccatgaccatcaactacacagtcacgaatccatccaccatttctgatttcagtagcaacttcaatgattggagcattacttcgcatcacctcggtcaaatgaagctgtaagaaatctttatgagtgaagaatggactcagtgcaggttcattacttccaggttctaccggacgtatctgagccttatcaccaatggcaatgacaatacaccaggcaggaatagttgccatcaaaatcttaaacagcttacggtcatacattgaagcttcatcgcaaatgagaactcgaatagatgccatatccggaactttcttttgttcaaacagaacgttttcttcatatgtcgtcgggttaattttcagaagactatgaatagtactggcctgcattccgctgagcttagataaaacctttttggccccatgtgtaggtgctgccaacgcaatgccagagataccctgagaaatcaaagcatcaatgataaatttggttaaagttgttttacctgtaccggcaggtccattaatcgtaatatgttgacctttagctccttgtttgaccatttcaatgactttattaaaaatcgctttttgactttcttttaattggtcaaacgtaatcatgccacttttaccctcactacatgtagatttttaatttttgcttcgagtttttcacgctcaacatcgctaagtggttcatacactagctcagttgttttccaccaaagcattcctttggttttgctttttccagtaaaattcccttttgctaatttgtctgttaaaaccgacattgtacgaatccgtgctttattagccgattcttcattagtgaagaccacacatcgttctccatcgtacatatcagttgtgactggatggtcaaatccgtctttatccttatacgctactacatatccatagtgttgcattacattttacctctcaaaagttggaagaaggacgcagtcaatggaagaccttttttcaattttaacttatctagcattgagcatttttctaaccgacgaagtgagctaacaattagccgtattgattgtacacggatttcagcatctgatggacgattcggaactgatgctaaaatagcagataacttacgctcaactttagctaattcagacttaccaccgctgatacgagttctcaatgcattaataagttctaaatctgccgaggttgcagttccattcttttctttttgcacaaattgagaaagatgattttcgcgattacgtaagttagttttaattgatgttatagttttttcatactcacgaatcttttccaaacgagaagcttctttatcacttgttggcttaacagaatcagaagagcgaactatgcgtgccgcaatttcattcgcttttcgttcaaggccttcaatcgtattatttccacgcaaagtattatacttttgcttgacaggaataacattccctactacatatcccaagtcattattccaacgctcgagcgtcatgctatcaggatgatttcctttaacagttccaaacttttcgcctgagtatgcgcaatgtgtctgctgcatgatgttaaacagatattctggggtgagattgaactccttgtgccgacgttgagcagaacctaaagttgtaattaaacgagtataaactttagcggtttcagcagtaaatttcatcatgttttcctcaaaaatgctttcgtcttacggacggtataatgggtctaggtccctagttctagataatcactagttgactaagctatagtaacactaaagtagtccataagtaaaccagatttttcaactttgttatgaccaaccactttgaacttagttcccatcggtagcatcctttcttgttctttatcaatcatctcgatgtcagcgcttctgcgctgagcaatgttatcaatcacatcatttggtcgcatgaattcagaatctggtgcagtaattaaaagcgatttcatgttggtatgataatcaaatgattgctgacaattattgacttcaatgactacaaaggtcgagtaatgccatttgcctgcaaactctcgggcgatcgtttcatctgttgtgaatgatgctacctttccaaagtcaaatttctctcctttaataagagcgtcataaaaggctttagcctcacgacacgatagacctctatagagaatttctctgttatcgatttgatgacgtctaacgatagagtcaagtttcttatgaaattcttcgccaatcttattgttcatgcactgccacagaattgactgttctttgcagtcaaaacgattggctaatgcttcccatacgcttaaatcatataaaggtaatcctttgctttctcgcgcgaagttaagaacatcaatggagcgaatgggttcttcgataggaataacctttgataattttactgaaatagatgggtttaatgaaatagccatgatattctccattttggttacgagaggtatcttatcatggctttttggaagagtaaactactttgtgaaattattttgcccagggagaccagggcggcgggtcagaccagattgaagctagttcatctagaagagcttctggggctttaataccatacttctgtataattatacggtattcgtctttgatgtccttagaaatcactggatgaacttgaacctcttcctgaggctcttccatcatttcaaacaaatccatcacatgaaccactcagtattgcgatacagacaactactgctgttatatccatcagctgctttttgcaacagcgggcttggagcaagtttgataaaatctgcgcccatatataaccaaactaacttagtaaattctattagagaatctgtgctatcaatgataatctttttgcctcttgaaattatgtcattttcgtattcatataagctagtttcatgacatacattggtgtatcctttcaagtggagagcatgcagtatagaaacaggacttcctggaactgtatctacgtcaaagacatgagcagtcttaataatgccataatcttcagaaggacaccaaccaaatgcctcgaatttattaattaaatctttgaaatctttgtcgaacgtactgtatagagcaacagtaaaaattctatcttggtctagacgcaaagctccttttgcatcatttcttgattgaactgcgcgctgtaagcttactttatagatttttgcgtttgccacacatagctccttcagtcatgttgttgtcttcaaaccacttatcatttgctttaattaaagcaggcgcagcttttagtaataacgctgcagctcttacacctctgtaccaacaatcaaaatgagacttctttaatggcgattgataccagggcttagtataacatatcattttcttctcctcagttagtaggaataatatactattcccagtatagcataaaaggactcccgaaggagtccttaattttatacttcgccatcagccggaacagcttcaaacattttcgcgttggtggttgcccaagtagcagcatcatcaactactgttgaataagcagctttttcagatgggaaaatctgatactgcgcattagcaatacgatgcgaatcagaatacaccttaaaagctacagatacttctgtgcctttaacttcaccatcagcagttgcatggtcaaaagttttgatgtttacgtaagccattttaatctcctatttagtttacagaagtatttatacagctgctgtaaacatctttaatatttctttatcaatttctcgagtgatttcttctcgaagggccaatactaaggccctttctttttgttttctgataatttttaaacgacgcttagatattcttttagccatcaataaccactgtcttgacgagcaaagttctctgcgtttttcagataatacagcttaaagatttcttcagaatccagaccaagcgccataaacatattcagaacaaagtgcaggatatcaatcatttcaaatttgatttcaagctggtctttatcagacaggtctttgatataagtttcctgcatcttgacgtggtcagctttccatggtttccatacggcagatgctgccttttcaccgttactcataccgccaagagacgtcagcaattcgcggaattcgtcatcaatgtaatctttttggttacgcagccactgcacgatatcaccggcttgggccaattcatcaggatgcatgttagtaccaggcttatcgtttgctagacgaacctgaagagatttttgcatatcaagcattacttgcagagggtcaccaccaactttgcgtacgatacctgcgtatcgagcttcagctttatctgcaccagcgatcagttgactacattcgttgaaatgtggcatattatttttcctttcaattaaattagataaatattatatcacttaacataaatagcaggaggattcatgtctgaagtgaaacgagaatgtaaagacaaaggaggatttggaagatatctttacgtcggaatcgccactgctgctttagctgcatggaattatgtggtagttccattagctagcacacacgggctagttcttcctccaatgccgttagaaaaagttgtgtcgtttattatgactggaggattgctttaatttaaggggctttggcccctatatcttcgcatatttgtcaagacgtaatttagccattaaaccttgcgatatattttgattaatataatccgttatttcagaagcagttgccccctctttcataatcatatcatttatatctttgcttttccaaggcgacttatcccagaaaactaccttttcaccagcatctactaaacgtttcatacgcttaattgtatcaggatgacgaggttcatggtccataatccatgctcggttatcatgacatggaacttgagctaaatctaaagacccgccagtgattgcaatagcattatcaatgaacaacgaatctattggtccttccatgacgaatacgagttttgactcatcaatggtgtcgagaccataaattttggttgcatgttcatgggctttgattgtgatgtatttttgtggagcattctttcgtagtgctcgtccttgaaacgactcaatctctcctttcttgttgaagataggaataaccaaacgtggttcgttcgtctcattcttataggttcctggattaacagagttaacaagagaaggccattggttagtaaaccataaccttttccaagaagtgcttggaatacatctggcagtcacatatttaactatcggatgttccttcggaagtctatctaatcgctcgcagaaattaagtttttctattacggggagttttgcattaattttctcagacggttctacagcctttggcttatcaaagacttgttcctttcttttctcaagaagatactctcgatagaggtcaggctcattatctttaagatactgtgatagccacttgttatactcacagttgaagcaatggcagcgtaatccttgacctgcatcaaaaatccagaatcgggctttattgatatctttctgtgagtcaccacaaattgggcaacgacagtttaacttgaatgttgaagatgtagtaacgtgtctaaatttaggtaggtgagatattgcgcgaattgcatactcgttatcaacccaagacataatatttcctctggccttaaactaataaggccattttatcactttttcttggcagcgtctttatccgcttttcgtttctttggaagagtttcgggtcctttattgacgatgtccccggaagttgtacctgatgcaatattctgtggattgccgcccgcatcacctgcgaccatctcagtaacaaactctttgtatgttttcatagagcctcctactatttattcatgcgtaatacgtaagcatttatatgtaggatacagcgtcggagacattgattttggattgtctttgataagcataaactgcttgcctgtatcttcacacttttgcttaatcattgcttcatctttaccagtgaatgccatcttttcagtagacattccgcctgaacctgtagatagcgccattattaaaacgtatgtaatcatcctaaaatccacttaacaatgttgaagttatcaaactgggcatcacagtaaagaacataattcaacttaagtgctgcgccgtcgtctttaagttctgcttgcacttctgtttgtttgctcgggtctacgttttccacaatatgaccaacatctgcacgaatctgctgagctacttcagactcatcagcagtcattgaccactcgcataagtctttgtcatagttggccatggcaggaactgcagagcaacttgatactgcgaacactaaagcaagtacaatctttttcattttggtttcctcaagcagcttgtacgttaagagcagaaatcaggcgataatcaccgtttgcgtatactaacattgacacattgccatcagtgtttttgaatggctcaacaactactaaaactgtatcgccttcatctaatgcttttcgtactacgccatcacaacgcagattagcatgtggagatttaactactttgcttccaactaccataccacaatgcggtacggtttccgctgattcatctttactcttaaagactacgtctaatgctttttcaattgtccacatgatgttttcctctactcgttttgtttcagtaaggccatagtatcatggcctttggagaaagtaaactaccttttgaacaattttttcaacaaaatgtcagaggtcagattcttggtaggtaggtatgtagcagagttaacccagatgccatcgctgtcatacaccttgacctctccatagtcgcatacagataggtctgctttgttatatgcctcgatgcctcggtgaatggtatctgtggctgttacgacaaaagagtgacctgattggtcacggaccgcgctaaacacaaaaatcataaaatttacctagaattttaactcttctgccagagcatcaagcttagaacgtgatactcgttcttgacgattagattcggctacacggttctgtgcaccggcaccttctcggacggtattgcttggattaggcttagttgggtcgttttgctgctcaatttctacccagcgttgattagccttatgcacacccataaagaacttattgttgatgttcttatcgccataacgtgatttaatctgcttaattaactgttgcttcatctgagcaagttcaggagtttcaatcacagctaacataaagtctgccgtagcaggtagacccgcagattctgcaatatcactcatgtccatatcagaagcatcccaagctgaacgaccgacctgagccgcggtccaaagaacagtttcagattctacagccaatgcacgaagttcttctgcaatagctttaactaatgtgtaactgttttcagtatattgacgaatacggcaagaagcacaaataccaagatagtcaatgatgataacagtcggtttaaagttcttcttgagtttcaactcattcagaagagctcggaatgtattagcgttagcaccgccagtcggatactgtttaatgattaaacgaccaagagtactagaactacgccatttttccattttgcctttatattcggcgtatgatacacaaccatcatcaatatcgtcaagtgatacatcaagcaaattagcatcaatacgtttagcacaaacttcttctgccatttccatactgatgtaaagaacgttatgccccatctgaagatagtctgcagccaatgaacacaatcctaacgatttaccaacgttgacgcctgccatcaatacgttcagtgtaccagtctcggcaccacctttagtaattttgttcagaatgctaagtttaaacggaactttacgagctttattctggtatgataaccaacgagcttcataatcttccatccaatcatgaccaatatagctatcaaacgatactgataacgcttcacgcatgatatcaggaatagcccccatatcaggaagacgcttatctcgcttatttggctcaagctgggcattagcctgaatttcaataattcgagacgtagcgttatacatagccttttcttgaacgtacttttcagtttccttaactaaccaattcaaatcttcgggagcatcagataacttatcaataagtttctttgcgccttcatgttccgtttcagttatagacgaattatccagtgctacacacaacgcagtctttgaaggaattgctgtatattcattaacgtgtttcttaattatgttaaacaccgtctgagcaggtccttgctcgaagtactctttgtccatatatggccaaaccttcgtaaagaaagcctggttgtaaatcagattagctaagattgtttctaccactttaacctcttaaaagattttccataatgattttttcttggtctttaatgcactctggatttgttgtttaacacaagcttccacatgaggataaagttcatccttatgagcttcagatggagtactaaactcaatagttacttcccccgaaggagaaatatttaatttatgaacataaaccaagtgtgattgaccatttaattttatcacaatttcttggataacagtcttcatagcttcttggattatttcatggcttttcttgaacactcgttcttgacgctcgaagtctccctcttccgagggagattcttgttcaaatttctcgagttcagattctaaatcaaactcagtcttcattcatgaagttctctaattcatcttcaacttcagcagctgatactgaaccactctcagggagtttaacaccatcaaccttagttgaaacttttgagttaatcatttctgctaccgcttcatcaaccgcagcgtttgaatcaatagcacccaactgatagcgagctttgatagcgtcacggaatggctcatgcttaaacagaggaccccaaaattccgtactgctcgtatcttttgcccgccaggatttttcttcacgaatcatctcaccggtttcaacgtccaggaattctcgtgcgtaccatccatttttcggtttaacaacaaatccgatatccagagccatatcaagcagaccactgtacggatctataccaccatcgaatttaacatcgatgaagaacttacttttctctttgacagtacgtgatttctcggcgttcaggacaaactgatatccctcaagctcagtaccatctttaatttggcgtttaccgatgatgaacacagtatccgcagaatacataggacctgtaccaccggtcattaccgtcttactgaacatctcgatggtctcgattgtgtggttaaccgcgacacaaggaatgttcttaatagagaagtaaggagttacgatacggaagagagacttcagacttttcgcacgagtcatatctgcgacagatttctcgttcagtgcatcttcggtttcctttttagacgccatgttaccaatagagtcgataaacacgatgactttttcaccacgctcaatagcttcaagctggttaaccatatcgatttttaattgttcaaccgactgaaccggtgtatgaattacacggtcagggtcaacacccatagatttcagataagctggagtgataccaaattctgaatcatagaacaagcagactgcatcaggatacttattaagataagcactaaccattgtcagagacatgttagatttgaagtgtttagatggacctgcgaagatagtcaacccggactgcataccaccatccaacgctccgctgatcgcaatattgagcatcggaattttagttctaactacatctttctcgttaaagaattttgatttagtcagttctgctgtcattttagaagtggatgctttaatcaggcgagattttaagtcagacattcattatattccataagtctccattatatttttctcacaggttaaaggatagggtaattatattaccttgttcttgaagctattaacagaagttccatttcttcttggtgttataaaccactgtttccgtatctatttcataatgcattttacatccaacacacatgccatgccaccagcaatgcattccatctgagccagtagttccttcatgaacaaactcatcagatttacatacgaagcatctgaattcttcagccttgaatatgttaccagctacatcagatttattatagatgttcataagaggtcctttgagggctttcgccctcacagatatggttctaccttaccaaactcgtggaaggcctgagatttcactcgagtgttaatacacatacgaattgatttcagaggttcgttatcaccgaataacccacgtctttcgccgtctttagatttccaacgggcttgatttgggaaagcagcatgtagttgttcaagggctctattctgtcgagcagtatcacgctgtgtagaacaaccaccaggagactgcaccttaccagatttaacgaggtacttaaacagagccaggtgaggatgacccatgttaattaattttagaaaagcataagcatcttcgttaaggtcaataattccgtaaccaatatcttctgctgtaagtttagtcaaatcatagaaagtattggtgaacccaaaactattctcgcgataatgaccccagcttgatgtaattttgaaaatcggcaagcgagcatggccatgataataaccacaatccatagcagtctctacgtatttgaccatatcatcaaatacctcttgactcattgcctcgccgacaccaagtggaacacggcgatcgtcgcgttcacgaatttcagtcagatgaatggtagtatcatcatcaagcatccaaattcgctgccctgcatacatttcagtaatcagacggcgagtaccagcgattccatcaacatcatcggggacagtaacgattttagcagcatgaccgtgccaagtttcgtatgcttctttttctgattcacgcactacaagatgcggaacataaccttcaggaaacatagtcagggcagtaactgccccggcacgcttataacttggaattacaaactgaatcatttccactcacctttatagtctttctttgcaatatgagtttcaccagtataagcatagttatctacaagatagaaatgacgctcatacacgtgcaaagacccgacgttccaaataatgtcgccaactgaataatttttacctgatgcattcagaagtttggttaactgttccagaacatagagctgccatgcatagtcattacgatatccaaatactacatcatttgaacgcatgtttacaacagcatgaactttattatcacgaatcagatactgaacattgttagtacacatgaaatcactcatgccatcgcgctcaaaatcatactgcatttgaggccgtgtataaatcataattccgcggcgagaatcaggattactgataagttcttttgcacagttagcaaactgcgaatagttttgtgatgaccaaactgcccagccatagttagaattaatctcaccatgtttggatgcaattgctttccaaatagctggggtttcacctggaatatctttaacgaataaactttgagatttataccactcaagttcccgagcaatatatccatcattaactgcgccaaaaattaggttttcatctgcaataaatgatgcacctacgatttcaatagtcttcacacccgtcttatcaatcacaaattctttgttgagcaaagcatcagcgaattcttgacggatatcttgtactgtcattggagttacaatcatgagacctcttatttaacttgctggataataattgtattctgctgtgcgttagaagcagaccaaatcagcgcaattaaccaaccgataatggaccaaccgaatactagatttgtgataaagattccaccccgtgatttatgcttacgactgcaagctacaaaggtcggcaaaaaatagatgaagaaaagaatgattaaaccaaatactgcttccatgttaatctcctcagttagacatgcatttgttgtagatgtgattttggagagattttaactgctccatacgttgtttatgctcattataactcaatccgccgttagcaaaatcagttaaacgaatctggtcattcactgctgccgcttgagcagtacatgtacgttctttttgagttttacgcagacgcttaatttcttccagctcatgcttattctgctcaatcatgtctagttccatcgcagatagctgacgattaggattagctttttctttcgccaaccgacgctcaaccgcgagcgattcagcagagacctggttgctagcacgatagtatcctacagtaccgccaattgctcgcacctgtccaacagaagaagccgggacgatatcaccttgtggcatttgacaaccagtcagcgtgagagcaacgataacagcaagtaacgatttcattgtaatctcctcagtatgttatttcgaaaaccatggtaccacatccttgtggcaaagtaaacaacttttttaaaaatcgaacatgtcaagaagagacgatttctcttcatagtctaaccctgctgcttcagacatacccgtcagaggtttaacgaacgatttttggaacagaacactgtggtcaagccacactagaacttcctgtcggatttcttgtggcagctcagtgcccgatggccatgccatgcatttctcaccgtacgggttaccttcacgcagcgggatgaccatcaccttctcgccttccatgattggtgttataccttcaaagcccgcggtagctcggttatacgctaaagcacctttgacgtgatacggagtacctttatctggatatcccgcaccatcatcatacttaccgatgttgttggcggtcttaacttctgctattactttatagtcaagttcacgatactcagactcaaactgcttataatattgctgtaaagattcttcaccttcctgcagcatacgccgaatagattcttccaacgcattctgaacagcagttggtgtagaactttgctgagtttccatacccatgattttcaggtgcggttctgcataacgagtaccttccatatcatacacgttcagagcatatcgtttcttcgctttccaaaatccaccaatgccgtttgaacctaacggaggacaagaaatagcttcacggtccatgaacattaaatgttctttgttgttcatgtattcacacatctcacgatatgattggtcaatccaaggttccattttcttcttaccgaattggttcaggaattctaccaaatcgttagtttctttgaaacgctcaagacctactttctcaataaccttatcaacacaaacgtaaattgagtcagtatcaccggctactacaaacgaatgtccttcagtaccgcataccttgttgagatattcattaactttacgttcaatccattggattgccatttgaccaaacaaggtgattgctgatgcgttacgtaaatcataataacggaagtaaatgttacccaatgcaccataaagggagttgatcagaatcttacggtttaactggttagtgttacccaagatttcagcgtgtttacattcaaacatcagtttgtcaagacactcttcggtatatgtcagcagttctgctttcatgtcatcagagaaatcttcatagacattaacttctgcgaatttatcgatagttccaaacttcttatcattcagaacctttttaatcagttcttgatttcgtttggcacccatcattttatttttccactctttacgctgataaaataccttcgcgatttcaactggaatgacaccatctacatctttacgatacatccaaccattgggtgaacatgaatattcatcagacggacgaggagcagtcttgttaatgtactcacccagcggatgaagtttaaattgtccaacgatagtttctggtgaaatattaacttgtcggattattgacggatacagagatgtcaagtcaaacgacatgatataacgatatgcagcaggaactggttccttaacatacgcaccaggatatgactgtttaacgtgagaacgactttgcggaataactttgtcttgctctttcagactgttaaagatgattgcgtcccaggttttaatcgggctcattacaccttgatatggcatcttcgcataataagacattgagattgccaggtcaataaatccacgaacagcatcaattgcttgtaccgattcaacgtcgatgatgttatatgaaatatatcgttggtgattagtttcacgcaatttattgatcggaccatcatatgctaatttacctttcttggtttcataataagcaatgaaatccaacttatatgtcggttggttcgtgaaactaaatttcttatacaaatccatgtaatcaagaatagtcacacccatgatagaataaatttctttatcaccatacatgtttgtgataatcttagatgaaaccttgttcagaggagagaaccgtttcatcgtacgctcaccaagaatctgtttcacacgattcatgatgtacggaatatcaaatccttcaatgttccagccagtaaaaattgctgggcatttctgttcccaaagattgatgtactcaagcatcatttctttttctgaattgaacggcatatatactacgcggtcaagaatatgttgtggaacttcatcaccgccttcggaatctaaacgagcagcgagtttcttgtcccactcggaaacggagccataaagcgaatgcagtaaatcaaacacatagaacttatcatcaaccgaatcataatgagtgatagcatcaatttcatattctgctttcatcgggtctgggaattgagatgcagtaacctcaatgtcacagtttgcgattcggatgaattttttattatagacgatttctgaaccgtaagtatcactgatatacgcgagtttgaaatcatccatacccattgcttccattcccatatcttccatacgacgcatccaatcgcgtgcatctttcatggttgggaatgtattcttcttgcaatacttgccatagatgtctttgtactttgtttcttccatgcaatgactaaacataacaggagaatacggaacacgacgcatgcgttcctcaccagtagaatcgatataacgttctacaatgtcattgcctagagtttcaacgctgatataaaattctttcatgggtttcctttgtttatagaccgagttattagtctttagatgggacaattatactccaatttttataaagtaaaaggcccgaaggccttttcttatgcaccaatcgtatatttagattttaaggtccattcatgtttctgcttgaacgtaatgacccggaagttattctgcatctgagcaagagtttgaccacgattaatactcagtagaccccagtcagcaagtagttgtgcgattgagtctcgacgaatttcatcttccaaatcaatagtaacagggcgaccatcaagcttcagcatttctttaaaatgaacaatatagtaacgaccttgtttctgaagaatgtggcagctttgatatagtaccttatctttgttattagcaattcccatacgggttagagtttctttaactttcaggaagtcttcaggctgtttcagtgtaatttcaatcatctttaccattccaatgctgttttcttaagagttttctgttctttcacgtttttcgtgattgtcttgaccaattcatcagtcacaagacctttcattttcttgagagcaggtttaagcttgtttttagcttccagggtctctctatacatcctagcatcaatcgcattgaccttgtaatatgtcattataacttgaagaatcaatgcatcctggatgttttctgttaacttagcccatttaccataccgacgacctctaggaacagaggccatcatatagttatagtgtgcttggtcagataacccttgaccaacaaggttcataacataaaccgaaggcatacagtcagggtgttgagaaagagcgttttcaaccatgaattttgaataatccatcgtcgagatattcaaatgctcttgcttttcgttaatagacccgataattgtgaagaattgattttctgctttttctttatatgaatcagataattcctggactttcgtccagtctttacctaaccacgctatttgatgctcgttatactgatcatcatcttcaaataaactcatcatttccactgcatctctacaacaagttgaataagcatataaaccaagtgtaattcaatcgaagctgctatgccatgatactggttattttcaccgatgatttcatacattcggataatgcttgggccagtaaccattgtatacagctcagaagaaagtttatctacaaaccaagtatagtctgctgcatatttcggagcaagagcacggagttctttgatgttcttagttttaatagcttcaatgacatcttcaattgaaccacggtcattcagaacgatagacaagatacctgcatcaatcacacccttagaagaataatgatcaagcatgttaatggtcttacggaattctgggaaattctttttgaccaaagcagctacaactttcttatcttcaactaccacgccttcattttcacaaattgcgagacaacgcttgagcatctcgatttgcattggcttaacatcagatggagatggtttaccaaaattaattacacggcaacgagactgaagaggtttaatgatgccatcaaggttgtttgcagtaatgataatagtacagtttgtgctatacgcttccatgaatgaacgcagatgtcgttgagattctgcaagacctgcacgatcaaattcgtcaatcacgataattttctgcttgcctgcaatagaagcagaacttgcaaatgcagttaacggtccacgaacgaaatcaattttacagtcagaaccattcacgaacatcatttcagcattaatgtcattacacaatgctttagctactgtggtcttaccggtgccaggagaagtgctatggagaattaaatgaggaatttttcctttagctactaaagctgaaaaaatttctttatcttcagcaggcaatacacactcagaaatagtacctggacgatatttctgttcccacatgaagtctgcttcgtttactgtcaatttcatttatatttcctcattcagattaaagatggggccgaagccccgaaattattactcaaaatcaaaggtactgtctgcttccattgctactacataagaggctgatgcaccttcaaatttcgctgcagtctgtttcttggagccattcatttttgcccacagcatcagtttataatcgccgatagtcattttcatattgctcatgttgatgataaagttgaagttaccgtcaccttcataatcaccgagtgtcagggaatacttcggacgggtcagtgcagcgtcttctactttattataaccgcgcagaacaattttaccatcaacattggtgatagcaattgtgtcaatctgcatgccacgagatactcgcatcagctgttgcaggtcttcacctttaaaatcgataattacgtttgccaccgggaatgggattggtttagtcgggaacacgattgtgctcgggtcagctgctggccagaagatagttgagcgagcatctttaattgccagattaccatcttcctgcatgataatatctgcatcatcaccaaccagagacagaatgctcagaaaactgttcaggtcataaattgctacatcagtatcgatggtatcagaaattgttgcttcagcataagtcgtaccattaacagcacgagtcatgataaaattgccaggtttcagcatgataccggagttgatggtggagaagtttttcagaatgttcagagtttctttagagaatttcatttcaataccttttaattaagttcaggataattatatcaagctgcgaatgtagcagttaattcttctgcaacaatctgacctgccgcaacgagttgctcatcagcatctacgcagtaatcattttctagacgttcgccaccatgacggtcagtaacaattttagcaccagccttgattgattcgttgtaatgcttacgcatcagttcaatccatttttctgcgacttcatcatcgatagatttatagaaagcaaagcgagcttcggaatctttaatcttatctttgatagcctgtttagtttcttcggtcagagccagaacccaagacttacgaatacgattttggttattcgggttggaatctgcacgtacgtttttaacctggatatctttcacatcaacaaaattaatcattatatttaccttaatcgtaataatcttcaaccatccaaccgggattcctgctggacatgactctattatattcatttcctgtaaaagcgtttcgtaacatttcttcagttacgagatgttgctcattagaaaacaaattaattaacacatagcgctttaattcaggaaaggccaacagatgttggcccgtagtaaactcattcattccatcaccgtgaatcgtccgaccttcttcatttgaaggtgttggccatatgcctgcgggtcgtggtcacggtgagaaataataaacacattagcatctaccatcttattcagaatagcagttattgccttaacaccttctgcgtcggtagccgagtcatagacttcgtcaaggaacaaacagtttattttaacaccagaaaccttttcagcaatatcacgccacgtgaatagtaatgctatatcaattcgagctttttcaccttgactaaacgaggcataactaaattcttctcgtccacgtgatttaatcgtttcagagaactcttcgttcagtgtgaacgaataatcagcttccataatttttaggtagctgttaatttgcttattgaacatcgggatgtacttcttgatgatagctcctttaataccggagtctttcagcatttcagttaaaataccacgacgatatttttccataaccaaattagttttgacgaggataattttatctaattcttcttgtagcagtttaatcttgtctgagttatcaataaactcctgagatgctttatcaatagctgctttaatgcgacgtgccttttccacagcagtgatagtcatttgctttaaactagacatttgagttttgatatctctggcacgtgaccggacagtgttatactcgcgagctagttcatccagttcactctggcgcgtctttaactcaccaagaatggtattacattcttcaacatgatgattaatcttagtgattagagtgtcattagaatgcaaatcctgcaagcacgttgggcaatgaccacctttatcatacagtccaagaacctttgaatatgattcaattttagaccgaattttaaatgttttaccttgaacttcttggattgactctgctgggtcgtctccaattactaactcaagcagttctctctggagagtttctaattctgctttatatcctcgtgcctctttcacctgctcatcatacatcgcctgcaggcgagctacgttatcaccagaaagtttcttctgcttttctgcatactcatgatgagttttaatttcattagtcaatgcttcacgctgaacatcattaacctggatttgctgattgatttctcttatctgtgtcttgttcagtttgtccatatcagctaaaagagacacttcaagcaaatcttcaacgagctttcgtctattagcagttgataaccccatgaacggagtatatcctgccgttcctaatacgacaatctgcttaaacgatgtgtatgacatgccgatgagactttcaaagtaagattgaaaatcctttgaacttgcggcttcatcaagcttattgccatctcgtaaaatctcaaagacattcggtttttgtccacgtttaatgtagaaactatgaccgtcatactccatccacagttctactacagagtccttcttattgaaggagttaattaattgacctttcttaatatcacggaacggtttaccaaataaggcaaaagtaatagcttcgagcatagtacttttgccaccaccattcttacctgtgattaaggtcttttggcatttatcaagttgaatgtcaatggccgcttggccaactgacattatattcttatacttgacacgatttagtttaaaagtcttcactgattttgtgcctcaatgtataactgtttagacataacctttaaggctttgatatcatctgcggacaggtcttcaagtgcttggatatattcttccattaaatccaataagcttttaacttctacttcttcgccatcttcagactcaaccgagttgtcaactttagaaacagttcttaattcatgtactaccttttcaagttctgattcaaacttaggaaggtcttcatcgaccgcagtgataataatgcgtactgcgagattacgaaactcttcaaagtcaatttttccagtaacaggataaatcagttttctatgccaagtgatttcattagggacgaaatcaaaggttgataattcagtgtcttgaacccagaagccacgtgggtcgttctcgtcacccgctgtaagcgtccaaggcgttccgatgtacttaacgtttgctgcgcttgatatggtgtggaagtgcccagaccatacttgtttgtactttttgaggaaatctggttccagcccatgagacttcattcctttataaaaataaaagccattaagctcccagtgaccaatacagtattcagcagacgattctttgatatgcttcatgatttctgacgtgttctcttcacacatccatggacacaagtcaatcaaagtcccatcaaaatccatagtcacgggcttttcaataacagtaatatgcttatacttaccaagaacttctgttgatgcattaggcgtcaacgtattcttgtagtgcatatcatgatttccgacgatcgtaattaagttaattccttctttctcaagagactccgcaatttcacgagcgaattccattgtcttatgagtgatagctttacgaacgtcaaaaatatcaccgtattgaatgatagttttaattccatgctttttggcataatcaatatgctgcttaattccgtgtcgttgtacatcctgtacccacgggtcatctgcgcggacacctaaatgccaatcgcctgagtgaataattttcatataacctctctagtagagtttaattttatattattccatgaatagcaaaaagggcccgaaggcccattacttattttgtcattaactcaaattgttctttaaagcaatgctcagaatcttggtgttctaccaggaattcaaatgctttatttcgctctttatcatagagcttctggtcagatgacagatgtttcattcgttcaaagacttcatttttattttcatcattcaaccacagaatgccagaatcatgagaagtcaacggctttccatcaacccggaatttcaaagcatcaccagtagctttatggaacacaggaatagttccacaagcgcctagttctaaatgcgtgtattccagcgaacgctcaaggaatttatctggaagacgtgacagctgataaccaaatccagactgagacatacgctcaagcatttcagagttaacatatcggtcaagaacttgaggattcagacctggtccagttttaacctgatgataatgacggcaataatcaatttcatagcgttctttgatgttaataaatgcaggactgcgttctaacccttccaagatagtcgttttgcctgcggggcgcagatgactttcatgaaagtcaaacatcaagaaatagcctttccacgtagtagtacgaccaatccaacgatgaatatcaaaatcaatagcagagaagtctttccaatacttatcacgaattgctttgatgttcatagcaggttgaaagttataaaccggaggagctgagtcagaatcatcaaagaaactcaacccgccgcttggaaaatattcttccattagcacggtattaaaatcgccgtttgagctatgactaaacagtacatcagcacgcttaacggtttcttcaagaccagcatttctacgaagtgacaatgctctatggtcatgttgatatacgactaccctaacttcaggtttaatgttctctatgagcttcttatagttatcaatcgctgcttctggagcattgatagcaggtactgagttaatgataagaatgtcacatgcgttaagcagagataaagtcttatcatagtcatctgcaagagacacaggaatagttacatctttatagctatgtgctctattacgagtaaacgctttatctttagcgtaaatgatatttacttcatggccatgttttactaaccactcacggtgctcgagactgaacttggttacgccgcatccctcaagtccgcgagccattaaaatattaatcttcatatgttgacctttgttgttaattttgaatattttaccattcccgtaataaagcaaaagggccgaagccctttaaattttcttgtatacaacataacccgctgcttcacatatacgcttagcttcttcaaagcgtctaagcatatctaccttagcattatgaatcgcttcataatcgggagcaggtgcttctctccgagcagtatcacatttataacagaagtaactacgctttggtcctgtataacgttctgaacaattactgcaccggcatgtataatttccttccggccaatcatgtccaggattagaacccatcaaattcgtcatacatcccaattctcttcactagtaataaaatcagggtgttcatctaaatcaatgaatccccagttctcttcatttaccattcataccaccgtttaacttggaaggtgtcaacccagacaagagagttcttatctattagcttacatccttcggtagagcctaacacgcgatattgattatctgctacctttactgccatcgtaccagtcgcagtgtttaaagtaaatcctgcgtctttacgaacacgtttaaattttacttgtaccagcatttagaatgtcccaaacagatttacgagaggtattccaacaagtcagaataatctcatcattaaaaggttgttttaaaatagtacgcagtttttcaatagcatacttgtaagcagggaaattattgtctaataccgcgtctccagcatgagctcgtaatcgctcaagttcacgacggtttttacgaacaactttgttggctcgagcaatagcttgttcttctgccgcttccattagtttctgttgcagctcgtcgcgctcttcctgggtaatattgttcatgttattcctttggatggtaatttatttcaaatgtgaattcagtatcagtccaattataactgtgttcaattatagcagaatctgacctgaaatcagcgtcatgtggatttttcgggtcaatgtgaatatcaagatcaagcacctcccttaaatacatctttagcaaataagggatagcgtctaggtcttgcacatcttctaaaaacccgtcgaggttaatcttcagcctcatataaaaattccagattaggtccatcgcttgtaggttcgctctttttagcagaccctggcgccttataagcggtggattcatactgcgtcattttatcgtagatgtcctgaataaaggtttcatctgctaacgcaaccatatcatcgtcccgtgaatcatacacgttgtggacaaaatagctgtatttctttgccatttctttgcgttcttttttgatacgctgaacgaatgcattgaaacaagcttgggttatatacgcatgcgggttatcatacttagtttcatcgaagttgattaagcctttaattgcggcttcaatcccgtctgaaatcatttcttgcttccaggattgggtgtatcctgaaaagttgaaacgcttactcagaccttctgcgatcagcataatagcaaggccgatcgtatcgttctgttttactactcgaggaccgccagcagcttcagactcccgacacttctctttccatgcacagattgatttatacagttccttgttatttacataattactcatattgcctcttcgcttcaattaataatatctattataacaaatttgggaagcgagaggattaaagcattacttaatcaattcagcgcatgcaattaatttcatcatgatacgataaaaatcgttatacgtgaaatctaatggaacatcaatgacggcttcaaaatcttcaaatacacgctccattccataaccagcgatatcatctgattcagcataccagtacgttccatcttgtgcaaaagttatttggctattttcaagacagaacacacctttaatattttcatgtgtaagagtcaattgaattttcatagttcacccttcataatacgatagcattggaacagctgttccatgatacgtttgaactcaaccaaactaagttcaaaccaatcagattcatctacttcatgcatcatttccatgaatgaagagtataaactttcataatgggtttcatttaacatagaggcatgcgtttcccaatacatgccctcttcattgtcaaaccaaacacccatataagaatctatagtaaatccgccaatgccttctactacaatcataatttggtttactttagccatgctttcaccgagtcaatagcatcttcaaatttagagaaagcatccacggatgtgtattcattctcaccagagcgttcataaatccaaaacgcgtcaaaatcttcttcaatgatgaattctccgttaggagtttcaatcgtgtttctgccatcaggcgttttagatataaaccatccaagaaaaccaacttctacaatttgttcttcagtcatttagaatttccaccaattgattatagtttaatgcctttccagaagaaatcataacattacaaaatctgtataatgcttcttttgatactttatacacataatcagaagttgttataatgtatgaaatacgtacaaatgttggggatttttctgccaattcatacgccagttttctagctctgccaatatcatcggcaaacttggtatcagcaagcaaaatactatcaaatacccaacggttagtaaaaatttctgtgtatagaataaccttacgcatcaagatactctcgcagttcctgctcgtttaacccttcttgccacatctctgacggagatggaagttggctgtctagagtggatgaatcaattggaaatactctgataattacgctagtatcttcatcccattgatttgcgagtatccgtttagcttgactaatgtcaggctcagaatgagcccggatatacttaatccttctatgccatacaccggtaggaatagatgcgcacacgatatatgaaatcatttagccgccttaaccgctttaacatcgcggaagcctttcttacgttgattcttcatcttacgaatagtgctttcagaaatttcaccgatacccggagtgattggttctacaccgaaggctttgatgccaaattcagacagaagataagcaaccactaattcacggatgcgggctttaccaattttttggccttcttctttcatcgtaccgtgaagctcaacttcccactgatcaagcaaagacggagttacacaacgtccttcttccagcattgcagatactttatcataagcaaaagagttcagtacgtttttgattgcttgggacatattaatttcctcagtaacgattgttttgacagaggagattttaaatcaaatctcctgtagcaaatcaatctttgagagattttaactcttcgagcatatcgtagtattctttactagcaaccggagctacagtacagtggtagctattgaattcatggtatttcacgaagcgttcaagttgccactcaatcaggttgttaattcggtgaagcagaaccccctctgaaccgacgtagacaactacttcaaattgaagcccatcccaaattctggtacggacgatatcacctacattaaatgttttcatgcgatgtaccaatgttcgttttgccaagactcacccttgtaccagcgagtcatatcatatccattttcatcacagatgaccttgttcttcatcaagaagtattcgtcatcagtaaaatgcacatgctttactttacagcctttactcatagcttctagagcttcttgccaatttaaccagttcatattttcctctcgagttaaacggtatgctgttatccgttgatagagctatagtatcactcatcaactagcttgtaaacaactttgtgaaaggagtttaaaaataaaagagaggtcccataggaacctctaaatgaagggtatagaaatatacagaaggtggtcaagatgaccttagaaaggaactggttaatcttctatgatatctgggtcatgcccagcagcaataagattggttttgaatgttggaatgtcatactgcttaacgttatccataaaaatgacaggataccgaatagcaagcgatggatagcacccgatgcgtttagcaagtgactcaatcaacggacggtcataaaccggttgaccgtcaacctcgttgattacgttataaaactcatacggaagttgtagcttatcgagcaagtcacgaactgctttacatccagggcatctccaaacttcttccgggatgccatagatttctatcatagttcagccttaatctcagaaatcaatctttcaattaattcaagtttatccgctgtagtcataggataaattttgtcaacagtggcttcttcgagatagcaacggtcagcatcattgagtatacaccactgatcaaaatcatcagcatctatgctaacaccgttgaaggtcttaactcgttcaacagacccgtcctgtgtcagagctgttaccaaaaatggcttaaatttaagcatgttgtagaattcaacatcctttgacgatgcgttatttagccatttatcaacagagtcttctttaaacttgtaccacttatcgcaacaaaataattctatcatttcatgacctgttgaagtttagcagtcagagtattaacacgcttctgaaattcttcattagacagtttttcatctttcttagtaggattaatccagtcagaaataatgatgagaacaataaatggaatagctacgaaagcacctgcggttaatgcaaccagtgcaataacattagaaataaatttacgaatagcattaatgaatttcataattttccttaaatagttaagatgaatgctgtcatagccagaaattctggtccaaacagttcagtagccatgtggttcagagtaaacataattttgtaagtcagcatataaatttcctcaatcatgtgtccaggtagaaccgtttcttacccagagtctttggttgtcagaaccacgccagtttttagtagttggcagtgatttctcatatttcccatcaattataacatcgatgtgttgtagcaaatctaaatctttgatatcttcaaacttatatcctgtccacatccagatatctttctccggaaatcttgctttaacccaagaaactaaatttgaaatctcttctcggttctgtggataaagtgggtcaccgccagttaaggtaagaccttggatatacgatttgcttaagtgagatgcaatttctttaacggtattcatagtgaatagctgtccgttacgagcattccaagtagatttattataacacccttcacatttatgcaaacaccctgtgacaaaaagaacgaccctgcatccagggccgttcacaaagcaacatggatatattctatcatagttcatttatatatttccaattatagccttcaacacttttgcgttctccatttaaacattttaaaatatttcctttactagaaatgttaaaatatttcgcagcatccggtatatagttaaatgtttttaaaagaacaccgtttttatatgcaccaaatacattgagagtatatttttctcgaagacgctggtgctttcttttcataatttcaggattttcatacgccagctttaatgaatttttgtgccgctcttttacttcaggcttttgcattgctagcttagttaatctagaaattttgcttctaactttatcgtctttcattgtatttgataaatttaataaagttttatttctaacttcaggattttgcattgctagcttagttagttctgcatgtctttttctaaaatcatcattcttccacatggtcttagacaattttgacatagaatgatgaagcagttctctttcttttgaatataatttaagaatttcatccaattcgtcagtattaaatctattaacgtttgagtttatcattctatgaaaggcataacacattttaccgtttccagtttttgccaaataatagtgagctaacgcatggtcatagtatgataagttaacgatattccatttatctgatttatgctcaggaaatatagatttaggaagcacatggtgtgcttccgtctttccttttattttagaattattgtaatttctttgtattaaagctgtatacgatagtaaatcgttgtcatcttcgaatattgaagatagcttatcattcacaaaatcagaagggtagattctgtcgaaattcattgaaccttacctcattacgtgcttctacttctgcatcatatttccagggctcatcagtttgaatagccccagccgataatccactttcggggtcacgggttatagcaattccaagcgggtgcagaacctctttgttgattttccaaatcaatccccattcgctaagttggttccaatcaacttgcttcattggtttctctaacatgttttaccctatgcataatttctttgttcttaccaagattgaacccacgctcagaaggattaccaagatagccacaggttctgcggatggtattcattttctttggatcagtttcaccgcaaatcgagcaagtgaatccattttcagtaggtgtcatctcatgagtagaaccacaagaaagacatttatctactggcatattaacaccaaaataatccaacttctcgatagcatagtcccataccgcttcaagaccttcaaggttgcgcttcatgtcaggaagttcaacataagaaatatgaccacctttagcaatagaatgatatggtgcttcgcggtcaattttttcaaaaggcgacaggttttcttctactgacacatgaaaactattagtgtaccagcctttatcagttacgcccttaacatcaccaaacttggcttggtcaatcttacagaaacgatagcacagactttcagccggagttgagtacagactaaaggcatagccggtttcttccgtccacttgtttagcttagtgttgatgtacttcaggacgagtttaccgcttcctttaaaagtaagcatatcaaattcgtggatgccaatatatcctaatgaaattgaactacgtccatttttgaatagctcaagaatttcatcatcaggtttcatacgcacaccaaaagcaccttcctggtaaagaataggagcaactgacgcagtaacaccttcaagtgatttaattctagttaaaagagcttctttacaaatatcaaggcgttcatccagtagtttaaacagtttattactgtcatctgaacttttataatttgcatccagagctatcctagggaggttcagtgttactacccctaggttattacggccatcaagaacgggtttgccagaagagtctctccaagcaccaaggaaacttctacagcccattggagatacaggagtttctgaacctgtaattgctctattatttcgagcactgatgatatcaggatacatacgtttagctgcgcattctaatgcaagctgcttaatatcatagttcgggtcttctttacgtagattaatgccttcttctacaaacatcacaagctttggaaagattggagtaattccatcgcgacctaatccacgaatacgattatcaagaatagctcgttgaattaatttttcttcccatgacgttcccataccaaatgtgatagtcacaaacggagtttggccatttgagctgaacaaagtattcacttcatattcatatgcctggaaagcatcaaatacatctttctcggttttagaaatagcgtaatcttttactagagctacttgatatttgcgtgcatcacgtacatgtttagcgaatgtcttctccacataaggagccaatactaaatcgacgttagcaaacgtagttccaccatactggtgagatgctacttgtgcagtgatttgcgccatgatagcagtagctactccaatactcttaggagtttcaatttgagcgttaccaagtttaaagccattctgcaacatacctttcaaatctactaagcagcagttagtgaaaggcaaagctggactatagtccatatcatgaaaatggataacaccttctttgtgtgcttccattacagagaaaggaatgacctgattggcgatatgtttagatacgataccggccatcaggtcacgttgggtaggaaaaacacgagaatctttgttggcattctcgtttaaaaggtccttgttggttttattaataagtccctggatttctaattcgatattcattttaaactcttacgaagctgcttcttgtattttgaagcaagttgtgattttccatcactttcctcgtatgtaaacccatgcaattccatttcagcaatcatctcaggcttaccaagacgtgaaaagcgtttagccatatcggcaacatattgcgggtgaatattactgtctttacgattctggcggagatagaccagcaaattctctaaccattcgaggtagtcaatatcttgaccttttaaaccagagcggttgaacttatgcttcatttggccttctgccgcattacacaggttacagagcaagcctctgacctttcctgcattgtcaccttctaacgcatggtcatggtcgaggtgattcttttgaatatcctcatctaaaggacgtttgcagcaaggacataatccgttctgtgcctgatatagtttttctttttcttctttatataacttaccggttaataacatactcttacctcagcgattagataagagtatttatagttaaattaacgagtaactactatagatgttatgattagactcttttatgcagaaagaagtacagaaagcatagatgccttcataatcatccgcattgaactcaatatatgaattagtttcttcatgaagaagactcattttagtccaagccattccattgatgtcatcgtcgtaatagcctccactaaattctactacatcgccaacttcataccaatgactgcgtaaaatttctcttgtaacacgatgaatatcagcgaaatcgagaatttttactgtaatagttttagtaatgcacgatttagacatggcgaactccaagacgggtttccaatgcgacgatgtaatccgcggctttttgcattaaagcatactcttctgaatcacaattttcctgtccagcaaatgcgtaaagagctctggtaattggaacgattgcgccttggaaatggttaagtttaatttcagaaatcagaggaacatcttcaccttgaccgatttctttaatttggtgcatcgtatcttcactgtagaagcaccagaaccaagattctccgtgtggagttgggtcgttaatagtaatgattttgtttgtcagcaaatcaattacggcagtaattccacacatttcaaggtcatcttcattaactacagaaatgacttggaacttaaatcccggaataaacacaggaaattgctctgttaattcgtcatcattaataatgacttcaaactgcttaccaataagtcccattcactttgtcctcataatcaagtaattcatttatagtgggttcagaagtattataatcttcttcaggaatagcatcttcctctggctcgacagtttcccagcgagccgcataccagggttttagacctttgctactttgcatggtgttggttcagaatcattagcagaatcatgttcaatacgccattcaacttcagtgcgagtaaccactttttcatgacgtgtaacgatatctacttcaggaggactataataccaatcagtatgatatgagcctgaacgagattctgataccatgaaatgaacgccacgcgctggataataccaaatttgagtgcggtcttgatacttgtgctcttgcgtccaatctccatcttctactaaaacaaagatttcttctgcatcatcgtctggtgcattaggcggatattcgaaatcgtagttgtcgtcccaaccgccagtgacgccagcgatatgtttgatttcttttactaattcagcgttagtcattttaacctcgcagcttctgtaaatcttcatcatcaatccagctttctaaaccggatggaagcgcacattcaatttcccacagcaattcttcaattgcttgcaagcgttcaagctcttctgctgaaatagttaccatgcgtggagcttttaaatcgccaatatcataactcatagttcttcctcatgttaatcataatttcaccatacactcgccgtatttccatttagacataaccttaactccattagagtaagttacctctacctttgctcgatgatttttgatttgtttaatctcaccggtttctaatccgccatagccataataaagggctacaatatcaccctcccgaaggagggttccacgataatcatgcattgaacttgaatttacggagttcatcaaaaccgccgatatgtgtaccgtcaggagcaaaaatctgaggcatagttaatccaacctgtgattcacgacctaaacggcgaagcaaatcactgataaccacttcatcaaatacacctttttctggcattacattgatgaatgcatattcttgcttcttaacgtcgagcagacgttttgcgttatcgcaaaatacacacttatgaatgctgctgtcgtaaccaaaaaccgtgaacatcttcttctatttccttaaatacttgagcttgaactgttttccaatctgggtggcgtactgctttaacgtaatttgtcataccaagacgcttcattacttcgccatcaatagctgcttgagcaaaatttcttccgcgggtcatagctcctttgagtttagaactatcaactatttgaccagtctcattataataaaccgaatacatgagtagcattactcgttcggcttcttccatatatcgtttacgagccattttcagccttagtagttataactaatgttttaccatctaacgcatcgagaatatctttgatgcaattatctggcattggttgaacgctagctaattgcttggcaatatcatcaggaattcccatacgtggtatatttaatttgctaaaatcaattttatccattagcagttaccgggaagtgttctgccaatttagcagcaatggcagcgttaatttgatcagcgaaatttttattcattgcattaacaatgatttcttgaattcggagattagctctttcaatagacatcttaatacgaccttcagcttgcttaacagcgtcatcaatagtttgacgaaccatatcatcaatagcatttttagcgcatgattgggcagcgttacgcatcatctgcgacatttcttctgtagcagacatatcattccaaccgcgagtatggaacatctgctgaacttgcttcttaacttctgctcggacatctggaatagtcacagcagcaatattaacttcagattgtactgcttgcttcagcttattctgtgaatcttttaacaccatttctttaacgatgttattgattactgactgttgcagttgagcacgggctgctgtaccttctgggaataactggcgtactgcataagtatcaagtttaatatcaatcattttacctttttcactccaggaatattagagatagtttcaaatacttcgtcaaagttatctttatcaacagtgactaccatagtgcgagcggtctgtttctttttccaacgtttaaagaaagttgcaagactcaaatcatgggaagtgaagaaatcatcggttttgtaaacatatccgctttcaatttttactacagcatcaggtgaagggtcttcatattcttctacttcaacatcatcaaagagaattaaagtatcatcatgataatagccttcccagaaggcttcatcgttataaaattctttccaaagcgcgccagttgttttcatttaatcaccttcttccaagcttcgtgagcagcgcatgctaatacttcatcatcagtcaaattaaacttgccttcattacgacgagcaatcatttcattgaattcagtatcagttctaagcatcatgttaagaactgtaaaatccattgtcgctcgaagatattctttaagctgcatagggtcgatgccactttcgtatgcgtcaagaatcatatctgcaatgatgttatcaaagtttttgtcttttatgaggttattagcatactcgacaaaaaacttagtattagcaccagtaatagttttagtaatcattttaattttctctcaaatttatgcttacaagtccggcatttcattttcagaatatcggttgtccaatcgacaagctgtacttgaatactaccacatttttcgcaaggcacaacttgtttagctgcagcttctcgacggtctaccatttcaagacaggcatcccagtcaattttaaattcaggtacaggcggatactcaaactcaatttcaaggtcgttatcatcaacgaccatgtcttcttttaattgatttttcacagtaagctccgggcatactcgagagattcataacgctctttgtattcgttaagcgatttaaccaaatctgccatcatcaattcatgtttagccaattcagcttctttagtatcaatgaaccgcttaacagattccatttcaattgcaatagaattcttagcaatttcaatatgatttactgctgtcatctgtaaaggcttaacttgagctaggtacatatgagctacatcggtatcaatgacatgttttgtcattggaggaaaaatcttaaatgggtccaaatgcacttcaagagtagatgaactttcaagaagcattttgcattggacttcttttactatatccatatgatttaatgcattacgaacctgagccaaaagagcacgtgatggataatttccactagtccaatggctattaatatgaatacgtactgttacgttgtcaagttcttctgcgcgaatactgtgaatccctcttggatttttcggattagtagatacttggtatttcacacgatcagtatctttaagcaaagaaattgagcgattaagaatacggcgcagattgctattgaactcagtacagaaaatccgcgaagcagaatgaccaaattcttcatcagttttaaatgatttagacgcaaaattataacgataagatggaattttagtgtctccaacaatgaattgcttcagttgttcagcagcagacattgcacctaaccaacgagagcgacgaatattttctacaaagaaactaactacattggattcgctagtcgccatattatctagagttcgtttggcaaccttacccgcaattgctacatcataagcccttggatttaaatcatgtaaagctgataacaccttaacatgtttctcacgcttcgtgagagttttatctttcaacttattaaattcagcttctacaaacatctttaattcattcttattcattatcttttcctctattttggactgggctcaaagagtatctcaaaatctccctgaacccattatacaacaactattcatcaagcataataactttgcttggacgcttatagaaagcatgagttttatcatctttcgctaattcaaatgtagcagtaaactgtactttgcctctgtattcaaacggaatactttttggaagggagccgtaaaccgtagctccattctcaagcacaaccatcatcttacattgtacgccgtaatagtcttcataaacttttactgacgttactgtaccagagacggtcactcgtccttccggtgcatcccctttattcttattcagctcattgaatatattatcaaagacctcttttgaatgttcctggatagcctctaagatgctcttatgagctctaacttctgccataacaacatctgtgccatcttgcaatttccactctttatatggaatgcgtacttcaagaggataaccatactcccgaagttctttgtactcttcttgagttaagcggattttccaccaaccgtggtcaccggtatactcaggcttatccagtgaatccaattctgtaacatacggcaagtaactgcctgcgtgataagcttcaacttcacctaattcattttcccaaagataaccatcaaagggagcatgaggacgatcatctttgccccaagtaggagctaccactttatcaaagtattcacgaccgaagcgggtcttcgcccatccagcattcaactcctcggcgcgtttttcaactttcgctcggtgtgcttggcgggctacacgattttcttcaacaagtgcagagataatctcggttaaagttttcattttattctccagtttggttgacgagaccatcttatcaacagcctcgccgaaagtaaactactttgtgaaaaattttctccaaagcagaactgcgtctctacgagatacttctactgctcctagagcaactgcttgcttgcgacgaacatcacacaaatcatagtgtggaactcgcttatcctggaaccaagaacgtttcattccgatggcttctgccatagcatgcaactcatcaagattgtcgctaaacatgtggcagttctttacttgatgacctctcattttccaaccatgattcatcaagacatctacgtatactgtcatttatgattctctatgtaagtttcaatgatgaactgtgctaaacacagaagattatcttctgaaggagaatctactaaattctcaaccatttcagaaatagttccaaaagcttcttcagtattgaacatttcttgaagttcgttccaagtaggtgctttcatttcaatctcctcattagttaacggaagctatcttatcatggcttttctaagatgtaaacaacaaaagggcccgaaggcccttaaaaagatcggaaatcactgttaaaccatggcgactggtgttgtcgccgtttaagcaatttcagttggtgtttcctattgtcttctataatcatcttagaggcttttagctcttcagccaatgagacctgtttacggtccatcaagatgaggttctgggtcttctgggcaaatgtctgaatatctttaaggcattccacagattcctccattcctcgcttatacttggttcgggcagcatttaactgcccttcgtaatacgcatgtatagacactatagtattaaacatgggttaccctttagcataattgacgatttgttcacgatcagcgggccaatttaaatcagaacgtttcttgtttgaccaagcaatattttcttcagcccaatgaagtttagccgatacgctcttttgtacgtctctgatggcttcttcaagataaatgcctaaatctctcgggttagttccttgagttttaaatgcattgagcaaaatatttcttacgacttctttaaattgattttcaacttccgggtgaataaattcacgataaccgttgcacggatatccaaaagcatctaccatacgagtagtactaaattctttgttcataatccgagcgcctcgcgttcatcaggatttaatttagccaaagcggattctttaattttttccaaccgtttacgcttagcttcaggtgtttcttcctgaacactaatagcagcgcttttaggaaaagtccacgattcaccattttcatcggtgaatgtaattagttccgttggcttacgattaactgtaccatctgagccccaccaagactgccccttaactgcttcttcggcaacgcaatatgaaccataataaccaaacaactcactacgacgatcgtctggtgaaacatacgctgcataggcttcactttccgtcattacccagtttttcattttagcacctcataacgaataagttcaatacgatttttaagctcttggtatgatttacgccaaggcttataataggcatttaaatcttggtgttgtttatgcatttcgtctaaatgctttactgcatcctgcacatttgcaaggaaagtatcaaatactttattagcgtattctttcctgagctcaatgaatggaggagcacgaaatacgtttaccattacacgtaattcatgataagaagaatggacttcagctaatacatttttcttatcgccaaaattaaacttataaagtttttcacagattgcttcacaagctttctctgctttacccttaggtttacctgcaaagatgtgtcccggtggatatactttaatatcgtttaaccaacattcaatatctttaatagctgctaaactcattgtacccacgctccgttttcatcaatgtaattaatccactcgttaatagtccaggaagaggtattacctttaggagtatcaacgatatacattccgcctttaaacaaaacacgttttacatcattagaaattaaagtagccattatattttcctcagttagggaggagaaatcctcccgtttaaattatttcagcattgttacttcagcaatttcacgccagtttttacggtcagtcgcgacgaaatcaccgatataaagagcagtacggagagatacgttacgcagacgatttacgttatctttcataaattccaaaacttcaataacttcagaatttcttaacccacggttctgtaacatagaagtggtcattattacatcttgaacacgaaccataatctcttcattagtgtgaacaccaaggtcaagataaaccgaacgtgataccagagcttgaagatgcggagcaagtttagaaccacgctctaattcacggtcaatatcaacgttagtgataaagaccacagtaccttcaaactcaaactcattaggaattcctttatcttccaagaaagaagatgcagtgctccagcatactttacgtttctcccctgaatccaaagcagctttcagaaggttaagaatgtccatatcagagaatacatccacatcatcaatgagcagaactgaatttgcttcacgtgattcccaaagacggcagtataaaccaattcctgagattttaccgttcactgatttgtaatcaatagcgttagtatcatgagcatgttgtaatgctttatccaaagagtaagtcttaccgatacctgctgctccggagataatcagagaacgaatattcccatgaattaaaccgttagtcattaatcccatgacgttaaagcgtttcttgatacgctctttcatttcatcaacggattcaacaacttcaatcttagcagctactccgtcaattacgatatcatctttgaatacccaaacaccgcgctttttaccattcagttcaacaaagactttaccatcaccctgacgagagtcttcagcacttaagctatccgggaaccactcaccgagtaactcataagtacctgaaatctctttgccgaagtaaatccctttcttgatggtgatagttgacattttattctccgttactctgttttgttttgatggagctatagtatcattctacagctccaaagtaaactactttttaattatttttctaaaatttcattgatgtagtaaggacggacctttgaaccaagatagaagtcatctacaaaatcaatcaagttgtcagtttcaccacggatgatagcaagcttagagaacacttctcccaccatcattggttcaaattctacaccgtgagcttcagcagctttaaaggctttatcaatgttgtttacgacgatttctaaagttttcattttattctccattgtatctgtttgggtggtacaggtctatagtatcactagctcgcgagcttgtatactactttatgcattcttttgaaacaaaaagaggagcccgaaggctcctcagttatgcgtgcttgttgatagcgttttctgcgatacgctttggaagtttacctgcccagcggaagaacatgataatcgctccggcaataaacgcagggaaccaaaagatgagataaaaccaatactctcctgctttctcgatggttccatttttgattagatgcttacagacagaccaacccacgataaagtaaattattgcaacaacgattggcactactacgctccaaagtaaaatcatatttcagcccagtaaagtgagaaccggagctcttctccggcccatgacataaattggtggatttgttttcgagttggtcgagcagagaatttagcattttctctacgaccagtctctctgcaaactgcttccaaataccaccgtctacctttatgaggtcttccataattcaagaagaccttcattgtatcatttgtagtaagaattgtggttttcaagataaaccttctcgacgaaatcgtcccagaacttcatgtctactttcttaggcattccattcttttcggcttgatgagctagaatttctacttcatctactacagactcgagaagctcctgtacttctttgaacggtaactcacctgctttgaccatcttgaccattttagcatgggtcagagggaattgaaggtcaccagtcatatagatttcctgaagctgcagacctgcacgaagagcatgactcagtgctttccaatctacaccttcgttagcttctgccttacgagcacgttcaccatattcagcatcaagcttctcaagggagtacttcatctctttgatagtgatagtcgtctggaatttacgacccagaacgttataaaacttctgctcgcctgatttgtggtcaacgaaggtggtccattcgaggaattcaccgagaggaagtttctctgcgatatcctgtactttccaacgctcattgatacccttctgctgaggacgatcgtcatatttccattcaggaacatctctgataacatccaggactttatgcaggtcagctaaacgagaacccttaacaccatacttacctgcttgcttacggacatatccaagataagccttcatgtcagtagtataaaaacgagctcggttgtcttgaatgaatttccatacttcaggaaggtcagatgcaactaccaattccggtggagtatgcagcatatccaacgcgacagtttcaccgtcagcagcgagcttgaagaaatactttaagctgaacagctcatggtcgacgtcgtctttcgtatttttggttgcgctgttattagtattacgattagtatgattcatcgcttgacacaacagaacatcacgcggatgaggtacaaagatttctttaaaatccacatctgactcgggagttgaagtaccatacagatgtgaaccaaaataagattttacgattgttttcataagtaaatatgattccctttagcgaatttaatcaaatcatttgaagatttagcacaggcttcaacatgttctttatcagtactcttcttagaattgcgatgaacattcccgattttctgcatagtatggtagtatactacgtcatggaaatgatattcttgaccgtctggatgcggttcgcggcgggcggttttaataacatgtgtatcatacataggaactaatgcccaatcattcccggtattaatgattgctacttggatatccattttgttccatttaaaggcattaacatatccaagaacacgatgaactcggtcaaacattgcgaatttgatttcagaagagcttgccattttcatctgcttaagcaagctcatagagagtttctttttggttgttacgatttcaatttccataacccaccctcataatatatgtctaaatcaatgttatctttgccgctgtacttgccagtcaaaggaataaatttaaccgtaatcttttcgccgtcatcaaaagtaaattcagcaataggatatgtagaaattataccacgttcggttttagcacgaaagacggcccgaaggccgttcacgatataaacttgatcattcttcactagttttaccttctacataatcaatcattgggcagactttccgcttacgggcttttaaatactggacaaataccgatggttcggcttctgcaggaagacccgcttttactcgagcaagttttttggtatactgtttcttattgcgatagcgtttaaatttttctaaaccaaaaataaatccaaacgctatagctgcaaataaaagcacaaatgctgctataaccactgcgccaactggtactgctacaacatttagccaaaaggcggataaactaacacctatccaagcgagaattcctgtctctgccacaatcggccaaccgaacatccatgcaatagaaccaatgaatatagcaattgctgaagagaacagaatatgaagtactgtggtccaaaagtatccacatagagtttttggcattttccatatattgccagatttaaaccataggttcattttgaaatgccaagaatttttattgatattcattataagttatcctgtttcatagttggaatcattgcggtaagatatttgaccagttcaatagcgtcgcttttatcaatagctacacaatctccgtcacgttcaatttcgatgatagtattatgttcatacgtgtgaaataccgtaagatacaaatcaataatatgcgggctttcatcttcaattactgcatcgcctttacgggattttccgtcccatactaatttactcgccatcttttgcctctatcaagaattgaattaatgaatcaatttgtttagtgtcaagatgaattatatcattgccttgttttagcacgatacgactcaactttttagtgaaatacgaattcacaacctttacatgcacatcgctgtacggattatctaaattggtactatcaagaatactttccataattacctcaattgtgaatcttttgaaccgcggcgattataggcagaagtcattactgtatcccactttccttgacattctacacaccgttgacagcctttaaccaacagacgacgagctactgggatttcctcatcacaatcaacacaaaactcttcggattcccgctgttcttggagttgtttctgaagacgggcccattcaatcccgtctgctattgtagcttcacgagttgcaaatccgtcatctgatgggccccatccattcatttcaaactctccagaatcatttgcaccaaattatatgtaaacatcggatactggtattgtaccacaatgtagatgataagtaaaacgtttctcattcttcgccatcatcaaagtcgtagtaatcataatcacaactgtcaagataagaatccataaattcttgttgacggcggaaatcttcagaaggggtcagtctgtctgcatatgcttgatcatctggatcgctgaacttatcttcttgcaattctttaatgaactgttcagcttcttcacgtgtccaaaacccacgattaagattatgaacagaacgcttttcacctggcttgaatacacccatatcatgggcagaccgttcagttgaataactttcagtttggccagcatagttttcatattcacaaatcacttggaagaaaggagatttacgtgaatatacaccacgaagaccaagttctacatcatatgtgcctgaagcaacaatgtaacgcgttatttcgccggttttagtttctgtgcgattaacaccacacacgtgataaaagatttttcctggttgaagctcggtagttaacttaatcataatgtttttctcgtttggttgttgatatgtctatagtatcatgtaatgaagggaagtaaacaactttttgaaaagaaaatgcctcccgaaggaggcggagggtattactgcaatgataacaaatacttagtcttgtagcatagacctgtaatgtcatccagaacactttggagggcggcaggaactgacttgtagataccatcggccttagctagaatgaggtctagcatttcaatggtgtcctttggcagctctttctgcgatggtaaagccggtgtataactcttacctgagaatcctaaccactgctcaccaaaagcatctatcaaatctggaatctcgttaaagaaaacttcatacgctttatgtctggcatacgatttggtatcaaaatgcgctgaatgaaaatacgcctgagacgccataagtaaaccgatgaattcatcttgtggagtaagtttaccgtcctttacaaaatcattgaatttcattatcgagttgtatcctcatgcggttagcatattcttcacctgctgaacgtcctaaagaatcgcaatctttagaacaagactcactcttccatttactttgtataaaagaatagaactgttcagactcttgcttactaggctccttaaatttagcataaacttgtagagctccctcaacatacgagttataatccgaaatgtcgttgtgtgatgcagctgggagtgaaatcccgcagcccaacaccagggctaagcaaatgtgattaaaggccatacggcctcctattatttttgtccagtattacgtttgtgctgaagtacagccttaacttctttgaggtatttgtccagcttacgtttacgggtataatctgcttttgaactgtgctgacgaatttcttcctgaaggtgcgaaataccatgcccaatctcacgacgaagttcgtccagttgttctacagtaagattacgaagttgcttttcacttaaatgctgcatatacacctcatcagttagtaatagtatttatataagtatgtgttacttaatcccaaagccattcgcagatgccttgctcaatagttctagcacctgcttcgtcccagttatattcttcgtcatacttcaatgcgcgtttaatttcggctttatgaaatagacgtgggatcggcatagcataacgggtccaacgtaaagttttccagaatccatcgcgctttgatttagcaattaatttcttggcctctagcggtctttcccgattttcagaaatacgcagttcaacatatttctgttgggtttctttatctttctgagttttaacgtattcgttatagcttttaatataagcaaattcgttattattctgatcgttccatttggaagattttactacatgccagcctttgcggcgaattgttctagacattattacctcgttaagttaaattacctcaacgatagtaaaatcctgatttgaaaaatttaatattcatgaatagatgaccttgcatttacattttggacattcaggttctttggttttaagacgcttggtagcagtctttggagcagtgttgttaatcatatacatgaagacaacgatagcacatcacatattttttcatattaaaccaataacgaaagcaatattacgtatagtaagaatccaactacgaatcctagtactataccaccgactataacaaataagctactcatgtttaatataacacccatttgtattagcaataaagtctttaccttgagctaatactttgcattcggaatcaagacgattttgaagttcttctcgtctatcgctttgaatagatgctgctacacccatccaaatgaatagcatacttaaaactagcatcaggatagtgttatacgttcttggcttcattataaacacctaccagttcgcaccagtgtttacgacaaagagaaacgtatttgtcttcaccaccaagttctactacttcaccatcggtaatagcatttccgttttcgtcaatacgagctaccattgtagccttacgtccacagtggcaaacgcccttgagctcaacaagtttatcggctacagaaagaagagctttagaaccttcgaataactcgccgcgaaaatcagtgcgaagcccatatgccattactggaacatcatacaagtcaacgattttacatagctgaagaacatgttcagcagtcaagaattgtgcttcatctacaaatacacaatgaatatcacgttgtgtttgtgcccacttgaaaaactcaaggatatcaatagattcgtctactgtattagcttcatgacgaagaccaatacgtgatgttacctcggtggcagaatctcgagtatcaatagcaggtttaagaatgagagttcccattcctcgttctttgtagttatgcgccgcggtaagaagattagctgatttgcctgcattcatgctcgcgtagttgaaataaagctgtgccattaaagggtctccataaaatcagaaatagcattcttagaacgaatgagttcatcgtattcttcgggtagaccatttccgtaaatggcactaatagctactacttgctcggcacctgcataatcgtcaatcaactgccacagtttatttttttgctctttagtaatcatctatttacctctaacaagatggatttagcttttagcctcttcatattctaccactgtaatgtcaatatcaggggttgctaaattaataagtttctcaattagttcccaatcaccgccagcaataccagcaccaatctttggaatgtatagaggacgattataaacaatacgaccagaatttagttcatggaatgcattaaaaattgcgccgtaatcaacatttggacctggagcatactgagtatacaaattatagcaatatgcagtgccattcttgtgaatggctcgagtatgagttccaagcttggctaaattattgtcataataacggtcttcatcgatgtcaatatcgagaattggaggatatgctttagcaagctgtcctgctacaccggcacccattgtagtaaagcaattacacccatgagcgatatcgcattcatgcttcatgaataactctacaatattgcccttaatatatccagtaatcatttattcacctatggaattttataagttgcgtattcattaagattattgtatactcttaaaaatatagcattgttacaattaaggatagggtttagcactccttgttctttaggatgcattactccatcaacagaaacaccgtcactctgcattccacatccgcgagcattatattcgacgtgtggaactattacctggtcatctttatctagataattataaaatgacattagcaattttctactgctaggaacaaatgctatttcaatattgttcttgaatggaccgttgctttctattttagtcccctgtgctgcaagtatagtttcaggatagcctgggagcttttcccaggcattaactgaaaatgcgcagcataataaaatagctgcttttttcattttgatgatagtcctgacatataacgagccattaattggtcacgatacattaaacatatattttcgttaggagcattgacacacaaatctttcatgctcttagccttacgatttattagtgttgtccactgggccgggctacgtgaatcttttactccatcgctgaatgctgaatctaattcaagcgctaatatatcaacgcattcagagttcgtattgcaaaatgttttagcgatacgaagtgaatctgtcattgaattttcagcattagcagagaatgccaatactaatccaagaagcgcggcgtactttaccattattccacctttatatgtagcattttatgtttctttaagaaatgagctttctctaggacatctgacgcataagagtttcctcttttgacattccatcctgcattataactagcaagagcttttcgcatattgccgttatgtatatttaaccaatatgaaagctcaatatatgcccactccgcagaattacgtctggatttaagcatttttcttatttcagaatcactaaggtttttaccttccagtttagctctggccttaacggtgggtaagtaattttgaaaaaccccataagaatgatggcctttacctgcctttaaattggctcctgccgaagactctttccatgatatagcagccattatatatcctaagccattattatcatatcggttttgtggaggtttttcctttccggatttttgatattgttcaccaaaattatatgcgtaatgcaagttgtcaagttggacattactgaaagttggctcagacccaaaggccgttgaacacaaggccattagaccgacaagcgcttttttcatgtttacctcaattaatgtgtataacttttgtgctgattttacctttcaaacgtttatcattaacgaatgccatacgacactttatactaggtccttttcccggtcttggaatatccatagtaaaccctagccacagatttccatccgtaatttctaaccgcatgggtttatactcgatattttcatcaatgtcttttgggtcaattggaagccaaggcattgctaaaaattcattaatttctttaaggtgattaggaattttggaaagaacagagaatacatactcttcatcaatttcacgttggatagcacggtccaacaaatgatcagagtacttagtgaagaaaggctctttaccctcggctttcgcccgggcacgaacagataaattcaaagagcgaaatgcttcctcaaacttacgacgcagtttagttctgcgaatgaatacttctgggttagttgacatagttcattctcctttgtttatagggccatagtatcatggcccgcaaggaaagtaaactactttttaatatttttcttctggttgaaacactgaacgacacgcccacattgaggcttccttcaggtgctgaatagcattgcgaatttgagtaatacgctcatgtgctaaatcaaattctttgtcgctcattgtgctaacatctaaattcatgtatttttcaacatgctcttcttctaatgctttaaaaattaatccaagacgaatttccgcgtctttgatagcatttactttaccaatcttttcatcggtatgtggcttatatcctttgatatcttcaattgccattatagtgcctctgtgaaagtacgagcgataacgtcgcgctgctgttccggagtcagggagttgaagcgtaccgcatagccggaaacacgaatggtcagctgcggatatttttccggatgctcaaccgcgtccagcagagtttcacgacgcagcacgttcacgttcaggtgctgaccgccttcaatttttaccgctggctggtattcaatttctacttcacgtgccttgtagccataaaaagtttcagcatccgtaatagtatcttctttaagaacttttgaaacgattactcgtgcgtcatcaccatcttcgatgtaaatggtgcctttaagttcaccttcaagaatttgatatgctttcatatttcctcttaattagattctttattccaaccacgcatgtatgcggtaattacactcattttattccattcgtctgaatgaaactttgcagctgcttctagataagttattttatcttcatgataagtaacttcttcatcagtttctttatcgtattccacaatttcaataggctcgttaactccatatccgcgagtgcctatatacgttgtagcttcttcccactgtttggttgtttcattccaagttccattctgatgggcttcatagaaatgctgctcgccagaattactgaaccaagcacagaagctttcaactaaatgtggaggacaccttataacaatttcagccattgcattgttttctcttgaatgcgttggtcatatgtgattaaacttgaactaatcacgcctttgagcttaccggatataaactcaattctaaaattaggatagcgattcatccacttcgtgttgggagcattagaaatgaattctgcgcctttgaatgggccagacagaaacttgtagcgcttgtactcaagcaggttgccagccgtaaccattgttattaattgcttcatatcggcaaatcctgtattttccatcactgtaatcatatcaacaatttctgtctgtgtcatcattgcattcctatcacgaaaaataaaggtaaggtatcattaggcatagaccatctgatagcttcctggtacatatcatagaacttcatcatatcgggaactttcattggttcttcaatgataattaatgctcttccaaactttcttcctctgaacttataagaggaatcattggatagaaattccctgattgtcatcggaacaattgatttagctatctcgttagccggtaatttattaattaaatgcgatgaattatattctcgtagaataccttccatcagttcagatgattgtgtgtatcgagtagataagattataaccgaaccatcttcaagcaaccaatcggtagcgaattggcataaggctgcggtctttccggtttgtcttccaccatctagacgaagggtaccgtactctcgcataaggcaagacggttcataaaaactgtagttgggattatttaatcgtctgtctgcagcgtctttgaaagcatgcatcagggtcaaataaattggtgttaagtatttcataagctctcttttaatggggccattccttggcgcatggagtgagtccattccgataccttatgtaactggcattgccacacttgggctcgaccttattacaggtaggcgggaatccctcatagaatcatgaggtccaggttattccaatgttgtttaaatgtaaatatgaatatactatcacaattctaggagaaagtaaactgttatttacctttaattactttagctgcttcgatagccgcttgctgaaggtcatccatagacataccgaatttagaagcaaagttatcaattttcttttcgacagcattcaaaggcttggcctgtttaccttcattagcgccaggaagagcgagaatacgctctttgtcaatataaaggcttacaagtttcttacggtctttatctgacaaatcatgaaatgaatgggcctttttatttatagcggcttctaatttacctgcactcactcgcgcttcagtgataaattctttataagttttcatttttaaatccagaaaggtaaaagttttaaattaaatggggccattccttggcacatgtttaatccatcgacacactatgtaaaccccttaccgcacttgcgctcgaccttattacaggtaggaaaagctacttcactcagaggactcgacgttcatgaggagaggtcgtgttcggctttattaggaaattgcttacttaattgatttagcgtaacgaatagcgccgcgatcgtttacgaatgcaattttaccattacgcatgtacatggtaaccgtacgctggtaaccgttagaagttttaccagactgataacctactaatgcaaagttatcttcaccaggtttgttctgcttagacttaatacgcatatgtccatgggccattaaagagcgtgcatcgccagatgctactgctttgcgagaagattcatcttcaaccgaagagacaaaatcatcgaatgaatcaaacttagcatggctcttattatataacttgccgtctactacgtagttatatccaacaacgtccatttcaatttctgtgccatcttctagtgtggcggtcatcttctggccttttttaaatttcagaagattacttccaacagattcagtcattacgccaactgttgctaaacgggattcatttaaaaattcttgataggttttcatttattttccttgataagcagaccaagttccggtccgcattgtttcaattacacgacgagcacgattaggtgtctgacgataccaacgtgaatttgcaagttccttggcagcagcatcccattttttagtgagtaataacttcattgaagctgggaacccggctacaccagacacacccatttggaataccatgttaatcagagcagctctacgaacatcatctaatacattatataccgggtttaatgtagcattagcaacaatacctttaattgccttctcaacatctttggcaaaaattacttctgcctcagcctgagtaatttgaccaccagtagaacgacctaccagtttgtccagattagaaatagccaaagattttgacgggtctttagtcagtaagtgaccaataccgatagtccaatacccttcgctatctttataaattttgctgtcgtatccttcatcaatacgcagcatgccaaaaatatccataaggacctcctattaattataggagtatttatttggccctgcacttggctatgaataactcaaggctgcacttctcgtatggtgtccatttatctttccaccacacataatctcttctatcgtcctctggaatttcattaaatccgggatacagcttttctgctatgtaatatgttgattttgtatactcgccgtcaccgaagacgtatcgtgatttcaatagtatacgcgacattttatctctaggatgaaatatgctaacccattttccatcgtgaataaatcgtagctcatgcttataaatgtgtggaatgcctaattcaacggcttcttccataataacctcactgagctgtgctatacatttgtgtcatgattttatacaaacttggtcccatcacatatttccactggcttggtttaattaaagcaaatgcatcgatttcaggaaaattaattccattttcatctttatggtaagctgtacaacggcaatttctgaacatttctgggctcacagggagcatatatccaaacagatggatatccttgttgcttgcataatcatgtcgtccaaggtcatataagaggtcttggtcaaactcggtaaatccagtctcttccttgcattcgcgaatagcagcctcttttggtgtttcaccaggctcaacatgtccttttggaatatcccatctagagcctctgccctggatatatgtatttgtcatacgacccatgaaaagccgtttgtcatcggtaaagaataaaattcctgcactgagctctttcattggcattcgttccagctttcttcaagaatatcttccatggcagtatagaccatagactctaatacaccatcacagttatatgaaccctctaccgagaaatcacagataggtccattaataccaagcagttcttctttaagtgaaatctcgataccgctcagtgattcattatcgctgtaacacagaaggcgagtatcaccattttcaaattttacatgcactgcaacagccattatttcatctccttaatccaggataaagtttcattgcgagagtcatctttagatttttctttctttactttgggcttatcaaatacaccccgctgtcgttgggaaacgaattgcaaccaacgagcaagcattgcaaaccaagttccaacacctgacatccaacctagatagtacaatgtatcaccaaatactggtgaaaagaagtagaatccccagaatatcccaacaccaacaaatgttgagaaggaaaacaggataagcagaaataggaagaaatacaagaaatcatcgtctttaatcattccacgataacaagttttaatcattttctgcagctcctaatccaggtgttgaaatcttctttttctttccacttcttgtatttcatacggtaagctaaaaatgtgcagcaattaatcaacgcgataattagcatccacatgaggctgaatacgaaaacacctaaaaataaaagcataatcataaactctgagacgttcaatccaaagaatgtccctccaacaattacaaaagcacaatataaaatccatgtcacgattccaaaagctggcgccagcccatcttggttccaaaacccgtcaggtttacattcattcattttcttctcacctctttaataaactcaaacgactttttgcggttccattcaagagttaaattcttgcactgttctttccattcagcctttcgttcacagttatgcttaacatactttacccaacgaaatagctcaattaatcctagaccaagtaaacctattaatccccatgtaagtaatagtacattcactaatgatgtactgctaatttcagccaaattcattacgtcgattatgataagcgttatcatagttccagcagcacagaccatccccggaattagaacataatcagtttggtcaaatttatagacataattataaacgggaggttcacttggcagatataaattactcatttctgcaccctctcgcggcagtatttgataaattcatcaatgattaattgtttgcctaccatgttgttagagtcaaacatacccatgacttttggtggtaattcattaacgcagtaatttaaataattgctataatcatcctgagatgtcacgtatttaaccagattaataccgagacgataactagttttattatagataatctcgataactactgtatatgttgtggagctagaagtaaaatattcatcggcattagtacgggctgattttaaatttgatggagaatcgttgaaagaataaattccgtaccgaagtgcaaaaatatccacaagcttaactccgtcggaaatagacgaaatactggaaattaagtttttcagcttgtagtagtctttaagaacgatagcccgcggcaaaactgtggtgttatacccgttatagcgagttttccaattttcaggccgagtatcaggatgagcaaatttttcgagaacatcagtgatttctgttgggaatcctgctgcaattaattctttaatttgaggtgttgccattggaatatctccagcgcattcatataacattttattatccaagttaggggcccgaaggccccggtaaaattacttcagactttccagatattcctggacatcagcagtggtggtttcaataccaggctgagtaccgctgaaggtttcaactttcatcatgatgtcttgtacatctactttagcgagttccgcgatttcaatcacgtcatcagcagaggtaatacccagagcagaagcattacgggtctcacggatgtattcgagtttcactgccaaatcaagacgctggtcatcaagcttaactacagtttcttcaatttgggcccgcatttctttatattcggcagctttatcacgtaaagccttagcagtacgacgatacagaagacccagtttagcatgggtttctacattcataccttctgccatcaagcgacgaatttcacgctctttggaagcacctgcctggtctttttcgtcagcaagtttcagcagacgcttttcttcatttaccgatttaacatgcgtggtacgcagtttagtgatttcatcaataatacgatttgctgcagtggtgtactggtcttcaacagaagtgttctgtgcaacaaaggtaccgaatttagaacggatgaattcaacaagttttttcagaatagacattttatttcctttcaatagttatggtggttttattcgtacggattaatccaatcataaacatatggtttaatgattagaccctgttcatttttgctgcgctcgaatatctcgatataatcagtaacgtatgattctaatccgagaataagtacagactctttgccttcttctactgttgctttaattaaacgctcgatggctattttagcttcaagacgaatatcagcaagagtttttggaacttcatttgtatgcattaatgagttcctccattttgtccaaaactgcgatatcaacaagacgattaacctccgggtcatcggcaaattcattgtaagttgaaatcaccaggttctcgatagttttcagtgcagccattcgttcttcaccggatggaaaatttggagtttcaccaaacagcctagcaaaagatttaaaataagtttgcgctactaatttcaacttatcttgatacataccaatttcctcagtaggtggggagttcattataactccccaaaattattagcagttaattaccgcttcaattcgtttaaccaaagcaggaacagttttagcaaacttgatagccatttgaaccgtagcagcttcttcatggtaaactcgaacatagtactcttcaacagcaggccaatctttgcgaacgtgtttaatcaaatctttcagttcacgggtttctgctacgctgaacactgcattctcatgttcgcctttaatccaaaccgcgcgataacgatcaggagtaccgtattgattataaccacgttcaatttggataaagttgaatttagacattttattctccgttactctgttttgttttgatggagctatagtaaccgagttaactggcgttgtaaacaactttgtgcacaaattttcaaataattttagggaatctggaaggactttctggagagtagaatggatttatacagcttgggatatagaaatgccctagatgatttctagggcaataggatttcattatacggtataggataacccagtttggcgacttagttcaacaagatgatgacgcagctgagacagcagaacttttacttcgccaatgtgttgtgtctcatgggcagatggcttagatccttgtgacgcgcgatatttgtatagattatcgagataaacctcaattgatttgtagagggctccattgtcacgtactagcggaatcatctggtcgattgcgctgaacagttcgccagaaccaataatgctaccatattttccacgaacttttagacctggaacatctttcggagcttctttaacaactggcttaacaggttctgctttaggtgcttgtggcgcaggagttgcttttgtggttggcgcagatttttgcccagtcagagatttgaatgcattctgtactttatagtagtcaccaggattgttagtgctgatgccataaagcttttctacggacgcagcaaatttcataaaatctccacgctcaccttttggtaccatgtccatagctgactgccatttaccctttgtcatccgtacggatgcttcgtttaaaaattctttaaaattcattataaattcctaagtattagtgttgatttactatatactatttatactaaaaagccccgtccgaagacagggctctgagaatcgacagcatcacctactggcagatgacctgcgaaattcatttctttggactcggaggcatcagtctcatccaaagaagtatagcgtcaggaggttatgcttgcgacagggaacaaccggctagcggtaatggacgaaccattctcttctatctgacgactcaacgagggcatacgcaagtttcccttcgaattacattacatcgtattcttcaactagatactgataataggaatcgtttgcttcaagttcttccgcatatgatgttgcttcggatttagtgtgaaaaatcttaagaggcaaagaatattcttcatagccatattcacagttccagttattttttactacagcatatactttcatattttcctcattaatttttggtatgggtaggaatcgaacctacaagccattcagcaccagggcctcacgctctacctatttgagctatcacataccagaatttggtgccgattgcaggagtcgaacccgcggcatcttcattacaagtgaagcgctctaccaactgagctaaatcggcgtggtatccccacctggactcgaaccagggactagggtttagaagacccttgttatatcctcttaactatagggacatttggtgcgtcgaacgagactcgaactcgtacgggtttaatcccgggagattttaagtctcctttgtctaccaattccaacatcgacgcaaatatttgttcaggcaggactcgaacctgcacgactgattccgtcggcgatttaccaccatcgccagcatatgatgcaatatgcgagctcaaaaggtgtccgtcaccatgtctaccgatttcaacactgaacaagataattatattactgattatttatagcatttctcaaacgataaagttgattacagaattcgcgttcagtcaaaatcgtttcagaaattttatttttacccatactgtgagtgagcgtagcattccgggtagcagccaaagcttttctgaatccttcatttttactaagtgcatcatatgctcctgttagtaaattctgatatgcttctgaagctcgatgaataggaacacctttccaataaagcgtttgtgttggccaccaacgtttcttcttacctttaaacttagcggactttccgactagtgtacatacatgtgcttgcatttcaggcgaagaaaatttgagggactgcaagaatccctccattgatgcgcattctacgccatcatagataaatttatgaggagcgaaattactcaaagcacatgatggatatgaactacctgaaccgatatccattacttttccttcacgtatttcaaccaatcaacttttaatgggctttctttctgcttatacgtaattccaacatggaatgcaatcggtgcgtcaggaatacgaatttcttcttcaatgttgaagatttctactttctcaaatactcgcatgaaatcatagtcatattcaattggattacccagccaagcctgaatagcatacataacttcatttgagcaagaataatggttatctaaataagcatcaaactcttcatctgtgcaatcatatgcaggaacatcaacaccaaagaatttcttggaaaattcaggagttacatacttctgttcagtatgaagcttttcaagaattgcttcatggttgtaatcattatttccaaggcattcaccacgccgaccattagaagagaaccattcaagaacatgaattacttgattaatctcttccttttctaagccataaaccatttgggtagaataccggtcagcatcattttcccaagtggtaattgccattgctaagcctttaggaataacttgtccaaatttaatatgcatttcaatttccttagttgataatttggtgaccctggcaaagactcgaacatgcaaccaatcccttatgaggggaacgctctaccaattgagctacagggcctttatagaaatcttatgacttttataaaagccctccgaagagggcgccttgtcgggcttatccacctgctaggcagaattactcacacataaaatcagctacttcccagaagtcatttttaactgctactttaaccaccggataaatttcagatgttttaatagaaacaattacatcacctgcgacagtttctaccagaccaacgattttctcgctgcgagcaacaaatttactcaccggatgaaatttaccggtagcagcgaacatagcttcttggtcaacaatcagtgcgatacgtttcattctttttccttgtttgttttgatgtagtaataataacaggttattcttgtagcattaaatctcgaaaatcgttccgttttcccacattgttgtgaacataggagaaaccttaacgaatgatttgcttcgcattgcaacgtagtcgttatctactttagccaatcctgaagcaatatcagtaatgcggccacacttcatagaaccgcgaccacctttattgtatgtgcgttctccgtagaaaacgatatcaccaacttgtacttctcggcctttagaatctttcatcatattttgcctgctgaattcgtttaaaatcgttaacaagttcttttgggtccaacgcattgttaaatggaagaacttgacgtagtttacttactttacaaccagagtgataagcaataacctcttgaatatcacgctcactgaagtattcatatttaatcagtgaatcatatcggcatttaatccatacccacatacctttgcgttcatcaaatgcatatgcaaagtcagcgttaatcattaaatcccgtttagcaaaagatgaaagccctaatgctaaattaaccggtccatccaaagacagcttcaccgtaatagcatttactttatttgcaacaccaataaaaatattcattctatttccttcgcttgttttggccttcttgtcgtgcacgagaacgtcctgctttatgcagtgattcgtaatatgctcggcgtctatcaatgttttctgtacgatatgctttcccgaaatgggatgttttgaagccgtaatatttcataatataattctcaatggcaagtgattggacggtatgcccggcctcgaaccgagtcacatggactttgcagaatccgtgtgtttaatatatcacccatactcgatagcatatctgaacgagactgcaatcccgctactcagcttacaccatcttgtattgtgtcataccgataatttggtctccatagaatgactcgaacattcgacctctccatcccaaatggagcgctctaccagactgagctatacggagtaattttgatttaaaattcttcttgcttgagtgtgacttacaccaatatgtttagcatatttagataattcgcctcgtttagaaaaatcatataatttagaaatttccattctgtaagctctttcatctgtactaactctagctaagtttaattcggatatctttttcttgaattcagccgaatggtgttttcctgcaaatccgcttggcttaccagccatattatctttccatgtaggtaaatccaaggatttcactgattttgaaatctttttcttatgctcatctgataaaggtttattagcacaagattttccaacttttgacatattagttcttcgttgttcggacaagatttcattattacatatgtggtcccatccgccttcaccaccaagctttaagttatatgtatcaggccttttaataaattcttcatttactaggtgtctttccgcatcatacatatctttagcattatcaaaagtttcgagaatttctttttcaaaattttctttgccgtactttttaatagcacgctttaaattcttaccagaacccatgtatccatcttccaacttagaagtagaatgaactccaatataaaacttttgatttattttatttgtaattttataaagatagtaatgcatatcagttcctattaaaagaaccgagcgtctctcgacgagtcacaatttggagcatccaaagggaatcgaacccttatcaagtgagtggaagtcacctataatagccgttatacgatggatgcaaatttggcaggccctgaaggaatcgaaccctcatcactgggtttggagcccagcataatagccgttatactaagaacctgttatttggtgggagtaactggactcgaaccagtcaccgctcgattatcggtcgagagctctaccaaatgagctatactcccatggaaagctaatcatctaattgttgatgtaccactgctatgggcagcgtttaactttcataaatttggcggagagtaaaggagttgaaccctcaccgtttccgatggcccggatttcaagtccggtttgctaccactagcgctactctccaatatttggtgaaggaagtgccatatagacacaattcgcttagcgacaacccagcatgactgtgggtcgtgtatttttccaccattccttcattgttggggtgaccggcggaatttgaatccgcgactacgagaatcacaatctcgagttctaccaactgaactacggccacatcaatattcactccatccatcatgaggacttcatacgaaattaagagaagaatgatcagttcaacccctgtagacgcgttgaatgaatattaatttggctggactatctggattcgaaccagagataccggagtcaaaggccggtgacttaaccgcttgtctatagtccaattatttggaggcggaggcaggactcgaacctgcgcgtgtcgggatatgagcccaacattctaccaactgaagttactccgcatttatccgggttcttgaagtactaacaagtagcttgatgtagaacacgctaaagatataatcttacgaatatagagcttattccgtgggaacaaacagcttcgtcctcggcattatctcacaggactcaaactcatcttcaagaactgccacgttcttatttggcggacctaacggaattcgaatccgtgactctcgcgtgacaggcgagtattttaaccgctgaaactataggtccataattcgctttcagagatactctggcacgatgccgaagcaaaggggaacaggactctcatcaccttggtaccagatgaatcttgtttagcactctgttctaagatgtatccctgaaagcgaactttcaacgccgtaagaaattataacatgaacaagcattaagcaggatgaaatcatactccttaatacaaacgccatgccagggatttctgtgccgacgattttatcagaacgtcttctgacttcttcatttggcgggccgtgcaggtatcgaacctgcctagtcatttctgacacggattaacagtccgtcgcttaccctctcagccaacgacccgaatttggtgggacaccgaagactcgaacttcggacacccggattaaaagtccggtgctctaaccaactgagctagtatccctaaatttggtggggagtaatggagtcgaaccactcgagccttttgagcaacagatttacagtctgtcccgctacccctacggtctaactccccaatgggtaattttatttatactgctctaaaattaatcagagcagttgatagattaataataacaaagaaaacctaaagcatattacacaatcggtgagctctttgatttaaccaggaatacccgatgtggtgaatccatatgagagagcaatacccggtgctcaggaattggacttgtatggaaaggaaccacacgataacctttaggagtaaatcctagcaaaataccaacgcttgctgcagaaagtgacccaccacagtagtatgataccaaatcaccaggctggatttcattgtcaagagaatcggttttgacatgcttaggcgtaactaaatcactaggaattggaacgccttgtgcatcatagtattcatgggcaagaagcttataattctcttgatagaaagtattaaacgcagctctgatattcatcacaatttcctcacaattaatctttgtatgcttcagttgaacctttagcaacggtctcaaatcgggaattcagtatctcaaaatagtcttgatacgttccctggagggcttcatagcattcttctaccgtagaatagacacctctgatttggtcagagccaggagcaggataataattagaccaagttaaaagtgcatacattacttacgtttccagctataatgagccaaaataagaagcactgcaatagcaagtagtgatgaatgcagtgctgccagtagtgcacctagtcctacgcccaaagtaacataatcatacttagttacttcttcacggtgtaaatcatagtttttgatgaaccactgcttaatctttttcatgtgctattttatccattatgaaagaaatgatacccattagaaatgcaacacttaacactgatactgtttcaggaagagacataaaggctgcaccgataatgccaaaacctaacgctcccatgcagatagttgatgcaacatttctaattaattcacaacgtttcattttattctcctcaagttgatagggttatagtatcactactacaacccgttgtaaacaactttattcagcgccagcggcttttaaaagctttttaagattagcagaacctcgggcagaaaaagttaccttaccatctttttcaccgatgctgccggtcaatttagaaagtttatcgctaggaacttttttaaaatcggctaatgtcccgtcaacggtttttgtaacaatcggcagttcatcatcctgtcttttagcttctgtaataaattcttggtacgttttcatgttgcttccgtttggttagtttgttttgatggagctatagtatcaccactaggaccggttgtaaacaactttgtgaaataaattcctatttcaaatcttctgaccagtccagttttagtggctcttggtactctctatcaagcactacaggtacttgaacttcaccctcgaagtgagctggacctacattgtagctgagagtaatgtgcggtgagtaatctgggaaatcatgagttgctcccaaagctcttgcatattggtgacggaattttaagtattctgaatctagcttaagaactagcgtacgtccgtcttgtgtgtcccatacttcaagtttacctgatgtagcaacttcaaaacttcctgaagcacaaacgtatggaacatgaactcttgaatagcatatcgtcgtatgaattttatgacgaggaactggattagggaccttcaactcacgctgaaggtcctcaatagcatcaagagttttctcagagaatttagcagctacatatagaccagtgctaaaatcactgaagttcattaggcatcagcttcttcagtggtttcttctgcgaactgtgcttcgatttttgcaacgaggtcatcaagtttaacctgaccgtcttcgctgatttcaacgccggatacagcaatcagcttctgcagtacttcttcatactgtgcacgcagagcagaaaggccttggatagtttcagacaggtcaaatacacgaactttcagagtatcgacttgggcttgcagttgttcagtagtcatttttgaattcctaatatagtgttgatttttgaataaagttcttctagagaaccgtcgttagttattacgatatcgccttcgcgaatcggaagtccacgctctgtgacgtgagtatcttttttagaaccttcttgctcaggacgaactacatgaataactgtagcacccatcgccctggctacatcaagttcatggtcttggcgggtatctgggacaatgaaataatcataatcaccaaaagtatcagccataaccaaagtgaatcgttttacccaatacatgcgatcgagcttatcacagacaatgtcagtcccaagggtctgcatgagacgacgaattgaccatggctcaacaggtttatttattacaactttacggatgacttccatcgtatcaccgtcaagtattttacgtttgttatcataaaccacaccaggtaaaggcaaatcatgatgaacatattcaatcgcgttcgccatgatacgaatcacgtctttagtagacagatttaaatcttgttcacgatcgtaatcaataccttcaatcatcgaccgagtaatgcgaggaaactgacgtgatgtatcgcgataccactcagtaagcattgcatcagccaacgcatctttaattggacctgctaactgatgctttgttgcgttatagttatccataatgtagtcagcagttgtatctttgccactacgttttttaccaatcaaaaataaaagcttcaaattattacctcatagaaggatgcattcccataactttctgttgatactgggattcgcgagtatcattgacagaaggtctaccagtaattattataccatctttttcaacttcgatgtatttgtactgcaaagttgctacacataccattgctgggtcggattcttcggttaaagaatactcaatttcagataaatcactcacccaacctccgatgtagcggacagttaatactatatcatgtttatcgttatcaagaacatgcattaaaactgcgccaggaaatccttcaccgccgttattccatccagacttgtctcggtcaatgtagttttgacagcttaacatccatttgtacatttgtacccatgaatcaagattttcatctactaaaaatctaacaggaacagcgtcaaactcaaaagtagacccaggcaatttagcacgatgcatgccttgaggcgagcctacagtatcagtagcaggaatatgaattccaggaactacagctgtttgaagattagctttaaacgcttgggtgaggcccccatcagggacctctaatataaagttagttgtgttagtttgattaaacagtccagtagacattatgatttccatacagaagtagcagagtagcgtttgcctttcgacatgaactgctgcagtggtaacatgactacattcgcccaatcagccggttttatctcaattaaagcaccctttatattaccaggaatatatgctttaatcattttgtcagcgccagcaaatcctttaacttggctccagtttatctttaatctggtcttattagatatcactggcgtattagcatactgtttaagaagttcttctaaaaactgctgacgagcctttggcggaatgtagtgaaggtttaacccatacatcaatgtggttgtaccttgctttccaagaccaagataaactatcaaaggaaatttatcccagaatggaagagtgtctttgtgcttagcgtcatacatgtaagcatatagctttccaggttgaggcttggttacagaatgaccacgtatatttttctttatagtttctgcaaaccatttagcagatttattgtttactgctgcgccttcattacgaattttatctttgatagagcttcgaaatgaatttaccatcacaagagcacgctcctgtttggtcattttgttagcaggttttttctcaatttctgctactttaattgccgttttaattcttgatgcatgacgagccattgctttactgaacgtagcaggatttattcctttgctttcagcgaatgatttagacgtcatgccttttttacgagcagcagagtattcaactcctaatgctacccattgattttcactacgggatttagctttaggcgattctgcagcttcagtgataaattcaaatatagccatcagcctttccatcctaattttttaagtgaatcttcggtaattaacctaaattctatacccattttactggcagtagcttgagctgctttccacttatcaacgtttacagaccatgtgtaaatttcatcaatgtaccgtttcttcgctgatgtcgtcaactttgtgggtttgaccggaggtctagtttctttcttcggcttaacttcaaaaaagaactgttgaccattagaaaacttagcccagaaatccatgaaataacggcgtttctttccatcagcattgctgaagtatggaattaccacgcattctgagttccaactaactacatctgggtggttatctaaccaccgcatcatgaaattgctcccaagtagatcggtatgtgatcttacgagggtcccccttatatttgcttaagttttttggtaaaaattttccgctatacgccattaggcttctccttacatttgtcaaagtgccaacacttcattccacgaggttttcctgatttgccacagtgaggacatgttactacaggttgagattctgaaacagccctaagctttgctcgagtttcttccgatctcttctttccggtgttagctaaatttaatttattttggtgctctttagttctatttttagctgcagtagacatgttttgtttcattgtatcgctttttgaaacacctgtcatagaaatactgcgcttttcatttgattctaatgtctgagactttccagtaagagctgcagacagtttagctgaccattcctttgacctttgacttcgcttctttcctgttaatatcacagaattagcaatagaaactcttttgcgaatccattcatatgatttgttatttcttcctgctaatttagaagacatgatatgaactgcgtatgataacttgtgattatctggataaatcttagctaaaagctgatgcgcaacataatgttcagctgcagtcaaatctacgaggttatcttcatcatcagtaccacccatacatcttggtacaatatgatgtcgttctttatatccttccaagctgcgagatttgcctctctcaataagctgatcataaattttacgataattcatattattctcctcagtagttgatagggtaataataccataaaccactcgtcatgtatactacaactttataaatactgttattaatatttataagaggataaactatgctcttctcattttttagtccgatagattattctgcaaagaccgtaaaaggtgctaaggcaaaagctatcccaaccgctgacatatttcgtaattatcgcaaatattttgacactgtggcagaaaactatcttttacaaacatattacataagtggagctcctagaccagaagaattagcatatattctttatggaaatagtcagctgtactggattcttttaatgtgtaataatgtatatgacccgtttagagattggattaaaacccaggatgcatgctatcaatttgcacaacaaaaatatgcagatgtaggtggagaccaaatactctatcacgtggatgcaaacggcaatcgttattataacctcgagcaatatcctgaaaattcaggcatttggtatgataaaggggactttaatcaccagtaccctcaatatactggggctttagctggtgttgacatttatgaagactctattatagaaaatgaaaaactgcgccaaataaacattatcaatcctagtgatattgaggcatttctttctgatattatacgagaaatggaaaaagcacctgacagcgaatacgaatcaggccggtacaaatcccagactacaatcggagaagttttatgattgaaatgaatgattcattaaaatggtttaccggtgttgttgaagacagacaagacccgttgaaacaaggaagagtgcgagtacgtgtttatgggcttcatccatttgaaaaggtgcaaggagctataaccggtcttcctaccgaagaccttccttggatgtcagtgattcagcctactaactcagctggaatttccggagttggctcgtctataactggaatggtggaaggaacatcggtatttggcttatggcttgatgaattcaaaacagcaggattagtaataggaacatattctgcgcacagaaaaactaagccaaactacacggaaggtttttctgaccccacaggtcaatatcctagacaggttgggtcagataccaacccactagttcaaggcgatgaaactgggtatagtgctataccaaacatcatccaagatagaaacttggatattggcattaatcctgacgatgctgacctaagcgatattcctgaagacccaaatcctgcaattacaataacagatatgcttaatagggatgaaggtcttagattgaaagtctattgggatacagaaggatatcctactgtaggtattggacaccttatcatggcacaaaaagtacgtgatatgtctgtcattaataaaactttatctaatcaggttggtcgtactgttacaggaaatcccggtatcattacaatggacgaagcagttgcactatttaagaaagatcgtgataaaatgctttctgatattaaaacgaattcacgggtaggacctgtatatgctaaagtcaacaaatcaaggcaaatggctttagaaaatatgagttttcaaatgggcgtaggtggattagcaaaatttggtaaaatgcttgatgccatgctcattggtgattggaaaaccgcttatacagaagcaagaaactctgtttggtttaatcagacaaaaggtcgtgcttctcgtgtttccatgattattctaacgggtaatatggaatcatatggagttcctgctccaaagccagaaggaaaaaacctgtctgcggcttatgtagaaccgaagtctggtggtaatcctgaagacccatggaccccagaggattcaagaattctttttaaagagcccgaatcttcatataatggtcaatatccatatgtacatacgatggaaacagaatcaggccatatccaagaatttgatgatacgcctggctatgaacgctatcgtattgttcatccaaccggttcatatgaagaggttgctcctgatggacgtcgtaccagaaaaactgtagccgatttatatgacatgactcagggcgatggaaatattttaatctctggggataagaaggttaacgttggagggaacgagacctattataacatgtataatcgtcgacagcaaattgatggcgataacacgctttatgtacgtggaaatgaaactaaaacgattgaaggtgatggtactatttttgtcaagggtaacattaagatagtcgttgaaggaaatgctgatatccaagtcaatggtgatgccactactaaagtagatggcaaccacgacgtgaccgtcggtggtaatttaacttggcaggtagcaggtactgtgaattggaatgttggtggggcttggactgaaacaatggcttctatgagctcaatcgcccaaggccaatacactgttgatggttcacgaattgatgtaggttaatcatggctgatatacttcctattaataccacgttacgcgaagtaatagaaggtgaatacgttgagcagtactttactgctcaattatctaccaacgaaacattaaaatcaataaatattatcgactatcaaccagtatctgatatctctgtgtctgaaacctattataaaggtaattataactcagtttttacttttggaaacgatgtgcttaaataccgtgaaggtgatgagctaaagtccgcttcagcgtgggaggatttacctaatcccaaaactgctgatttgtatctatggaaagcccccagaacactagagaagacatttacctatacagttgagataatatatacagtgacagaagaatcgtctggaggttcatccggaggttctagcgctccaatcataacagaacataaaaagcaaaagatttactctcaaaccgttaaaggcaactggagtagatggggcgaccaacttcgtgcttacgtatatgcggggaattaaatggctggtctttcatatgataaatgcataactgccgggcatagtgcgtatcctccgacagaagtaaatgctacacaaagtaaagtattcactggtggaatagcggtattagttgatggcgactcaattaccccacacaccaagacggttgaccctcatgatacgcatggaggagttgttcaacctcgcacatccaaggtatttgtaacaggcaaaaaagctgttcaaatggccgatccaatttcttgtggcgacactgtcgcgcaatcaagctcaaaggtattcatacactaatggctattaaagaacctttaaattatcagttaacgcgtactgcaaacgctatcccagacgcatttactggagcaacattcgatgaaattaaaaatcagcttattaactggcttagcggtcaaaaagagtttcaggactttgattttgctggttcgcgtttaaacgtgctattagacttattagcatataacacgctttacatacagcaatttagtaatactgctttatacgaaagctttatcggaacagctaacttgagaagttccgttgttcaagcagctcagcaaaacgggtatttgccaagttccaaatcagcggctactgcgtctattatgcttgaggtaactcatccaaatccagagccagcaataaaaatacctcgtggaaccaagtttttagcatatgcacgagattcatcagtagacccatacaactttgttgttactgaaaatgttattgcgctaagagatacttcagcaccagaaggggttaatagatatcttcctattgtcaatttggcgcagggacgtattattcgtactcagttgtcatatgacccgaagaaacctattgttattcgcgatcagtcaattgaccgcaagcaggttaagctgtgggtggatggcgctgaatggactaactggacagaccggtcaatggttcatgcttcgtctatttcaacgatttattatatgcgtgaaactgtcgatggaaataccgaattcttctttggtgaaggcgtggcagaagcctctgtagcaggaggagttcttgaaagtaatttcattggtggattaaaacctactaagggtgcgcaagtcgttattgaatatattcgtactgatggtgaagctgcgaatggtgcgactgatttcagctatgctgataccctgcaatatatcgtagtaaacaaaatcattgaaaactggtcagattctcctgattatgttggtgctgatggtggtggggaacctgaagacatcgagcgtattcgtgagctcgcccagattaagcgcgaatctcaaatgcgttgcgtgtctaaaactgactatgaatcattcgttagttcacgctttggttctatcgtacaagcagtgcaatgctttactgatcaggacaaacccggatatgcatttatcgcaattaaaccaaaatctgggttgcagttaactgcggttcaacgagaagacattcaggattatctaaaacctttctgtcttgctccgattactccttcggtaatgagtccagactacttgttcatccgtcacaatattaaagcttcttatgcattgaataagttgcaagaatcagagcagtggttacagtcaaaaattatagactcgattaatagatattatgttgatgaagttgaaatgttcaacaaaaatttcagtaaatctaagttgttgacttacattgatgacactgaccactcaatcatcggttcttctgtggatattcagatggttcgtgaaattgtcaactatttcactcttcctagcgcaggtattaaatactataatactattactccgcggacgttacgttctggtgatttggtctttactgttaccccaactgctgaaccgtattcagttaatatcgttggaactgacccagataaaaatggcaaaggaaatatggttattggaccatttaaaccaggtgacattaaagagaatactcatatccagccatatactgaaaacgattttgatagaactaccgtcggcgaaagaactcgttggtacaaaatcggtgaagtagattattatggtgataatatttactggagccttggagctattggagccgatcctcttcagtttgaagaccagagtattgagctttattctactcctacccaggatatcgtcttcgcccgcgatggaacacttatcgtatttgagaatgaccttcgtcctcaatacacaactattaaattggagcctattacagcttaatgaagtataatgaaatttatgatagtttaattaaaagaggcctcgaaagaggccttaataaaaagaagcttgattatcatacagaaaaacatcacattattcctaagtgtatgggaggagttaataataattctaactatgtattgctaactcccagagaacattttgtagctcatcaattgttagtaaaaatatataaagatactaagtatttctataagttagttagagctctcaacgcgatgtcaatgtttaatgataaatattctagacccaacgctaaagaatatgaatgggtacgaactttatgttataacgcgaataaattgactaatgtgggaagaaagcataaacctgaaactctacgtctgttctcggagcaacgtagaggtgctaataacccaatgtatggaagaaagggtgaattgtctccatcatttggtaaaaagaggagtaaagaatctaatgataagatatggttaaatcgaagcagaaatattagtcagaaagcaaaatataatatttcaaaggggaaacgaacatctcctatatggaaagaacctatgtataatgaattgtttaatttatacataagtaatccggtaggaggatgcgcgtttagaactaaagccgtgtctttaggatatcctaatacttcataccacagactagtacaagaatttaaggaaattactcaatgacaattgcaccgttcgtcaccagcttacgaattcataagctatctgcgaatcaggtcaatattcgttgggatgacgttggtgcaaacttctactattttgtagaactggccgaaactcgaaacagagcgggggaagttatccccgctgataacttgagttggtcttcactgggttataccgcggataatgattggttcgaacaaaatcgtattgaaccgcttacttattataaaatgcgtgttcaaactacgtcagcagggtttgagccgtctgaatgggttgaaacagaagagttccaaacttttgaagaaaacgcatacacatttgagcatatgcaagaattcagtttagtgaaagaattcattaaacagaagttttctttaaacaacatgtcgtatgttaacttcaacacatctgccatgatggcatctttgatgactgagtcttttcagtttagtcctgaatattctcatttatcagctattgaaaacttcgttgtaggtgaatctggatatcatgaaattcagggacctattgaagcagtgtgtgttgataaaaatagaactatgctgggagaaatagacggaattttgtatctgtttgaaagattccaacatatggttaaagtatcaaacgataaaggacagaactggcaatacgttcagttatttaatgaccgtgtaggaaatcctgtttcacgagtagtaatttatcaatcaagtaccacatcatatgttttaggctatgataaaatcttttacggaagaaaatcatctgacgtacgctggtcatcaaatgaggttaaatttagcgataacgaagtcacgttcgctaaattgggagaccagttaaaactgggatttgaagtagagttatttggtacatatgcatcactacctgctgatgttaccaaatatgcagaagcctttacatgcaatgatgaccacttatatgtagttgcaaaggatacagtacgcagagttaaattaaaagatgctccaatagacactgaccctttaagccctacatttggtgaaaaagtgtttgaaaaggaagtatctcatataacaggcaatcctaaatctgtatgctttaaaatggattccgttggaggcaaaatctttgcccttattaccggggaagttaaaaccttaggattagacccaacagacccaaggaacgttgtggattctgcaactaaaggcgtctatgtttaccaggaaggcacaaatacttggaagcgtgtatttggtaataccgatgaagaaaaacgtcgtatagagcatttatggacttctatgtcaactgacggaaaggaaatattcttttcatcagctaattttaagacaacagagtacgctcaggatattgagcttgagacgaaatatccagaactaatttctactgcagttaaaaatgttaatccaattcagtatcactctgataagcattatcacatgatgagtttcagagcagatgaattttcaggatgggaaacatttgttcctggacctatgaggttttatgctgaaccttggtttgtctggatggctcgtgaaggcaacagatgctggataagtacagctgaccatgcagttgtcatttataatgatattctttatcaaaaaagagtagatgcagcggcgcagggaactaccgagcgtattctatcggaagtgtgggataaaggtgacgcaacgttttattgccctccagtttcatttaatggatttttgcagtatgcttctggcatcatgtttcacgaaccagacggaaaactgataggctattacgcatttgactaccgtgttcgtgaccaggtaacgcttaactggaaaccaactgatgtaatgtttaaggcgtttctgcagaaccaaacacgggaagaagactggacacctgaacatactccaggcttacgtgacccagatttgcgtccgtatcttactaaaatgatgccggatagttacttgctacaagatagtaattttgagcacttttgtaagtactatctccaattcctttcagatggaaatggaacacattacaacagtctcgttaatcttgttaagaacaaatatcctcgcgaagaaaatgcatgggaatatctgtggtcagaagtttataaacgcaacatttatctgagtaaagacgctcgtgacgctgtcgtccgtttctttgaagcacgcaagaatgatttctatgctactaaaggaattgaagactcatataagttcctgtttaaacttctttataacgaagacgtcgaaatcgatattgagtcaaagaacactaccgaatatgacattattgttgaaagtacaaatatttctgacgatttagttggtcgtacgatttatactgcttccggtcgtagtaatgtgacttatatcgagagagaataccgggatggtcgtctgttatggcgtattactattcataacttatcaggacggttcattgaaggccaggaaattaaatcagagcgtacggactttgagggtattatagttcaaggtgtccgtggaaaggatatgctgagtaataacattgattatataaaccgcagccgttcttactatgttatgaaaattaagtctcagcttcctacttctcgtttccgcgacgatgtattaaggtttgttcatccggtaggtttcggtttcattggtataacattgctgacaatgtttatcaatagtggcttaaatatgaagcatgttgagactatcataaataaactcaagaactataaatgggatgcaggactgccatcagtttatcctgatagagttgctattatcgcctcagatgatacaatagaaagggatccaataactaatgagcctagatattcttctcgtgctcaagctggcgaacctttcccattacctgctaactataatcaagaaaataataatagtgttatcgctggacaaaacccaggacaaagacgtaaacctctgagtcctacatttgaccaatcagcagtaacgtttgccaattatcgtgatttagttaaccaacgtcttaaagacgatgcaggtaatcctcgcgatcctgaaaatccgacacaggtaaaaattgatgagtaattcaacaagagcaagttcaacgcgtagcacgatttatcgtgctatcattacatctaagtttagaactgaaaagatgtacacattttataaatcgattggtccgggaacggaccaaaacacactgtatgtttcatttggcaaaagcactccgtggtcagataacgaatctgaacccggatttgcacctccatatcccgctgataatggagatggggtagttgatgtttggacaaatatgatgggcgcggtcaaaattgaatcatcaatgcttgattgcgttgttccaagaagagactggggtgatactagatatcctaacccgcgtacatttttgattggtgatattgttgttgctaactctgcgccatataacagaactgacgctggatttggatggatggtatatagatgtattgatgttccaaaagacggaatgtgttcaattggaaatcttacaagcaaagatgaatgtattaagcttggaggtaaatggacaccatcagctatttcaggttcagctcctcgtggtcgtggtgatgcaaatggtactgtcgatttaggtgatggatatctttgggaatatctatatgaaatcccagctgatgtatcaatcaacagatgcacaaatgaatatattgtagttccttggccagaagagattcaagaatctccggctcgttggggatttcaaaacaacttaacatggcagcaaaatgactttaatttaatttatcgcatgaagtgcaatacgattagatttaaagcatatcttgacgcaatttatttcccagaatttagtcttccaggaaatactgggtttagacagctgtcaattataactaatccgcttgaagttaagccaatgccaaattcacctaatgttaaggctgaaaaaggctggtatagtgcttctggtcttgaaagacagtcaggtgaaatgatttacatggaaaatcggcaacctattatacgttcaatggaccaaacagaagagttaaatttaattttcgagttttaattatggggagcctttggctccccatttttatataaataagactatactttgatatgaggttaacctatgtatacagataagggtaaaaaaataattgacgtcggtgagattggtaatgcttctaccggcgacattctgtatgatggcggtgtgaaaattaatgataacttcgacgccatttacaacgccttcgccgaccaacgattatttgcagctggcggcggagcattgaaccaaaaaattcatgcaacaagctattaccaaaagataaaatttggagatgctaactctgcagggacagttccaatggggtcatgcatagatgctgattgttcagaaggcgcagttcaaatacgtctttcaaaaggtaaagcgggagaagctgtattcgttgtaaatagtaatggctcagcatcaaaagctagatccataaaaataacaacaaacggcgaaggcgtagcagatgcatttaaagacggatcgcgagagttgattatcaacacgccaagatgcagaattgagctatggtgtgttgaggtaaaagctaacggtgctgctgtttgggattattcaatttcaagtatgtttggcagcacatattcgccattagaagctacatataatttaacaagttctcctattaatatccgcattggatataatgatgattactccaccgttaaattgttattaagcttcagtgcaaatccgggtggtcaaaccatcaaaaggcaatcatctgaagtcatgcttatgattgacccgactattacttcatcagcgccaaacggaagagtatttgacactgaatatgcagtgttaagaagtggtgaatcatctgaaaatgaaaagatgtattctatttcatactctattaacgcgcagaaagatttaatatgcacagcttcaacatcttatggaaacgcacgtttggcagttaaagttattgctacacagaccgtaggggtatctcaataatgaaacaaaatttgatagtaggccaatcagtagatgatgggtctggtgattacctccgtaaaggtggtcttaaaattaataacaactttgatgatttatattcagagttaggtgatggttcagttccattcgcagcaggtgcatggaaaacttttaaagctagccctactggaactactttaaatgctaagtttggtcaggcctttgctattaatacccaggcagcaagagttaacgttcagcttccaaagggtacagccaacgactataacaaagttattaaacttcgtgatgtttggtcaacctggcgattaagcccaatcacagttattcctgctcaaggcgatacattaaaaggttcagcttctcctaaaattttcaatactaacttccaagatttggaattagtttattgcgcccctggccgctgggaatatattgaaaataaaacggtagataagctaactaacggtaacttaagtactgtagcgaaaaaatcaattattgctactgcgggtcagactgactttcttaacatttttgatggcgtagaatataacgaagactcgcttaatgtatatcgtcgtggtaatattttatattacggtgaaaccagtgttatggataaagccaatgctgattacggttctcctggaacagtagcaggtcaattggtagaattaaacggtaaagacattcgtttaaaagttccatgcgttgaaggggaagtaataacatttgaaaccttcctagatggaattggtgtttatcggtcttcatacaacaagttggctatccagatacgagattcagcccagactacatcccagacgattcctgggtcaatgatagtagataaccttgctactctccgcagaatcactctggatgacatgggtgtacttccaggcgtaggggtaaatcctaactcgcttgaaatttcattgaacggaaaggaattactcgaagctggaactgctggtcttcctttattttattgtgaaggcgcagaaggtggatacgcagaagactgtataaacaatggtggtcaatgggtaaattctaaccaagattatagactggaatttgactcaactggtactaacgtcgaagctattatttttggtgaggcgtttgaagataaagaccttcttaccgtccgttggttcaataataacatcggtactactatggatatcaatgatatcatggcagaaaccgaccaagtgtatatgaatgctgagcaattagtaactctaaaaaatcgcattgaatacacaaattatgatgaacctaatcagaaaaatatgcgtccggttgctgacgatattatgattaaagtcaataatattgcagcattttttgacgtaatttatccgattggcacgatttatgaaaacgctcacaaccacgcaaaccctgctgactatatgggatttggggtgtggaagctttattcacaaggccgtgttactgctggttggaataatgattcatctgatccttatttttcgcgtaacaacaataacttaaacgaaaatggtcagccatcattaacagcaggtggaacggttggagatttgacatttacgttaggaaaagaacacattcctgaactaatgtcaagagataaagttctaatttcagaccctgaacatggaagcgtagttatcggtggatgtcaattagacccagacgcgcagggaccaggttattctaaataccgtgaagacactgttgcggtaaacaacggtgtagttccaaatgacatcactaaaattcagccaacaatcaccgtttatcgttggattagggtaggttaaaatgacgattgaaactaaaactcgtgaaggagctaaagttaattcaagattagctgctttttcagaatatcgcgttgacccgcaaaatattgcggtaggaaatacggctcctatagggagcctaacctttgaacaaatggatttaggggtttggtatccaaatactgaagctgctattaatgatttgatgtcattgcagtcagcagaaattggaactattatttgcaatgacactggaatatctccacagcccgcacagcaaattacgcgtgctactttttcaggtgtcgttgcgttagagccaaaagaagacggctctgtcggtgacccagtaataattcatattcttggcttaccaattagaattgcaaacggtgatgactttgcagcagtagcaacacgttggtatgataaagtaaaagaattagaagctgttggaaaggttgttcaacaggttactcaatcgccggcaacaccccagtatgttgatattattcatttagattatcagaaccataattttgaaacatataaaaagtatggtttaactgttgaatttactattacttcaccagctaaagcaggttatgggcaatgggatgctatcggcaacgaatctaaaacattcggcgcgaacacatttactttccactattttagaaggatgggataatggcccagaataactataatcactacagtgatttggccaaatatacgatatttgacccaacaaatacacaatggcctgttgctataaaagacgtccaatcagcgttagagctgattggtagctgggcaagaactgataccggattacctgtagcatctcctacagtagccggtgtaattcgcacagcaacacaggctgaagttgatgctggaactattggtaatgctgcggtaactcctgctacattaaaatccacagttacccgtcctgaagcaactacagcagttcttggcttaacacgatatgctactaatactgaagccgcagcattaaccgcaggaaatagaactattaccgcggcggctctcggtcatgtgtttaaaaccgtaaaagcccaagaaaacgtagatggaactgttaggttaactactgcggctcaagcgcaagcaggaactgacgaaactaccgcagtaactcctaagcgtgttgtagaaatgattggaaagttcagcgttagtcctcctagttatacctctgcgacagaaagcaacttgggattagttcgtgtcgcaacccaagcccaggtagcagcaggcgctgttcacgatggatacgcagtaactccaaaaaccttcatggaatcaaaagcgtctgacagtgtatttggtatagtaaaatttgctaaagactcagatgtggcttcagctacttctaacaatttggctgttactccaaaaagtcttcaagcgctaaaatccaccaaggataaatatggattaaccagattatcaggttctccaactactgatgcttcattggcagcggctgcaacagatgcagtctttaaaacccgtagaataaacggaaaaactcttgacaatgacataacgattactaacaatgatattaattgttatacaagacaagaatctgacgggcgttacatgccagctggaaccagagtaggtaatgttacttgggttgaaggtcaatcttggattagtcgaggtgcaacgtttacatgtaatgcaccatgggaagcttctagtagattagctctaaatgttaatgtaaaatttgagcgtaacaacgacggatatgacaatcgtattttcagatttgttgtaatagttaacggttcccaatggggcggtgaacttactcttaacatcgaaaatactaaaggcggacgaaatggtcattcatggagatttgaagcttacgcatctagcaactttttcttcaataacattcctccaaatgccactgttcaaataagaccaacagaagacagtcgtattatattttatgactgcatgcttacattctgtacaaatagaccgtaaggaacaatatgaccaaactagtagattcgcttccgttcgtagacggaattccagacgattttcaacagagaattaactggataaaaaatacagagcctcttaatggggcttcaacccgctatggaaatgatggagaactgaatagagcttctgttcaaatccagaaaaacgttgttcaggtacataacgatttgaacaacgttggaactgctgtagaaaatattcaagtagatgtagaccaaatcaaaaaatcgttagaaattacaggttcttctgacgccattgagcaggtttatatcaataaaaagaatattgaaaagcatgatggacaaattcttaaattagaagaagacaccgaaaaacttcgaactgaccttgattttctcgaagaggatgtaggtgtttatgattctagtaaagatgactattacagaacagttcgtgataatatagtttgggttaaacgtgaaattggtgcgtatcctgggcaagatattaacggacagccgaagcaagactctccgggttctggtatgaaataccgaatcatcaataatgcgtcagctatagtaaaacatgacgagcgtattcaggcgctagaggatgcatacaatgattcagacgtaggttctctgactattgaagtaaacgacctgcgtaaagaagttggtcctaaatccggagctacgtcagcttcaatttatgcaaggcttgtgaataacgctgatgctatttccgcagctaataatgaaatctttgctattaaccaagccattgattttaccaatccagtaaaaattggagctcgtactactagattagaaaacgattatcgtatagttgacgcaacacttaactctgcacaaaccgggttagttcctcgtgtcaataatattgatgctcgtttagggtcttctgataagcctgatactattgaaggaaaaattagttctctttcaactgaccaagggtacatttctgatgttgtaggacgtgatacttcatcagggcttcagggtcaagtagcatggataaaccaacaggttggtattgttcctagcgagcagccgattcctcctgggtcaattttagcgagaatgaccaatgttgaaggtatgcaaaactctcaacagtctgctattcaggacattcaagtagaacttggcaataacaatgaagggttaaagggttctgtatttacattacagactcaaatgaatggtgacttttcgtcagaaaacccagttcaacgtgatggtgtatacgctactgtagtagaattgcaagataaattcgtgactgcagttactgacgtagaacaagctggagcatacctccgtaaacagggcgaatggtttaaaaaaccttcatcaataggtgaattcagtaaagaagatttcactgttgatttaagttctgatgcattggtaaatcctaactcattggtcgctgctccattcaatgctggcattcgtattgtcgatgacattgttgttgatgacgatggcgtattttgcgtagaaactgatacggttatcgaagcttctgattcagataaaggcgtgaaaattgttattctcgttaataacattgaggtgttttcctacggacttggtgttaaagcagtaacgggcgagcagttgattaaaaccaagaaactcattgagttttcatctggtgatgcaatcaaaatcgtgtatagagctgcttcagaagaatcgcaggttcttgttaaaattaaatctttggatattactattcatccagctgtataacaaaaggggaccttcgggtccctttttcgtataaataggaatataaagaggagttcatatgtcatacaacacgtacaacccaaaaacgcttaaagacgctatacttcgacgtctaggagcgccggtaattaatgtagaagtaactgaagaccaaatttatgattgtattcaacgagcattagagttgtatggtgaataccactttaacggattgaataaaggttatcaggttttttatattggaaaagacgaagctgacaacgcaagatttttaaacggcgtgtttgatttgcgcggtcgtaatgtatttgctgtcacccaaattgttagaacaaatgtaggttcattaacttcaatggatggtaatgcgacatatccatggtttactgactttctaatgggaatggcaggaattaatggcggaatggggtcaagctgtaataaaagctatgggccaaacgctttcggtgctgaccttggctattttacacaattgatgacttactggtcaatgatgcaagatttacttgctcctctcccagattattggtataactctgataatgaaatgcttaaagtaatgggcaacttcatgaagggtgacatcattgtctgtgaatgctggaccaaatcatttatgaatacagatgtgatggtaggcaatacagcaggatatggattcgccggagcccaaactgctgaccactggggtttaggagatagataccagaatcctgaccttcgcaataacggccaatatgctggtgaaggcaatacaaatagagaaggtgcatataataatcgttgggtaaaagattatgctacagcattaactaaaaagctgtggggtgaaattctttttaaacatcagggtctgcaattggcaggtggagttacagttgatggtcaaacacttaaggtagaggcccaagaagaaatcgagaggctccgagaggaacttgatttacttgacccgggttgtcctattctgttggggtaaaagatgtctacatttgattctaggctcttcgctaaactcgaagattatcgaggatataataaaactaatgagactgaaattctcaatccttatgtgaatttttacaatcataaaaatagccaaacgttagcagatgctttatcggctgaggctattcaaatgagaggaattgagttttatttccttcctcgtgaatataacaatcctgatttgctttttggagaagacccatcaagtaaattcaccaaagcttggaaatttgctgcttatttagattcatttgaaggatattctggcgataacacattctttagtaaatttggtatgatggttaatgatgaagtcaatctgactattaatcctaatttattcaagcatcaaactaataattctgaaccaaaagccggtgatctaatttattttcctatggataactcattattcgaaattaactgggttcagccatacgatccattttatcagttaggtcaaaatgttcaacgcaagattactgcacaaaaatacatttattctggtgagcagcttcagccagaattgcaacgtaatgaaggcattaatattcctgaattttctgagcttgatttagaaccaatcaaaaatatagatgctcttgctgatatttctgatgtgcaatacgcagaaagtgacgcaatcaataaagaagccgctgaatatgttcatccgtattatgttaataacggaagaggacttgaatctcctcctaaagcagattcatttgatgacggatttttcgaataaataaaataaagatgggacctttgggtcccttaggagaaatcatgtttggacattggtataattcgtccttacgccgatacattgtattgcttggagatttattttctcatgtacaaattgctcgttggcgtgaagacactggactaaaatatattaaagtacctatcacttatgcttcaaaggaaaagttcctttctcagcttggaaaatggactgctattcagtctaccgagaataaagcaaaaatagaaactgttttgccaagaatgaatttgcacttggttgatatgcaatacaacgcgatgtataaaacatcacagctgaatagaacaaaatcatataaaactccttcaaaaattacatctcaatataatcctactcctattaagatgatttttgaattaggaatttatacacgcaatcaagatgatatgtatcaaatcatcgagcaaatcgttccttattttcagcctcacttcaatacgaccataactgagctttacgacaaagacacaagttttaatcgtgatgttagaattgtattacagtcattttctccggatgaagctgttgatggagacaatatcactcgtcgtagattagaatggtcattaatgtttgaagtcaatggttggctgtatccgcctgtagctgaaattgatggcgaaattagaaccatttatttagatttcttcgctaacagcaaagagttaactccagaaggaaactttgaatcagtagatagcgaagttactccacgagatgttcagcatgaagattggaatggttctagtaaacaaacgtattctcatgatattcctattccggtaaatccggaggctcctggaccgagaggtgaaaaatgagtgaattacaattagatatggctaaattattagacatcgaaggaattcctggaatagaaggacaagaaattccggtttatgaaaaactcgaattagttgaggttaaatctaacccaaatgaccgtaagcctgacctcgaagatgactattcggtcgttcgtaagaacatgcactttcaacagcaaatgttaatggacgcagctaaaatatttttggaaactgctaagaatgctgactctcctagacatatggaagtatttgcaactcttatgggtcagatgactacaaccaacaaagaaattcttaagcttcataaagaaatgaaagacattacttctgagcaggttggcaccggaaagggagctaatcctcagcaaggaatgaatattcaaaatgcaacagtctttgtagggtctaccgctgatatgatggatgaattcggtgatgcctatgaagcacaagaagctcgagagaaaatagtaaatggaacagactcaaccgtttaacgttctgagcgatgcccatcctttaaatgacgggaaactgacggttattcgtcacccgtctgaaatggaaacgaaaattgaaaacggagttcgtttctttaaatcgcaatgggatgataagtggtatcctgagaagtttgaagactatcttaagttgcatgggatagttaaaattcgtttgcaaggtgaagacccagctcatttccaaacgtttaaggacaaaaacaataagcgcacccgctatatgggattaccaaaccttaaacgagcaaatattaaaatgcagttgacgcgtgaaatagttgcagaatggaagaaatgccgagatgatattgtgtacttcgcagagacctactgtgcaattactcacattgactatggtaccattaaagtccagcttcgtgattaccagagggacatgctggaaatcatggcagccaaacgtatgacttgttgtaacctcagtcgtcagctcggtaaaactactgtagtagcaatctttcttgcgcacttcgtgtgttttaataaggataaagcagtaggtattcttgcgcataaaggctcaatgtctgcggaagttctcgaccgtactaagcaagcaattgaattacttcctgactttcttcagcctggtattgttgaatggaacaaaggctcaatcgaattagataatggctcatctattggggcatacgcttcgagtcctgatgccgttcgtggtaactcatttgcaatgatttacattgacgaatgtgcgtttattccaaacttcatcgatgcatggcttgctatccaacctgttatttcatcaggtcgtcgttctaaaattattatcacgactacaccaagtggattaaaccacttctatgatatttggactgcagctgttgaaggtaaatccggctttacgccttatactgcaatttggaactcggttaaagaacgtctatataacgacgaagatatgtttgatgatgggtggcaatggtcacttcaaactatcagtgcttcttctcttgaacagtttaaacaagagcactgtgcggaatttcatggcacatccggtactctcatttccggtatgaaacttgccaatatggattggattgaagttactcctgactcgcacgggttttataaatttaaagaagcggaagcagaccacaaatatattgcaactcttgactctgctgaaggacgcggtcaggattaccatgcactaaatattattgacgtgactacatctgaatgggaacaagttggagtattacattctaatacaatttctcacttaatcctcccggatatagttattaaatatctaatggagtacaacgaagctccgatctatatagaacttaactctacaggtgtttctgtagcgaagagtctttatatggatttagaatatgagaatgtcatttgcgattcaatagttgatttaggaatgaaacagacgaaaaggtcaaaagccgtcggatgttctgcactaaaagaccttatcgaaaaggataaactcattattcaccatcgtgctactgttcaagaatttcgtactttctctgagaaaggagtatcctgggcggcagaagatggatatcatgacgatttaattatgtcactcgtaattttcgcatggttaacaacacagcaaaaatttgctgatttcgtggataaagatgaaatgcgtttagcatctgaagtttttaaacgcgaattagaagatatgaacgacgattacgctcctgtagtgttcgttgacgccgtgaatagcgcagaatatgcgcctcaagaacatggtctttcatttgtataaataataaaaagcaaacaacattgaggatatatcatgcctttagtctctcctggaattgagctcaaagaaacgagcgtacagagcacggtagtacttaacgctacaggtcgtgccgcaattgtcgggaagttccaatggggtcctgcatatcaagttactcaaatcactaatgaagttgaactggttgatatgtttggcggccctaataaccaaactgctgattactttatgtcagcaatgaactttctgcaatatggtaatgatctacgcaccgtccgtgtagttaaccgtgaagctgctaaaaacgcatctccgctggttgataatattgaatggactatcactactgctggtagtaactatgaagttggtgataagattacggttaaatatgcagaccaaactgtagatgacaccggttcagttactgaagtagatagtgacggaaaaattaagtcggtgttcattccgacatcgaagattattgcatatgcaaaaagcattaatcagtacccagatttagggtcttcgtggacaactaccattacttcacagagttctggtgtttccgctgtcattactttaggtaaaattatttctgagtctacagttttactgactgagcatgaaactgcccatgaagaaatgacaaaaaccgaattccagactgcgcttgcgcaatataaaatgcctggaattgtagctgcgtatccgggcgagctcggaaaccaactggaaattgaaatcgtatcaaaagctgcatttgataaaggtgaacagctgacgatttatccggctggtggaaaacgcgcttcgactgcaaaagctgtatttggatatggtcctcagaccgatactcagtacgctatcattgttcgtagagatggcgcggtagttgaatcaactgtgttatcaacaagtcgtcaagataaagacatctacggaaataacatctttatggacgattatttctccaaaggttcttcacgttatatatttgctaccgcgcaaggatggcctgaaggattttccggtgttattcgtctgggtggtggggtttcagctaatgaatcagttactgctggcgatttaattcaaggttgggatttatttggtgaccgtgaagcactgcgggtaaaccttctgattgctggtgcttgtgctggtgaaacggatgaaatcgcaagtacagtgcaaaaacatgtgtcgtctattgcagatgaacgtcaagattgtttagcactcatttcaccaccaaggtcaacgattgtaaatattcctctgacccgtgctgttgataatttaattgattggcgtcaaggtgaaggaagctacgactctgcaaacatgaacatcaatactacgtacgcagcaattgatggtaactataaatatcagtatgataaatataacgacgtaaaccgttgggttccgttagctgctgatattgcaggcctgtgtgctcgtacagatgatgttgctcaaccttggatgtcaccggctggttatcgtcgtggtcagattctgaactgcattaaacttgcgattgaacctcgtcaagcacatcgtgaccgtatgtatcaagcaggtattaacccggtaacgggtcaaggtaccggtgatggtttcattctgtttggtgataagactgcaactactgttccaacgccgtttgaccgaattaacgttcgtcgtctgtttaacatgctgaagaacaatatcggtgattcttctaagtggcagctgttcgagttaaacgataactttacccgttcttctttccgtatggaaacaagccaatacttggcgggtattaaagctctgggtggtgtatatgacttccgagttgtatgtgataccacgaacaacacccctgctgttatcgatcgcaacgagtttgtagcgagcttctatatcaaaccggcgcgcagtataaattatattacgcttaacttcgttgctacggcaactggtgcagatttcgatgagttgatcggaccacagtaatatgaaccccaggacattctggggtcatctaacctttagatgataaattatattaccgcacactttaatagcctctatgatgatgtagtcaatcgagaggctatataaatatctataggaaacaacgatggaattaacagacatcacccgtgcgtttgaatctggtgactttgcacgtcctaacctgtttgaggtagaaattccttacctgggtcgtaacttcagtttcaaatgtaaagcagcaccgatgccggcaggtatcgtagaaaaagttccagttgggtacatgaaccgtaagattaacgtcgctggtgaccgtacttatgacgactggactgttaccatctataacgatgataaacacgaagtacgtaaggcaattattgcttggcaggctcaggcccacgctcaaggcaatgatatctctggtatgactccagccgattacaaaaaggttgctacggtacgccagtttagtcgtgatggcaaaactatcacaaatgaacacaccattactggtctgtggccaactaacgttggtgaagtacagatggactgggattcgaataacgaggtagaaacgtttgaaactacctttgccatcgactggtgggaataatgctatggggcttcggccccgtatcgaagttctgtgagttatttgcttaaatatctgacaaaacttcgatataaatatacttatagataatttcggagactccaatggcctttcatattttggacttattcgctccgtgggaaaaacgcgacgaagctgaatataagcaacaaatcaacaatgacctagagtcaatcactgctccaaaatttgatgatggagctcgtgaagttgaatcaaacgaaaacgaaatccagtacaattcattcaaccaaatgatgtttggttccaatgaacctggaatgaaaacaactgctgatttaatcaacacttatcgtagtttaatgaataactacgaagttgacaatgctgttgaagaaatagtttctgacgcagttgtatacgaagacggtcatccagtagtttctcttgatttagattctaccgacttcagtcaagcaattaaagaccgcattcttgaagaatttaatacagttttaacatgccttaatttcgagcgaaaaggagccgaccatttccgccgttggtatgttgactcaagaatattcttccataaaatcgtcaacacaaagaaaatgaaagacggaattcaggaactgagacgtcttgacccgcgcaacttacaattcatccgtgaaatcgttaccgctgatgacgctggtactaaaatcgttaaggggtacaaagagtatttcatttacgatactggcaaagaaagctattatgcagatggcagattatattccgccggaacgaaaattaaaattccacgcgatgctatcgtatatgcacattctggactagttgattgttcaggtcaaaacatcattggttatttacaccgagccgttaaacctgccaaccagttaaagctattagaagatgcgttggtaatttatcgtattactcgtgctcctgaccgtcgtgtgttttacatcgacactggtaatatgccttctcgtaaagcggcagcacacatgcagcatattatgaacacgatgaaaaaccgtgttgtatatgatgcgtcaactggtaagattaaaaaccaacagcataatatgtcaatgacagaagactattggttgcagcgtagagatggtaaagcagttactgaagtagatactcttcctggtatgtccggtatgagtgatatggatgacgtccgttactttagaacagcgttatacatggcattgcgagttcctctttcgcgcatgccggatgcaaataatcaaggcggtgtgcagtttgatgctggtacagcaatcactcgtgacgaacttgattttgccaaatttattcgtagattacagcataaatttgaagagattatgcttgatccacttcgcactaatctaattcttaaaaaagttttgtctaaagatgagtgggaagacgaaataaataatattaagattgtgttccataaagactcatatttcaccgagttgaaagatgctgaagttatggagcgtagaatcaatatgctcacaatggctgagccgtttatcggtaagtatatttctcacaagacagcaatgaaagatttccttcagatgtctgatgaagaaattgaacaagaagccaagcaaattgaattagagtctaaagaggctcgcttccaagaccaagaaaatgaagaggatttctaatggaaaattatatttccgcaattgaatccagagacctcgtagcagccaaaaaagcttttggtgcaattatggctgaacggacatctggtttaattgaagagcgcaaaaaatttatcgcagcgtctgtcatgattgagggtgaagagcccgttgacgatgaagatgaagacgacgaagatgaagataagtctgagaaagacgacgacgaagaggacgagtaatgcttatactgcctgaaaatcatgaattagttatcgacgctgtcgaagcttttcttcctgaagcacaggcacgttttgataagttgtccgcagcgctttctaaagatgatataaataaaattgtagagaacatggttacttctgagcctgatttagcaattgctttaggttcaattaacgaatctctacaattaaatgaatttatcgttaagcacgttgattctaaaggtactattacccgtaccaaagatcgtaaaacacgtgagcgtaacgcgtttcaaacaaccggactttctaaagctaaacgccgtcaaatcgcgcgtaaagcagtaaaatcaaaacgtgctaatccatcggctcaaactcgtggattacgtaaacgtaagaaagcacttaaacgccgtcaggctctggggctaagttaatggaaaacctcaatgaacaacttttaattgagcattggggtcaaccgggcgatgtaattgatggtaaacccatgctggaatctattatcgttgaaggcgaaaatgaatctggcttaaaacctggtctgtatatcgaaggtgtttttatgcaggcagaagtagtaaaccgtaataaacgtctttatccaaaacgcattcttgagactgcggtaagccgttatattaaggaacaggttgctactcgtcaggctctaggagaattaaaccatccacctcgtgcaaatgttgacccgatgcaagccgcaatcattatcgaagatatgtggtggaaaggcaacgatgtttatgggcgtgcaagaatcatcgaaggagaccacggtccaggtgataaattagccgctaacatccgtgctggttggattcctggtgtatcaagccgtgggctcggttctttaaaagactcaggaaaaggatataacatcgtacaagaaggctttcgtctgactgttggtgtagacgcagtttggggtcctagtgctccggatgcatgggtacaaccgaaacaaatttcggaaaatacctcggcacaagttgccaatagtgctgatgatgcttttatggctctcgcagagaagttaaaagcgttataaagtacgaggaggtaaatatatatggaaaccctgaccgttcacgctccgtctccgtctaccaacctgccgtcttacggtaacggtgctttctctctgtctgctccgcacgttccgggtgctggtccgctgctggttcaggttgtttactctttcttccagtctccgaacatgtgcctgcaggctctgacccagctggaagactacatcaaaaaacacggtgcttctaacccgctgaccctgcagatcatctctaccaacatcggttacttctgcaacgctgaccgtaacctggttctgcacccgggtatctctgtttacgacgcttaccacttcgctaaaccggctccgtctcagtacgactaccgttctatgaacatgaaacagatgtctggtaacgttaccaccccgatcgttgctctggctcactacctgtggggtaacggtgctgaacgttctgttaacatcgctaacatcggtctgaaaatctctccgatgaaaatcaaccagatcaaagacatcatcaaatctggtgttgttggtaccttcccggtttctaccaaattcacccacgctaccggtgactacaacgttatcaccggtgcttacctgggtaacatcaccctgaaaaccgaaggtaccctgaccatctctgctaacggttcttggacctacaacggtgttgttcgttcttacgacgacaaatacgacttcaacgcttctacccaccgtggtatcatcggtgaatctctgacccgtctgggtgctatgttctctggtaaagaataccagatcctgctgccgggtgaaatccacatcaaagaatctggtaaacgttaaataattatgtaacttaacacaggacatcaaaaatgcttaaagaacttttaatgaccgaagctaaaactatcgatgcttccgtcgctcttgacagtattttcgaatcagttcagctttctccggaagctaaagctaacttcagcactgtattcgaagcaacagtcaaaaaacacgcagtagctctggcagaatctcacattgaaaagattgctgagaaagcagaagaaaaagtagaagaagaaaaagaaaaagctaaagaagaagctcgcgaagagctgaaagaagctgcttctaaatactttgaccatatcgctgccgaatggatggcggaaaatcagctggcggttgatcgtggtattaaggctgaactgtttgaatccatgtttagcggtatgaaagaactgtttgttgagcacaatgttgtaattcctgaagaatcagtagacgtagtcgctgaaatggaagaagaacttgctgagcaaaaagcagaaactgctcgtttatttgaagaagtttctaaacgtgatgcttatatcaattacgcccaacgcgagtatgctattcaagaagcaacccgtgaattgactgatactcaaaaagagaaagtagtttctctgacagagggtatggattattctgactcgttttcaactaagctgaaagctattgttgaaatggtgcagggttctgtagagcagtctgtaacggaatctgccgatataaatactatcgacaaagaagcagacggtttaaacttcacaactgaagcagtcgaagaaactcctgcgactaaaaccccatccgttatggatgcttatgtagcccaagcggctcgtctttcttaatttaaaaggttatacaacacatgaaaaagaataaacttatcgaaaaatggcagccgctgcttgagaacgaagctctgccggaaattgttggcgctagcaaaaaagctctgatcgctaagatttttgaaaaccaggaagctgatattaatcaggctccggaataccgcgatgaaaaaatcgctgaagcatttggttctttcctgtctgaagcagaaattggcggtgaccacggttatgatgcacagaacatcgcagctggtcagacctctggtgctgtaacccagattggaccggcagttatgggtatggttcgtcgtgctatccctaacctgattgctttcgatatctgtggtgtacagccgatgtctaacccaaccggtcaggtattcgctctccgcgctgtttacggcaaagacccgctggctgctggtgctaaagaagctttccatccgatgtacgctccggatgcaatgttctctggtcagggtgcaaccgagaaatttgaagcagttaaagctggtgatgctctgactgttggtgatatcgttgttcacgatttcgcacagaccggtcgtgctcatctgcaggttgttgaagatttcactgtagacgctggtgctaccgatgctgctaaactggacgctgcagttactgctgctctggaagctggtaaagttgtagaaatcgccgaaggtatggctacctctgttgctgaactgcaagaagcctttaacggttcgaaagataacccgtggaatgaaatgggcttccgtatcgataaacaaaccatcgaagcgaaatctcgtcagctgaaagcacagtattcaatcgaactggctcaggacctccgtgctgttcacggtatggacgctgatgctgaactgagttcaatcctggctactgaaattatgctggaaatcaaccgtgaagttgtcgactggattaactactccgctcaggttggtaaatctggtatgacccagactgttggttctaaagccggtgtattcgacttccaagacccgattgatatccgcggtgctcgttgggcaggtgaaagctttaaagctctgctgttccagattgacaaagaatccgctgaaatcgctcgtcagaccggtcgcggtgaaggtaacttcattatcgcttcccgtaacgtagttaacgtactggcagctgttgatactaacgtatctccggcagctcagggtctgggtcgtggttataacaccgacaccactaaagcagtatttgctggtgttctgggtggtcgctaccgtgtatacatcgaccagtatgctcgtcaggattacttcaccatcggttataaaggtgctaacgaaatggatgctggtatctactatgctccgtatgttgcactgaccccgctgcgtggttccgatccgaagaacttccaaccggtcatggggttcaaaacccgttacggtatcggtattaacccgttcgccgattctgctgctcaacagccgaaaggtcgtattacctctggtatgccttctatcgtcaactctgttggtaagaatgcttacttccgtcgtgtatgggttaaaggtatctaataccaataagggagccttcgggctccctttagttgttttaatggatataaataaacttataaatccacagaggaaagcgcaatggctaaaatcaacgaacttctgcgcgagtcaactacaacgagtagcaacttaattggtcgccctaatctcgttgcattaacgcgcgcaactactaaattaatctataccgatcttgttgctacacagcgtactaaacagcctgtagcagcgctatatggtatcaaatatcttaaccctaatggtgatttgacatttgcaacaggtgcaacctatgcaggtcaaatcggagccacagaacgtgagtcaattgaagaactcactatggcaaataaagactcattcaataaagacgatatgttcaaatatcagaatgtggtctttaaagtacttaaagatagcccgtttactgatacaacagaaaccgatgaatttggacttgtatctgaagctgtagcagctaataatattcgtatgctgtcagatgctgcagtcactgaaaaatttgaaggacctgattcagacccaatcaccgaagccagttttaaaattgataaatggcagacccaggttaaatcacgtaagcttaaaacagatttaacggtagaattagctcaagatttagaagctaatgggttcgatgctccagaacttattgatgatttacttgctactgaaatggcagaagacattaataaagacatcctgcaatcattgattacggtttcttctcggtttaaagtagctggtgtatccgataaaggtgtattagatttaactaagcaggattctgctccggaacaaggtcgtactctgtatcgtttcatttgtgaaatgaattcagcagttcaacgtaatacttcttattctggtacttatgcagtagcatctactcgttgtgctgcggtgcttgcagcttccggttggttaacacagaagaatgatggaagtattccggaaaacgcatacggtatgctgaataacggtttacctctttattgtgatactaacagtccggttgattacgttattgttggtgttaaggcagaatttggtgggaaagaaactgtaggttctttattttatgcgccatataccgaaggcttggatttagacgaccctgagcatgttggtgcatttaaggttattgttgacccagctagcttgcagccttctgttgctttactggtacgatatgcgctgtcagttaacccatatactataggattggacgaggacgaagctcgtgtgattaatgctgcggatatggataagatggcaggaagaagtaagatgtctgtactgctcggtgttaagttacctaagcttattgcggactaatttgcggggagcttcggctccccttttttgctataaactaaatatgtcaaacctcggggagtattcctcctcgagggatttaaacacgttcttatcatagagattgacgcattctattccatgtctacgggctatatcaacagctactctcgtccctccagatacactcccgcatcttttttcaggcgcccaatataataccttatctacaggctcagtgcattctaggcccaatacctgcatagaattccgtgcaaatagtgtctgtactatcttcgagcattcatcccagtacgacgtaacttctctcgccttaatgatgcttttgattttggcttcgtttgataattcagaccatacaacaacacctgtatcaggaacatggccacaaaagccagaataaggaataatcctacaagaatttgacctatcgtatttcgccaaccacgcttcatctgaacccggagctccacctgaatatgaaaaatgcccctcttccgagaggcgttgaccgattatagtcattagactcagaactctgcgtggcgcttctcttgaaccaatcagcgccagcctcattattctaaaacctcatgccatttgctacgaatagtgttttgaattaaagtagtcagttctttcttaacagcagaaggattatcagcgaatagcatgtcatgaccttcacgagctgcttcgttgatgatatctttcatagtcagtcccataactcgaccaaaatctttggcagttacagtaccaatatgagacagaacgttacttacacggttccaggttacatactcggaaaagatttccagaacacgcttatcagtatcagtgagttcaaccttagctttaataggcttatcagatttagctttctcgctgaacttagaattcttacacttaatagctacacgggtaccgttattaaagaatttaggattaaccggtttaagaacatagccttcagctacaccggtttcagaagaagcctgtggaccgaacacatgtttatttgcatgttcaaggtcagtcgtgtcaacaagttcattatagtaattgacaatagatttaaagtcatttacatactgagatagctcagcgaatgaaccacgaccaagcagtggagctaatttaagaccaagaccagtagcaaacgattctactacataatcgtcccaataaactttttcgttaccggaatccgacaggatatcaaacacgtagaaatctttatcaccataatctacgcccttctgaataccaccgccagcaaattcaccgaagatttgaacagatactaaatccatggtgttcagcatgttctgcatcttaacgaaagaatccttgtacttcttcatgataatctcatgaccaaagaagctttcaccttctaaaataggaccagtacgcttagccggaacgatttcggtaggggtaataatcacactgaagttagtgccatgaattttctcacgagccacccactcaacggtatgcatatcaaaaccagcaccacgaatcttctcgatgaacttaccgttgtaatgattctcaagactagaatattttgcaaacattataatttccttagaatgtgattttcataaagtcagtatcaccgttacgctgggaactggtataatttgtaacaaatccttcatcatgcaaataattaagaacacttgtaatgtgtttcttaactagactactcggatacataattaactcacgcttacccgctaaagcggttttctcaatctgagttaatacttcttcttttgctgccgataattcttctgtagcaacattaatagcagtattagccattctatcggcaaggttcataatttttctctcaataaataaaataaaaccaggagtccatctatcttggacaagggtaatggtatcagaggatttcccctgagcccattataccacatcgatttttaaagcaattaataaccgctcggtacgaagcgatacatgatatatccgcttttagttagcatgatttcaaattgacttttgcttccaacctcaagtactaatggaatatctttatccattagcatccaatcaatttttccataccgttcattaatcaaatccgttattttacgtgcaccacttttatagtagtaagaactctgaacagccatcattttactaacaaatttagatgcaaacaaccagacatttaccccattagcagctggcgtaaatttcttagaaagcatttcttcaaatcgttctactacaattgggtctactttagacattataaagtcctcatgtgtttaacaagtttcttatgacgagattttataccaacgtttgttaagcgtttccgatatacgactttttctttttgcttaaaccgttcgtgtgctttctcaactgagacccacaatttagcagcttccgctggagtgatatctaatgctctcgcaatttcttgaaaatctttaccgctttcatgcattaagtgagcttgtagtgctttcataataacctcatctatgtgacgaggacataataaaccaatccgtgaatagcaaaaaagggagcccgaaggctcccgaatattaaggatagataatacccgcttccagcgcagtacgatgaacaatgtatccatttctagattcttgtacatcgacttctggataatcatctagcattttagccagagtataccgatgcaggtaatagtcgctgtcagggtcgtcgagtttccaatctttgccctcaacagtcattcgctggatttcatccattacccaccatccgcaccagatataggctgttccacggaacggtagaggatgaatatacggaagttctccgtctggctcaggggctactcttttggtaatagttacatcgccagttttagtgactgtaatcggggtgtaatcttctgcggaaacctcaacagaaacctcaatcacttgagaccctatatcagacgtgtcaatcactaaagtgctagtagaaccttctacaggagaaccgtctttggtccaagaataaaccccagttgcaccttctggagcaccgataacgttggctttaaaagatgcttcagacccttgttctgccgtaatagactcaggagtcaaagtaacagaaacaccactcattgtctttttagtaaaagcaacagcaatacctttagttgcagttccattattataatctggagcagaaaccgttacttcacaattcaatgtgtagctggtttccgttgactcggttaaggtaattgttttacccgtttggccagaaataacagaagagccacgtttccaaacataagcaatgcttgctcctgacggggcgccagtaacatcagctgtgactacttgggattgaccaatttctttagaaacagaagttgggctcaaagttaaagtaatggccggcatagttttgttcttaactgtcagagtagtttctgcttcagctgtttcgggatcgccttcagccggagtaacagtagcaactactttaacggtcttactacctgcaggtcctgcagcaacataattcatagctgcggtaacagaagattgttttacaccatttacggtccatacaaacgtttctgtgccttcagctgcggctccagaagttgttgcagtaaaattggttgttgctccaatgactgccgaagcagccaaaggagcaatagatacgctataagccataggtgttccttattttaaagttacaaatgaagaattacgtgtttcacgaatcataacagacccgtttcttttgatgtaatagattaaactaaacagtgtctggtgtgctgatgggtgttcaaacgacgttggccgagatttccaatctggggtatctttaatccattggtaaatccaccatggaagagtaatatatcctgggttcttacctagcaattgcatgtttggactaaagtttttaggaagctcaatggtttcatcagttttaacaattttaactactttgtccattgctttgaagaattcttcagggtccgtagtactaattggaatgtttgtaagttttccttcatcatcgatatggataacgctgtctccaataggagcttcagcataaaatcctttatcattgatagaaggagtttttacttcaaatccagggtcatttactttgggtgtttctttataaaaatctgggtcaatatcatgaattttaacacttgcacttactggagcatcaaacagtagttttgcttcatcagacgcttcatcattgaaaagtgcttttccttcaatttcatcatctgcttggattaaatcagcaattgatagaccatcgttgtcttctggcataggctcatcggccaatttagccagttctttttctaagtcagcaaccatattgtcaaatgagcgggtcttcttcagtttaataccgaaggttttggcatattcgtcgagcttgtctttagcttcttttttatcgagtgcctgaatttctttaatatagtctttatctagcattgggtgtgcctcatgtaatgtataaatatgattgtatttataaactgaggatagtacagtgcacgacatccaagtcaaatttaaagattttagtcatgttcatattgagtgtgatgactcaattttctatgaactcagagactattttagcttcgaagccgatggatacagattcaacccgaaatatcgttatggacattgggatggaagaattcgtctgctagattataatcgtctcttaccgtttggtcttgttggccaaattagaaaattcgctgaccaattcggatataaagtttatttcgatccaactatattcgagcaagaaactctttcacgggaggattttgacaattggttatcgactaaagaaatttattcaggattaactaagattgagccacactggtatcagaaagatgctgtatatgaaggtctagttaatcgacgtagaattcttaatcttccaacgtctgccggtaagtctcttattcaggcattacttgctcgttattatgtagaaaattacgaaggcaaaattcttatcatcgttcctaccacagcgttagttgaccagatgattgatgatttttgtgattatcgtttatttcctcgcaatgctatgttgggtattcgaggtggtactgctcgtgattcgaatgcattagtttatgtatctacctggcagaccgctgttaagcagcctaaagaatggttttctcaattcggcatgatgatgaatgatgaatgtcatcttgcaacgggtaagtcaatttcaacaatcattgcgggtctcaccaattgcatgtttaagtacggactgtctggttctcttaaagacggcaaagctaatatcatgcaatatgttggcatgtttggtgaaatcttccgtccggtatcaacttctaagttaatggaagacggacaagtaactgagcttaaaattaatacaatcttcttaagatatccagatgcagccgcaaatgctttaaaaggaaaaacgtatcaagaagaaattaaattcatcaccaatgttaagaaaagaaaccgttgggttgctaatttagctgctaagctagcatcgcgtgatgaaaacgcttttgtgatgtttaaacatgtagctcacggtaaagagctattcgagatgattaaagctactggtcatgagcaagtttattacgtatcaggtgaagttaatactgaaacacgtaatgctttaaaggctatggcagaaaacggaaagggaattattatcgtcgcaagttacggtgtattctctacaggtatttctgtaaaaaacctgcatcatgtaattttagctcatcccgttaaatcgaagattatcgttctccaaacaattggtcgtgttcttcgtaaacacaaagataaatctttagctactgtctgggatatcatcgacgacctcggtgtaaagccgaaatccgccaatgctaaaaagaaatacacgcatttgaattattgcttaaaacatgcattagagcgtattcaacgatatgctgatgaaaaatttaactacgtaatgaaaacggtaaatctatgattaaatttgaagatatttacgaagccacaattcgtgaggctactatcgataacttcatgagtaaaattaatgcttgccaaaccttagatggtctgaaagaactcgagaagtattacgataagcgctctaaagaaactactcttgctgattctgatgacatcattgtgcgggatgctttggcggggcgtagacaggctcttgaagctgattctgaagatgacgaagacgaagacttctgatataaaaaagccccaaccgaaaggaaggggcaaagccaattggctacatcaacactagactaaattaaaagttgcgtttcttgtaattgctcttctgtgtcttcagtgacaggcaattcaatcgcataattatagcaagctccgggatgaaccgggcctttgtctgtgtggacaaccaatgcttcatcgattggtcctttacagacgacacataccgtattcgacatgattgtctccttagtttacaagtttatttattacgcgccagcttcaaactgacgaaggtcaataatgtgcttaatgctaaaacctcgtgacttgatagcatccattgcatcgctacagaactccaaaagaattccccaatattgcaatttagtatctacacccaagatttctttatcagcgcttaaaacagttttcatttctgatttttcatatacatccatgcatacttcaccaccaacctcgccacggccagtgtaataatccaaccgtgctttaagattttgctttttgagggcatctaatcttaacatctcttttcgacaggtcgagtgcttacgcacccatttaccatacagaacggggttattagccgcttcatactgtagtttagtctggtcgataatcaaatcattatccaattcatcctgtaattcttctaatctcattctatctccactctactgtttctttggaaggactagtcccattatactctactgctagagttagcattactacgcatctgtatgcgtatacgttctagcgtatcggggtcgtctactatagaaaactgcacggtgacaattatagcattatcgtcatataacggaagcacatcaactgatagacgattaatcctaggctcataattacgcacagcagagactatattacgctttatcgtatcaccagttaatggagtcatgttttcaaataattcgtttgtgatatcacaaccaaacgctgggtcaaatggccgagacccctttcttgtggttattattccaagaaggctgtttttaactgatcgagctcctactgtttttgacacgtcagtgtcccaagcaagtcgcatttctgggtcaaggtcagaatagagtttatcgatattgctcatgacataatcttaaagaattctttaagccccttaattacatgaatgtgagaaattccgcattcacaagtaatgggaactgccaattgaacctgtggcttcaatagcatatttttaatgttaactacatcttcggttgtaatagcagaatataaatcatcgatttctgcatcgtttaaatcattaaagtaaatctgctcatttccaaccacgatataatctatgcattttgatatcatcattggaatgtcggaatcgtcaaaaagattaggatacttgaactttatcttgaatccctttaagtcataccagaggtcttctggaggatcgatttgcgcatgtgtataatttaatggcacaggaattttacgcccacaggtgcaattccaggtcacctcatgattaacctcgcctatactatgcgcccaaagtataactataagtaattccgattcttgtttgtttaacccagtagcattagtacattctctgagcaatgctttaacacattcatcgattgtaccgtttttcttcgctgcaattaaattagcgtattcttctagtgtaaaagctcggcactggatattcttgccatttattcttgtttcaaatttatatgtgatgttcatatccactcctcttattcaattatttataaatagtataaagaggattaccttatggccaacatagttagatgcgaattaccagatggtgtccaacgttttaagccatttaccgtagaagattatagagaccttttattggttagaaacgacatgaacaccaagtctgaagaagaccaaaaacagcttatagcagaattaatggatgattattttcatgaccatcctgtcgagtatcgtccttatatatttcttaaagtatttttgtcaagtattggtaaaactaaaataccagtcagaatgaagtgcccaaaatgcggaaaatataagcagtatctttttaatcttaatcagcctccgttgacaaatccgaaagtagaggttgcaggattaacgcttaagttcaaaaaacctatagaaataattgatgatacaggtaaaatgattttagacaacattatatctgtgaaggattcatctggggaataccagtggaatgaattaagcgatagtaataaattgacagttatcgatgctatagatgttgaaaccttggaaaagattttatcgcagatgaagccgtttaactttgagctaaagacgtcatgctgtgataccacgacagtattaaaatatgataacattgttgatatctttaagctattgctacatcctgacgagattttcacattttaccaaattaaccatagattggtttctcaaggtaaatatgacttgaattctataatgaaaatgctgcctatcgaacgtggcataaccttatcgcttattgaaaaggaccttaaatcatgacagcacaaagattaggatatcctaatataagcataaaattatattctggatatgatgcgtggctagctaatagattcgttgaattagcagctacatttattacattaacaatgagagattcattacgcgggactaatgaaggtctgcttcagttttatgattcgaaaaatatgcacacgcgtatgaacggtgatgaactggttcaaatatctgttgcaaacagtaacacatcaagaacacaaactcgaatttacggaattaaacactttacagttggtgttgatgataaaggcgatagcattatcacccttcagcttggaacgctgcatgacataatgaatctcaagttcagtagagcgttttttagttctgcatatgaaactataaaagaaatgataggcgcgatgtatgttgaccaaccattgattgctcctcctatcaacggaattaacgcttacgtcccacgagttccatggactagtactctcaaagattacttacgatacgttagaaacgtaggcatttctactgataacgaccaatttatttttgcctgggaagatatcactgggattaacatgatggattatgaatcaatgatatcccaggacccaaatgtattcatgttcggggctcctcaaacaataggtcagtttgcagcaggattaaaatatccattagcatgggattttgaatggcttgttaagtcaaatagatataatagaaatcccatgaaaaacgcaacattttatgcacactcatttgttgacaaagatgttacccgaattattaatggagaaggccaaaacagcgtattcattaatagatcaggcggatattctgacatgatttttaggaatggctatgaagaagcactacgcatttctacgatggctcaatatgacgggtatgctcaaactaagtgttacggtaattttgaactaactccaggaatgaaaatcaactttgttgatttaaaggaccagttcagaactgacttttatatagatgaagttatccatgaaatatcaaataacacatctataactaacttatatatgttcacaaacggctctgcccttgaacctgtagatttgattaaggtgaaaaatgaacttaaacgtgattcttcctattaagaaaatagtaataaatgaaaagacgatatcaattccaaaactggggttaaagcaccataatctgatgaaagatgttaagggtccagatgaaaacatgaatcttcttttggattcaatttgtccaggattaacagcagccgaatctgatattgttgtattacatttattagcatttaacaacagaataaaagaaactgctgttaaagatgattttacctacgatttgaataaggtttacatttgccagcgattaactcaaaggttagatggtaaagaattcaaattcagagctcctcctcgttattccaaactaggttcagtagattcaattttgagcgaatttcttgaatcagtagatggaaaaccaatggatataaactttatgaagcttccagcttttgtgacaaagtgggctgatgacttagtaaacactatagccattgatggacctgaaggaccaatcaaaggcatgcttaacgtaatggaaatatttgaatgactaagaaatcagaaatgaattcaatgcgtagaagagttattgctgactcggctccacagaaaaaggctgagtctcaagctgatgctcagattaatacgctagaagatattggtcgtcgcttagacgaccaacaagcatctactgatttgatttcggatgtaatagaaactaaatcaaacgaaattatcaaatcggtagaagatgtttcagctggtgttgaattaactgctgaagcttcagaacgcacaacagatgctgtctctaaactaaatgataccgcatcgttaattaatgataagctcacgaaacttgccgacttgttatctaaaaagcatgatgttcagcaagatgtccaaaagactggtactggaacatcattagaaacgataacagaacaagtcccggatgctcctactcagcagccgctagaggaattactcgaaagacttattcctcctcaggatggcagacgtcctgacgcggatttctttcctagcacagaagagcaagaggaaaaagctgagcctaaaaaggaaactgaggacaagaataaaaagtttcttgacctaaaatttggagaattaattaaaagcgttaaatctggttttggaaaaactatttcattaacagataaaattagcagtatgctgtttagttatactgttagcgctttggcccaaatggcgaaaactgccgccatggttttgggtgtgataatgcttatagatttaattaaagttcattttaattattggactaaattattcgaaaagaactttgttgaatttaacaagcaagccaaagaatggggtccgctattaacagcaataagcgagatgtcgaatgaaatagtaaaatcattcgtcaagggagattggggcggattagctaaagccataggttctggcttggttgatgtaattgacaagctcggagaaactattatgctcggaatgagtaagcttcttgctggaatgttacgcgcattaggatttaacgattcggcagataacattgaaggcgctgctttagacagatttcaaactgttactggagcagaactcgatgaagaagatgctaaaatgagagcaaaatatgttgaccgtcaagaaagagaatatgacgaacaacctgaatggaaaagaaagctttctgctaagttccaaaaattcaccggtcagattgatgacgatgaatataacaaactgctgagcggagagaaaaagcagtcagcgtatgcagacttgccagaagaagaacgcctcaaaatcatcacagctcgtaataatgctgaagcagaaatgaagagaacaaaagcatatgttgaaaaaactgatgcatctgattccactcgattagactctgctaaggatgcagtacaaagcacaaccaccagatataaagaattggagaaattatctccagaagttgcaaaagatttaaaggttgaattagaccaattgcaaaagcttcttgattctaaaatatcagaacctgctccaactgccgaagctatacctgcagcagaacaacctgaggttaaacagtctgcttctattaaagccgccgcggatagtcgtgaagctgctcgtacacgtgaatctaatacacagtcgcaacctattcaggttaataccgctgtaaataagaatagcacatacgtttatagaacgcctccacagacttcgacagctgctcctggaatgcaaggcgctatgaaaacctcttaaggaaaaataatgatttttgaagaactggccgatggccttgaaaacatcaaaaaatcaggaactcgaatttcccaaggtaaatctaaactgacgaatgcgccaaccactaaggtggcgcagttcccagctgaacgttcagctgggaatgattccgcccaagatatgagagtacatgacttatatcgcaatgggttattattcacagcatatgattttaaaggaagaacaactcctgatttgcgttcatttagacgagatgtaatgttatcgtctgtattcgattcaccaatgtcagcattggctaattcatcaagctctaccactagtactgcaccagtagctaatattctattaccgcggtctaagtcagacgttgattcagttagccataaatttaatgatgttggggattctcttgttacgcgtggcggcggtactgctaccggtgtattaagcaacgtggcttctactgcggtgtttgggtcgatagagtctttaacgcagggattaatggccgataatggtgaacaaatttataacaccgctcgtagtatgtatgccggacctgacaatagaacgaaagtgtttacttgggatttaactcctaggtctgcagatgaccttatacaaattattcgcatctatgaaatttttaactactattcttacggtgtgacgggaaattcatcatacgcaaaagaagttaaagctgctattgatgaatggtataaaggaactcttaaatccgcagctccagatggggctaaagtagaaaacacagtgtttgagcaaataacatcgtttttaagcaatgttattgtagtttctaacccaacgatttggactgttcgtaattttggatattctacatcaatggatggtagagaggatatatttgggccatgccaaattcagagtatccgctttgataaaacgccgaacggacatttcaatggtttagcaattgctcctaaccttccaagcacgtttacgcttgaaattactatgcgtgaaatacttactcttaatagaggtaacgtttatatcggaggtattgaataatgtttactctcgaagaatttaagagtcaagctgctgatatcgatttccagagaactaatatgttctctgttgtattcgctactgtaccctctagtaaaacccaggctcttctaaacgactttggtggagagctgtataataatatgggtttagatggaaattggcttggattgacaccaggtgaattcaatcagggtataacaactatagtgacacaaggaactcggcaagttgttcgtaaatcaggtgtgaatacatttatgattggcgcaatgactcaacgtgtggtgcagtcattattaggagaatttacggtaggtacttatctgctcgatttctttaatatggcatttccaacagcaggattgatggtttattctgctaaaataccagagaacagattatcatatgaaatggataagttccataacgctcctaatataaaaatcacaggaagagatatggaaccgctggttctttcatttaggatggacccagaagcaagcaactaccgggcaatgcaagattgggtaaatgctgttgaagacccagtgactggtctgcgaggattgccacaagacgtagaatgtgatatccaagttaaccttcatgctagaaatggattacctcatactgtatgcttgttctcaggggctatgcctgtagcgtgtggagctcccgaatttacatatgatggagaaaacacgatagcagtgtttgatgtcacgtttgcatatcgtagcatgcaaacaggttcggttggaaaacaagctgctatggattggttggaagataaggctattcagaaaattgagacgattaatccaaatcagggcttgagtgcgtctgcttcaagattgtctcgtttaggcggggctggtggtggaatttctaatatcactactacaacaagtagaataatttaggggccgtaaggcccctttgttttatgcaatgcagccaataaaccctggctcagtgcgaagaagttccatttcgtctgtggtccaaactactttaacaggaatgataccttctgctttaccgtttagaaccgcttcgacaaacgatggttcagttggcttacggaagatatcttgaataagaaccgtcggagtaccttcgttaaacccttcaagcatgataagaacttcttcattgaacttctctgcatctttaacatcagcagaccattcaataccgttaaagcgaaatacgtgtttcatatcaatttcctcattggtttgtgtaagtctatagtatcacgtccttgtgataagtaaacaactttatgcaagtttttctgggataccatccaggttgatagcaccagccagtagctccatggtacgcgtgtagctaaccttatctgtagaacggtctggcgaaaagtaaatctcatttaaaaagcctttgaacttgctttcttcaagaggttccactttgccctgttccatcaagatgtcaccatcatagagatgaacggattcatcgatttgctctggaggaactaccgtcatttctaccatgaatgtcttgttattcgctacaccaactccatttctaaaaggagttccccataccttgttaactttcattgccaacccgcgaggaagaataacttcagcctcatcgctaaagcttgacaagacacccgggataactaccttaactttatcggccccatgaataacgaatccaaacttaaactcatcaccataggcaacttcctcgcctctatcaactctttccaagttgtctgttccaataacggaagatactgcatcaatagttgtttctttgttttctaaatcagaactaggtgcgtctggcattaatgaatcaccagcatttgaataagcaccaaagataattggacttaacgaagtagaaacatagttctggaaataaaacattttagactcaatgttatctttaaagtcttcatattttcctcgctgaccgcgatacaaaagagtgcctggttcaagacgcaaacctttttcaaaggcagaatcgagcggacgaattttcttgtcaataatcggatcgcctaagctttccataccaataagatagttattaacaaatgaataaccagaaccgcagtaatggtgtattgcatctctttcttcttcgcttaaacgagattgcatttcacggttatattcaattgctttggatatagaatcgccaacaattgacacataagcggatatcatataattgacaagattttggtattgacgtaaagctccgaaatcgtcagctggaggcatatcaaatccacgagtagctacttcaacgattttacgcattgtttccatagatgcaggatttttagcttgagcaataacgtcagcaacgtctgaaattcgttgttcagcgattttcattttgtctgaacccgaaggaatgaaaaccttccagtcgtcatgcattctagacatttggcctacaaataatctctcaactgcatcgccaaaattacttccatatccgccacgaacacgatagtgcttgatatcatcaacataaaaaggaattgatttttctaatccggctttgatatctttttggaggtctaccgtatcgccttctgcgtttagtactggagtgttagtagttaattcgtaccagcgttcacgtttattttctggccaatcttcatcaacatatgaaacaaatttgccgtactgtgctcggattaaatcttttcgagacactttcattttactcattacagcgagttcagatttcttgtcttctttttcgccaatggaattagccaatgcttcggctttggtaacgttttcgccggtttctttagacacataaacttcgcctactttggaatctactttggtgtaaagttcttctgaaatttcaggaattccttcaatctcttcaagtttcttacctttacgaaccataatagaataagcatacttacctttgtagtaagccatatctttcattagattgaaacgaccgccggtgcgagtagtaatcaaccgagcaagaatgcgttgaatagctttatcctgtccttgcattttcttcggattaaagcggaacattaccgcatcagctttaatttgcttaactactttgttgacggtctcaaaaatggtattgatagcaccaatcgggtcttggcctaaaccacctttaagcgcgccgatgttgcctttttccgacacagagaaaacatagacctggatgaatttatcacccatcttgatgttcttaactgcatcaccttgacctgacccttgtactaaccgaatcattaaattgttattacccggcaccttaatcaaaaagacctgtggtaccttaagttttggcttaacgttctcgacgggatagattttactattctcttcatcgaaaacttcatttaaaagttccatgacatatcctcgtttgtttattctatttatacgaaaaaaggcccgaaggccttaattaattattgttactgtacgccaaacttgtagtccatttacagactcatactcttcaatgttttctttgaagtttcttaatgtgttaatgttattaaactcaagaacttctgtgtgaacagaaataccaccacgtccgtcaagagatttagcaatcacttcgtataaaactttcattttattcctgttgcctcagtaaagttaacaccaaacgcggcttcgaatgtattagccacttctttatcatatctacgctgtttaatgataggtaagaataatcctactgtaccatcatcacgaccttcagcagttacccatccattgcattcaagttcccagatagttcccggaagagaatctctgagcttccataaatgagtacggtcaagttcatgtaattcttcgggcttatctttaagacctgacccagcgttaacacgaatacgaccacattctgatacgaacattaagccgcccattttaccaggttgttttctatgctcgtacgaaccgacacatttcaaatctacggtgataacctctttaaatttaacgaggttcttagaacgcttatcttcccaataagcaccgatattcttaaggataataccttcgagaccttggtctacgtatgtcttatagatagcccgagcttcatggatgttatgtacgacacggttttcaattagaataaccttgtcatagcctttgctcatcatttccaatgcacggaagcgtacatcataagcaaatccaggaactttaccttcggaatatactacatcaagcggaacataatcccaaacttggaatctcataccttccgcttcttcagcagagattgttcctttgattgctttattagccaatccgtttgattctgtacgagccgtctgttggaattccttagccttacttagctcaggaagctcaggctctttaaacatatcaaacaggtcgttttcttcttctttcacttcgacatgatataccaactcgccgtcaatcatcacaccattaggatggcgttctcgggcttctttggtcatctcgataagttgacgcttaagtttatctagacccaggtattcattaccggaacgagtaagaagagttacatcatctaaatcatctccgcggatttcagcgaagcaccgggctccatcggctttaagctgagcgaatgcaggaaatttaatatatgatagcgctttctcagaataagctgatgctaacatctgtggcatctcaggaattaatttcttccataccttgttagcaatagaacctgaagcgccgcaacgcatatccttaagaaggacacggaccagtacactagcatcaccctcgttcatcttagagagcaaatctactagcccctggattgccatattaccagtaagtactcgtgctgccagaatgtcttggaggtaatctagaccatcagaaaacgtctttgaaggaacatttggatatttaacgggagtatattctggaactttcttaataaagaatttaaatcgcccggaatacgccagcagataagctcgttttaaatcaacgttatctttattgtcaataagaatttgggttttagctttagaacccttagcatcttcaattgctttgatgatatcaaaaatcattattcacctaattcttctgaaagttcgcttacgctacgatgataagttaatccatcgatataaacaaacccgttattgatgcattcattccaaatcgggcacgcctttgcttcacgccaaattggattccaacgataaaactgattaacatgaccgtaatcacatgataaccaacgtttacccaccttagtatgaactacaaacattattcctccttgggtatggtcattataccatacccagattgttagcaattaatttggtggttatcacatgtaatacgaccgttattccaccagtcgtttccaggaggaacatgcggaccaggactaaacggaatgataggttgtttccaccaatctcctggaacttgtcgtggaggccaattaaaaggatgttgctctttacgaatttggtctttgatagcttcttcccacaatccagaaagagacttctgcggtttcttaacggatttcagagattccaggcaagttacaatttgatgccaatcttcaaccataattccaggagcagtcactgaaccttctcgctcaccacgaggcatataaaacacacgagtttcagtgtcttcaaatactttgctggccgcagcaatatgtttaggcaaatcatctacatagcagacgatgcgatcgccgtattttactttagccttttccagtaaagcatctttagattcatcataatcgcagaccatgatttctgtaaatgcatcagggaacaaagcatttagattgaaacgacgattaaggttagcatctactgagttaccaagagccgtgatagcgacaaaatcgtatttttctttgagcttattaactgtagctaaagcatcagcatacggagcaagataacgaataaaatcgctgttgttgtacttcagaagcagcttaacagccagttcttcttcacaatcaaacagctcagcgggtttaatgaatttttcagtagtcatcatatcaaggatatgctctaccggaagattatatttttgggcaaaataaggcagaccactttgccacttaacgatgattccatcaacatcggttgcgattactggctttgacattcggggaaattcctcaatgcttgtttaaatttggcaacgctatttgcggcaccggtgaaattgaaccagattaaccctggagcgtccgcgggttctatatcaattatttctatattataatactcagcagtctttagcatttccctggtgatacgtcgggcaaccatatgaccgaagtgaggattaatagacatcgtcgttagcagcccttaattgagtaattggataaagctcggattctgcatggattgaacgattgccatcaacccaattaacttcataccacggttcaactgagtaggctttaatggctggagccgtatcacatacaactccaggaattccatttgctaatcttactgtactgaagatatgatatttcatgcatcaagtctcactgcccattcaggcaattcaaagaaatccggagcatcaatttcatactcaacggtgtgttgtttaacgttagctgacatgatatcaaccattgggtggtttttcaaactgcaagaaaaaataccagctttaggtttaggcacggatacaatcatgttgatttcctcaaaatttagttatgaatttttctttcggcattttagcatttgagccatcactgtcagaatacccaattggcatagttgcattaatgaattcaattttagcatttataacattaatgctcagagaatctacaccgtcaatcatacgaaattcaggagggcaatacttatcaatgtatgctttcacaccatttttattagcaggtgtaccatcgcgggtatcgctgataatggtttcaacttttttctttcgtgaatcatagaaagctgatacaatcatttcaatttcctcttaaaacgggcgaatattaacgtgaaccacagggacagcaaaaggttgcatgattacaacttttgtgtctttagttgcattcaggcgttgtacttttgcaagattaacagcttcttcctttgtcaatccacctttgtaggtatcatttcctttatttgaggtccaaacaccccaatcattgcttccatcgtcggtcttcggttcaagttctttgtagatggtttcttcaaaataatgctgaaattcttgattagtaataatacaccacatgtgagaaaagcgaacttcatctacactaacgcgtttgcattctccatctggcttaatgatttcaaattcaactaatccggtattttccgcatatttaaaggttctggtaattttaattggattattaccgatttgctcaaaaacacccttgataagagcgcctggagacaagcttggagtctttttaagcttatagaatttacctttttccattatcatttcctcaatagtggggccgaagccccgagttagttaaaacttgatttcgtttgaaacgatatcccagattgcttcacgttgttcttcggttgttttacgaccgaggatgtggcgcagataaattttaacaagcagctgacgatttgtgttccaagacggatgtgaagataaatcacgtttacgaacttcatcatgaaatccaactttgatttcagaaccgttgaactgaatatccagagtaggaccattttcaaagctaaagaatacgtagttatcttcccagtacatatcgatttgagctactgtgccgttgttgtgttcccacagcaaagtagtagaaacgtcccaagcattgttctgtacgtatttgcggttgaagttagtgaagttcatttttattctccgtagtttgtttatctgtttgggtggtacaggtctatagtaacccagaccacccaagaagtaaacaacttttattcaaaaacttcagacatttttcacctctacagtttttacagtttttacttctgcaaatccgatgcttttaaacagttcatacttggtagtttctggaacgatatcggttagctcaaggatgatttcttttgcttcttccagagtaaagatgcttcttccgtccttaacgaccggtgctggtttaatagcagctgatacttcaaaaaccacgtagcggtcagtagtactttgattttcaaacgctcctatttgcacaacccgtccttcttctaactcgtgagaagaaaataagcatgacagagaccggtcatattcatctcctatggtttttgccgaaatgattttaccagtttcggttttaatcttaacaacccggcccagcgaatcaagttctaatggcgtccagccttgaactccaacaacggtggcaatgagatagttaattgtgttcttagcgtctttccatctacggtaagtttctggggaaatgcaatatactcggtttttgctgtaattcattttgatatcctcaaagatggggccgaagccccagtcaagattactgtttagtccaattatccatgtttaatttaccaacctttttcatttgttcaattaaagcatcggcacgattacgaccattttcataccaggttacatcttctgagtaaccgtcttcttcatctgtgtaggtttcagaacgaatacgaccaacaactggagtgttcagaacatatacagaacccgtgaaccagtttgttaaagtgatatgccagcagaaatcatctgatggaccgtccggtgtcatgcatggaacgatatcaccttgaactttagacaaaatccacattttctcatggacagtttgagctttgtaaccgtcatggtctttagtcttgatagttgcgttcaggttgatggtattcattttattctccgttgtccgtttgggtggtacaggtctatagtaaccttgttgaacttagaagtaaacaacttttttcattctgcggaaaataaaaaagggactcccgaaggagtccctgaacttatgctttcggcttaccaaaacgagaagcatcatcgcgaagaaccgcacgagcccgacgcatgattttctcaaccgtctgattgatacgcttgttcgacccacgcttgtagccagcgcgtttagaggtaccaacaacttcttttactgcagtttttgctttagcttgtttagccattttatcatcttccattttggagaaatacatgggagcacgttcttccgaggttcaacttctttcgacagttctttcggttgtagctcccgcaagccctcaagggggtacgtttaaactcttatctgttgcacaccgttagcttaaaggttccgggtccgatttatcggggataagatatacaccgatggatgtataggccttgaggcgtactcccgattggccatcgcctcggggtagcatgcacttgccgtttattttctagctgcactttggtagcaaatcaccgttggtttcgggtgttttacgtggggataaccaacaacgtccacatcatacgttacccatgcgtacacatggtgggcgtacaaattacttcagcgttaccacaaagtggcgaacagctttgcgagcagcagaaccaagatgcttagcatacttcagttcgtccatcgcttctaaagtatcacgaaattcagcttgtgctgggttcaggtgtttaaaccctttcagaacttccagtgcttctgcatagatatcgattgaagcaccgtagttttcgtgaccggaattccatgcattacgttggagttccagagctttagtaagttgtttgttcattgaatcgttcctcaaatgaggttaaaatttggtggacggtaaccgaggtttagctcgggcatccaccgcgtagaattgctcgggtaactaattgtccgacgcccaattcatattattatttatatacgcatgcaagggacttataatgacaagtcacaaacttctgccgaatttctttgggtttcttcacacctgctgctactaacggatgaggtacgtttctgatattaccaacaggcagtggagtcaaatcaccgacttcaacaaatcctttcggtacatcatcaccgatagaatagatttcacacatatccggcagttgtccttgttcttcttttccaagaataataccggaaggagaaacaatttcatcaccttgctgagcaggttcagatacgagaattacatactcgcctagagctttaattggaagttccatgtgttacctttattgtttgaccatgtagttatattaacatggtcagtttaaagcaaattacttaccgatcatctgcagcagatgctcaactttcataccatttaccgagataagtttatcaaaggtaaatgagcgccaaccttctttctcagtatcatataccggaagtgaagtagtgctttctgctcgggcagatttaatagtgctttctaccaaatcagatggaataatatctttatcacgagtacagcgcagagtacgaatagtgccatcagctttttcaaacacaatctgggattcgcccatgctcagcacagccttcagagtttcacgaatatggatgttttgttcagtagtcagtttcattttgatgtctctttaatagttttgataattacagatttgcgcttggataattcttttaataatcgaactgcttgatcttcaaatttaaatgttgctaatggtttccatttaaaccaataccggcgttctactgagtatgatataacaacatcaccacttaggttaagtttattaatttcaacaattctaagtttcattattcaattccacagaattctttaatgttataccaattcaacttatccaaattacgttttggaacattgaacacctcgattccagcagaacgaagaatatcgtcccaaccgggttcgttcttgtcgtatgtttcgcagtatactaattttttaataccagactgagcgatggcttttgcacaatctggacatggagacagtgtgacatacattgttgctccatcaatactactgccgttccgggcagcaaaaagaatagcattaagctcagcatggatttcattgactttagaccatgcagagtgggctgctcgatgttctttgagcaatccgacttttttgacttggaatccgtcttgacgcaatcctgtagatttgtaaggaatttcaccaatccaaccttgttctgctgcatggtcacaacagttcacaccaccagaaggtgaaccgttatagccagtagaaataattcgtccgttcttttcaattactgcgccgactttccacgagcagcattttgactcttgagatacgagatacgcaatttgtagtaccgtcgacgctttcatttaaatcaccagataagttgtgttatttgttttaaccaattttaactcgtcagtaggagaagcaaaactctctactcgagaagtacgaatgcctgtaccatctggaaacggatgattccctcgttcaagaacatcggaaaagacataaccataaagaggttggccttccttaacattaacgttactgtacaaaatagcatcatattcttcgcgtggaattgaccaaacaccttggtcagaaccaataacagcactgatcagccgaatgccatttgggctgatttctgctttaatgccacgagcatgttcaattaaaagagcttctaccgcttcacgtaaagtcattagatatgtcctaaaatgttagtcatttcaacttggcctgttccggttaaagccaattgagtgtgttgattgctctttccattattaactgtaatgatataagcatcaacatagttaaaggatgactctcgtcggagagtcactttacttccaggaacccggtttgctacttcctgtgcgaagattttaaccttcgaaataaattcatcatgcgaaaatttagcgtcagacaacataagtctcaacctgttgggtttcaaaattagcaataattccaacgataaaccagtcgtgttcaccttcgccgcaagaaattttaatttcagacgaaccgcctgaccggtcaatagaaaatttaataacttcgccgtttggaataagtgcattcattgcagataaaaactctgcatgcattttggctacttcagatggagtaaactcatctgttaaatgattagcaacaacttgcgtaaatgatacttttactacttcggaatactttggaaacattatactttcctctaaaaatcaccgtgggctacttgccagcattcaacaccgatacgacgccacatttcaactacctgcgccctgtcatctactgcaagtttgacattataacgatcagcaattcggtcccagaagatttcttcttttaccacatcgtctttgcgtgaatcgccttgcttacgttggaagtgttcgcctgtttcgccaacatggtccaacaaccatttcttcgtaatgcgttgataaacagtagggtcttctttagtaccagactctctgccggaaacagtaagaattttatatcctttgttacgaagcattttaagaaattcaattaccatttcctttggatggtctttaccacatttggccaagtcataaggagaacgatgattgttatctgctaacgtgccatcaaggtcaaagataactgcttttggcaatgattcatctggaatgtacaaatcatacggatgcatcttagagtagaagctacggagcacttcaataggaactgcattcgcgccacgatagaggttacgcttaactagttcagtccaaggaacgtcaaagcgtttaatttcccacttgacaccatcaatttcatatgccaactcttgccacttcttgatagtcgttggattaaggttagtatcagcaatgatgacacctttagtggtttccatctcgagtagagtcttcgccatagaaaactggcatacagatacagacttctcacgaagcttagaatatttgtaatcattacgtttatcaaggccaaagatgccttcacgcaaatcatcacgagacaaaacataccaaccgggattagctgctacgtattcgttagcccaggttgttttaccagagcctggagccccttgtgtcaaaaccaattttttcattatacatccttaagagtgtcaataaaatcatgaagagccttagacttttcaccccaatttgcacgatatttttctttaattgctcgcaatggcttattcattgacagtatatcatttttgtcataattttcagctgcgcgtccaaacacgatgcacgccaattcattttcagcaattaaccctttaagtgtttcatactgttctcggttcattataataccatcacttaacgcaacgaggttctttaaggtcagaacgataataacatatcattccgttagcatctttagtataacgtaaaatgtcattcatccagatgcgatactcttgagactcttcaaacggcataccaacccaggctttaccgtcaattacttttacttcccaatgtccttcccatttttgaattgggtctggccactcaggatgcaaaaccgggacatccggtgcactagaagaacatccaacaagtaggctgataatacccatggctaatagacttcgtttcatctggtagcctcctggatatcttctgcaaacttattgaagcttgcattaatctgtttttcaactaacccaggtttagctgcaactacgtttccacgcttagcatctttattcattttagcgttggaagtatcacgagctgctcggttttcctgatagcctttataggttgtctgcagattttttatagaaacaccgatattttctatttcttttgcttgtcgatcagattcatcttggacgactttgaggtcagctttaagattttctacccgccacgaaagatatttcaatccaccgacggataatgctaacacaccaatcatcaaccaagttgtgtttattttgagcatagtttaaggataacctctacgatatcatcacgggataatcccgaaatgaggatgtgacgatcagaactttccgaaggagaacacttgaagcaagcttctacatattctgccatctcagaataattcagctcgcgatgcataatgccaagacgatgtttgccataaatcgggtcaacgattacatagcatttgcatccgttggcatgaacgtttggttgagtgatgtttttaaacacctctgcaccatacttcgcgagatgattatctaggaaatcaatcatttcatctacggcttcaggcaaggcttcggcacgctgctcgttcacacgattagtgtactctttttgcttcttacgagcagcttccttgcgtgccatatgcgttcgtaggtcagtgacgaatcccactttcttggtgccattccacacaaaatcccgtcagaatgagtaccatatttgttaacaaccatatctaaagtaattgcttgcatatccatttcattatcctcatcagttggtgtaagtctatagtatcacaccttgatgaggatgtaaacaactattcttcagaaatttcaatttctttttcgtactcttttggaacatatccagcccagtacttcaagaacactttttcgaggtctttaagcagtttatcaacatctacagttccttcgtacatgttcatgataacaccaaaaagatgacgctgattaaccgtggctttctgcgcagcaatagcgtagtctttacgagcacgacctctgtattcatcatagaatgactgacatagctcaagtgactttccgaggtaatctagataagcttgctcaaacgcagaaattttcttaattgcgtattcatctccagcaaaaagagaacgcaaatcatcggaatttgcagatacgacagacgcaaacagtctttcatttgacgttattgagtctttagtgtgatgaagagccgagtaccattcggttttaaccttaaatctctgcccagtgtttagaactgcaatgtatccttctacgccttcaagtgcacgaacaccttcaacccaagtgtcggggtcagaaattccataagcattaattaaataaggacgaattttagcattagcgtacaaatcgtcatatttaacatactcgccggttgcgttatcacggacgtttaacacaaacagctgtggctcctggtatgcaagaacaacacgattatcaggtgaaacaaattccatgtttacagtatatccatctagtgctagttcaagaacaacttgatgaagcgaagagtattcttcactattaagcagggcagaagaccttctcgcctggtcactgtagagagatgtttttgacttaaggtatagatacccatcatcaacataagatgatactagagagccatcagccttatccataatgtattctacatcgctaatatcaattcccatcgttaatgggttttcattcaaattaaagaatttttccattggacgagaagcaattcgaattggagtatcaccatccatttcaaacatgatgccccggcactcaagagcatctggttttaaccactcgctgtagcttgcatagtgatatgaaaacactctgaacttaccatccataggaccggtaaaatctttataaaagaattttgcaacttctgagctttcacacagattcattaaatttttatatagctctaacatttctttaccttatgtttgcaattatcgtagtgccatctgatagcaatggcctttgaagttattataccacaatgcgggcatggactgtacaaaggctttttctttcctttttggctttctgaccgcttgagtttagtttcttcagattgtgttttaccggttaaagattttgatatcttttcgcgtgtttctttggcatgagtctttccttgagtgggacttactctgcctttcagtgctttagataaattctttctatgttcttccgttcgtttctttccggagaataagttagatgtataattagaatgctttattctagagctttcataaaatctggaatgaactttaaaattctttccagaagaattacacatcatccaaagagcataattcattttagaattattatgtatctttgataatagcaaatgggcaatgaaatgttcacgtccagtcaataaaactaaattagaaacatcgtcatttcctcctaatgattttggaatgatatgatgagcttcagtataatagtttaattttcctttatcattgcctcgtaatttaccctttgctattaggttatcatatactttaacatagttcatttagctttgttagtatgttgtgtgttccatggaggattgaacttcttaatcagaagaggttcttccaagtccatagtggatattgacatctcgccaagttcattattaatcgaaagattaaaacactgacgagcatagaactctacttttttgccagccattagtgcttcaaaaatcttggcagatttagctgaatcagaggtttggtctttccgattaatagcagttctataataatttatacgtttacgaagattttttgtcttaccaatgtaaaccagctcatcatcaactgcgatggcataaactacgttcaacttgtttgctatcagaattggtttgatggtaaaatctggttctaactcaagttgaacatattttataaaagaaaactcgttagcaatatcattcataataaagaggggccgaagcccctttccttataagtactttttaaatccaattagaacatcatcagtgacatcattgtcaatctgagctaccagataagaacttatctcaacttcctgaggagcagattggactgcatcagagttaagatattcacgaatccagggaataggatgtcgagttggtgcgtcagtgattgggcacggcagaccacagctacgcatgcgagatactgttaagtagtcaatgaagtcatgaagaattttaacgttcagacccggaagaccaccattacggaaaagatggatagcccaatctttttcttggcggttaacttccatgaagattttaattgcttcttgttcacactctttagcaatctcaacccattcttcgccatcagtgccagtttgaagttgacgcagaatgtactgtgtgcccttcagatgaagttgttcatcacgagcaatgaacttcatgattttagcattaccttccatgatttccatatttttatggaagttgaaggtacacgcaaaactaacatagaaacgaatagcttctaatgcgttaataacatgtaagcaaagataaagagatttcattaaatcgcgtttagcttctttaatttcgatattatcttgattaaagcagcgatttttggcattttcccatgcgcgagtcttcgctataacatcatcatagtaaacaccaattgactcagcgcgtttcatgattgcttcgtcaagaacgatttcatcaaagattttagctgggtctacataaaggttacgcatgatatgcgtgtacgaacggctgtgaatggtttcactgaacgtccaagtctggttccaagtatctaggcttgggtcagaaataagtgcagataaaactgctgctggagctcgtccttgaattgaatcaagaagagattggtacttcaagttatcagtgaagatattacgctgatgttctgggagtttttcaaactgaccacggtccatcataacgttaacttcttcaggacgccaaaagaaactcaattgcttctcaatgagttcctcgaatactttatgacgctgaatatcatagcgtgcaattcctagaccagaaccaaagaacatcggttcggtcatgatatctacttgcttggtattaaaaactgtactcattctatttcctattctgtggtgttaaccatccgtggtctaattataattcccttttattaaagcttacaggccgcgcagtcagcagagtcttgaatcatatcatcgttaccggaaccgtcacgggtgttatgatagtaaagagtcttaccgccaaagtaccagaaataaagcaagtcgtccatcattaccgacatttcaacttttcctttagggaaattcgccgggtcgtaataagtattagcagagatgctttggtctacaaatttctgcataatcagaacctggttcagataaggcttattaccctgtttcgcgagctgccaggcataatcataaagggaagcattgtgctcaacatttggaacgacttggttgaagcttccttcttttgattctttaactgacactggtccacgtggtggttcaataccgttggtagagtttgatacctggctagacgattcgcatggcataagcgcagataacgttgaatttcggataccgtatcgcttgagatcttctcgcaggagttcccagtcacagacatagtttggagctgcgagttggtcaattctttcgttgtaccagtcaataggcagttcaccacgtccgtatcgtgtttctttgtaaagcgtgcatggacctttttcgctagcaagtttaacagaggctttgatgagtgcatattgaatacgttccatcatttcgtgagtaatatcattagcatctgcgtatgaagcaaagttgcttgctaaccaagctgcatagttagtaatgccaacacctagtgctcgacggtctttagcttttaacgctttgtctacaggatagtcttggtaatccaaaaggttatccaaagcccttaccattacttctgcgatttcgttgacttcttcttggtcttgccagttgaagttgtcgagtacgaatgctgcgagtgtgcatagcgcgatttcgccatcttcttggccaacatccgaagttggtaacgcaatttcgaggcagaggtttgattgcttaaccgtagccacatcacgaataaaaggaccatattcaccaacgttatctaccatgtacgggtaaattcgagcagtaccagcacgttcagtaaggaacaactcaaacagttcacgagctttaatacgtttctttcttacgtctgggttcttttccagctcttcgtataaagtacggaacgcttgtgcatcacggaagtattctgtgtacagcgtgccaagacatacatcgggactgaacaatgtgatgtaatcattcttaatcaaacgttcaatcatcaggttattaatctgaacaccataatctaaatgacgaatacggttttcatctacacctttgttgttcttaagtacgaggaggttttcaacttccaagtgccagattggatagtacagtgtcgccgcgccaccacggactccaccttgggagcaggatttaactgctgtttggaagtgcttccagaaaggaataactccagtatgtttgacttcaccgaatccaatttttgaaccctctgcgcgaatcatgcctgcattaataccaatacctgcacgcttactgatgtatttcgtaattgatgcagcagcttcgttaattgaattaagactatcaccaccttcaataaccacgcatgaactaaactgacgtgtcggagtacgaacaccagacataattggcgttggcaatgaaatctttttagtagaaactgcatcatagaaacgaataacgtttgctaaacgattttcgccatcatcttggtgcaagcacataccgatcaacataaaggcaaactgtggagtttcatacaattcaccagtgtgacggtcttttacgagatacttctcgataagctgcattgttccagcataagtcatagtgaaatcacgctcatgcttaatataagaatcaagcaaagtaatttcttctgctgaccatttacttagaatttctttatcgtacttatttgcgttgacgcatcgggaaatgtggtcaataaatgcaggtggctcaaactgtccataaacacgcttacggatttcaaacatagctgcattagacgccacatattggtaatccggttcatcaatagaaatgctattcgccgctaccttaacgatagtcttttggatatctgcagtgctcatgccatcacgtagatgggatttaataatttcatataactcgtatgggtctactttggttccttcgcacgcccattcgaggactttaatgattttctgcatgtcaaattcttgactaacacctgagctcttaattacttgcataagtcctctaattcaaatgtatctttaaaaagtttattcactacaagagctattatatcaccatggcaagaaagcggtttgcaggtgcatcctaatctcattcctcttaaagtttctaagtgctctcgctttatttctccgttccgaatcttagcaataaaatcgtccttaaatgccgcaatagcatcaggacgattatcgcaatctttaccgacgtaatttccccacattgttccacgttggatatttacatcgaagtcggaatggtatttattaaccacccgacatatcttcatgttatatcaacttcaaaccagcagattaattgtgttttgccaatagaccattcatatgatttaatgacagataaaacgcgttgttcgatcccgtcaaaaactatcttgtcattaacttcaggcaaatcactagagaatgcatcacacatctcgcctaatattgtttgtcctttacgaacaaatcgaatattcatatagccattttccccttaattgttggatgggatttatatccttcaagaacaaagtcagatggtttcatcattcctgtaacccaagctaattgttcttctgttgctaattcatgaaattctttatcttttactggaggccaataattaatttcaagttcacacagctcttttggcctctcactgttcaatatggttcagataaatgtgagtgttaccaccagtgaataccaaatgcccaggtttaagattggtcattttagcaatgatatgaaccaatgctgcatatgacgcaatattgaaggggaggccaaggaatacatctacagaacgttgataccactggaggtccaaatatcctttacgaacgttgaactgataaagcagatggcacggtggtaatgccattttgtccaaatcaaccgggttccaagcggtcacaatctggcgacggtcagttggcaattgcttgatacggtcaatgaccaattttagttggtcaacgcccatgaaatcacgccactgctttccatacacgggtcctaactcaccaccagaataccccatgtcttttgcctggttttcataattgtcgtcccagacagttttaccttctagtaatgaaccatgctgaataagacgcaattcatgaacattagtagacccctgcaagaaccaaagaagctctgcaatacatgctttccatgcaagacgcttagtagttacagcaggaaaccctttttgtaaatcaaaacgtaactgagtaccaaacttcgcaatagtgccggtaccagttcggtcatccgtctcataaccgttttcaaaaatgtctttaattaattcttggtattcacgcattaaatttttcctgaagaggagtaaagaaaagctgatcaccacgcttttcaaatcgcccaataatagacactacatcatctttgaccatcacattgccatgtgacattccgatgaacatcttcttataatcacgttcaatttcaataggtatatttccatttcggttatatactgtagttgaaccgttataagtgctaagaccattataactgaaaactagaagatgaataccatgcttaaatggaaatcttttccacctcttttggactttgtcttctgatagctgagtgatatcatagtttgcgctcatagaccacctctgaaatgttagtcacttcatcaatatgataccagtgattttctttagtaatgaatcctgattctggccaagtaggagctgctacaaattcagcaggtagagtgacatcagaattcactctatgactttttctgatggttgtttggataaccctatctgcatatggatatgccttctggatgattccggcaccacctatgatagaataattaaggtctctattaaaagtgatagtactgttgtaagaagtatgagcggccataatgtcaccacccaagaaaccgataaattctaattcacttacataagcatctgcaaagaagccatttttagcagttgccaacgcacgactcatgtcttggacaacgattgtcttacgaccaggaagaggtttaggaaaactcataaaagtctttgctccgcaaatcaagatagtatctcgagtacgattagcaaagtttttcatgtcctgggaaatatgtttccatggaagaccatcgcctaaaccgaaagcattttcgtttttgccgtctacggtttttgtaggagcaaatgcataaactatttgaatcatttaaacctcagcaaaattcaactcgttcaacattaccatcttcccacttctgttgaagctcttggagacgtttgatagcgctatcgatattggacattgcacagatagttacccattcacggccatcccaccaaatcaaatcatcgtaatcatctactgcgaaattttccattaaccttgcctcattccacacttaaaacaccggccacctaattgccataggctaccgccgcagtacttacaatcccagtcagttaaaatccacatgacttgtacccactagctttaatcatgttctgaagagttttaaacccttctttaatggcttctgaaatttcctcaaatacttcctttttaagaatatacaacgaacccgcttgattgccagaaagagctgaaatcacaacttggtcattaattaaaaattcgccatatgctgaatcaattttacctgaaacctgattgcctcgggaatgagggtcaaatacgagctcaatatgagttactccaggaatttcatcaaattggcagcgaatgttaacacgcggatatcccgttacactaaatttagacatataaaaataatcctaatataatgccgctaataaaagcggcagtaacagaaattagcaaaactactaattcagcctcaatcatttcttggccttagcaagtttaaatgcttttttgaattcttcaacatcttcaacaggaatccaaaagcctgagccatacccatcttcatagcatgggcagttatcacagtaatcattccaatagacagtttcaccacccatagtgaatggagcttccatttggcacagtacttcttcaacacgctctaattcttctgggtttttatcgcaaatgcagaaattccatttaccacgatattcagaaccaagtttgatgctttgacgttgaagtttcatttttattctccagtagattatggagctatactatcacaagcatagctccttgtaaactactttttgaaaacttttttgatcaagtcaatcatttcttctgcattttctggggtaacgatcaagtccaagcgagtaggaccaggttggattgcactaccattttcatataccggttcgaagtatttgaattcataatcagagatttcaaagtatgcgtctccaaatccttcagcgtcagcagttgttccatctttaaattttacttctgtgatgaaactattatcttcgtcgagcattttagtaggaaagaacgaaccaccatgctcttcaatcatcaagcgcatccggcgatttccgctagatgaaaggtcccactcggcagcaagacttgggataatgcgatattctgtgttcagtttcataatttacccgctaaaagtcgttaatgtatcttcacggcattcatcatccatgccaggaaaatattcttgttcaagccataaccatagtgtaggagtatcaccttctaccgtgatttcgtttcctccccatggggcagatttgttactaacttcaatcaaaccgtatttttcaatggtttcaatgaagtgttcataatcatatatttctacagtaacctgtgccattatcatttcctcaaagtggggaccgaagtcccccaaaggtaattattcttgccagtcttccatcatccaatcgatatcgtcccattcgttggcttctaaccaagcacgaaccgcttctttagaaccacggaggtcaatatttggccaaccgccaccagggccttctttaataactaaatcaaaatcaataccatggtcagtgtcataaaaacgtgaaccatcttcaaaaatcaaatcagtacaaaatcctgatttattgatgtaaggttctgccacgatatcaatgtttaatttacccatgatgttttcctctactcgttttgtttcgatgtagatatagtatcactcatcaactggcttgtaaacaactttgtgaaaatatttttgtagggataaagaaaaagggacccgaaggtccctttatattagaggtcgttcaaaatatcattcagatcgtcatcgccaacactgtcaccagcatcgcccattatatcgtctgcggaacgagaagaggtcggtttggattcaaaatcagacaggtctttgtcaaaggaatccaggtcatcaccaattttatcggcttgagctgctgcttttgccgcggcaccaccaagagctgctgtacccataatctgtttaaatttggcttcgttaacttcaaacgatttaaactgagatggagcaacaatttcgctgaggtcagccatattttcggtcaggaatttctgagtttcttcatcattgatgtttgcaatctcggactgaccaaggaatttacattcatcatagttctggaaaccaccgactttcttaactttcatgacgaagtttgcaccttcatacacacaagttacatcaaccggagtttcacccatatcaacatcgacttcaaccatcgcgttgattttgtccataattttctgaccgaaacggaatttgaatactttaccttcgttttctgggttagccgggtctttaataaccaggatgttagaccagaaagaagttttacgtttcagaagcttatattcagctgggttgctgttataagaatcgtttttactcagatgagcacaaaccgggcaagaatcaaaatcgccgtgggtagaagtacaattttcaatgtaccatttaccgccgtgtttgaaaccgtgattgatcagttttacaaacggcagagagttttcatctttaccaggcaggaagcgaattactgcttgaccattaccagcattatcggtcttcagtttccattcgtttttatcttcattagagaaagaagaaccacctttcagaccggccagttgctgttgaagttgagcaggattttttcttttgaacatgatttattttaccttgattttatttagacagttatttgtgtgacgcgctattgcatttacagaaatacttttcccgcacactggacagttttttctgggcattgttttacctttcatgccgcaaggatgaggttgtgtttgatgtcgtttcttagcaccatcactccaagtttttagaacttgtttacctcttgtattatttattctatcaccattttcataatagcgatgcaatccatttgaaattaatttcttatgctcttctgtctttggaacatctgttaagagttctgatattcttttacaatgatgttcagaatttttctttccaaatctaggagcattttcaccagaaccaccaaatttaccggaagcagtagataaattataaaatagttctgatttagcaacatcataatgtttatgataaaattcttcttcgtcaagagcgttatcacatacatgtagtattttaacatcgggtttttgaagcgaaattgcgttcaaaaatctttcttgttcacatgacgaccaatactcaatatttctgttgtcaaaaataacaccattgacaaaggtgcaatcatgttttgacccaatataatagtaaggtggagttttattctttaccctatcagtaaaggtaaaccaatatacgatattcattggataattatatactaatttctttacaagatttgattatgctaataaagagtttcttagcttcagcaccgtcaacgtttaaaagttttttataagcttttaatttagtagagtaattactccaaactaagttatccgttgcagtatcatgtgtatttattatatctaaaaacgagtcaagcatgatgaatgtctcgaaagatataacgtttgactgcagaagtttgaacacataagatgttccgactttctcattatattcaaaaatatcatgaagcttatctacattaactttcttggcaaaatagtaaatgttctttacatcttccgagaacgttgttttaatctgcttcaacttacctatatattcacgataaaacacaagggcatcagcatcactgatatcgccaatccaagcatcttggttagctacgaggttactcatgaatatcagtgttaactcttttaatgtatatttctcagcgagtttctcaaagaaatatttgtctctacgcttttgataagctttatcagagacccgcataacccagttatacttaacaacgtcatatcgaccggcaaagtgttgtttgagcattaaatataaaagataaacgctcttaccgttaacgtatctgttattatttccaggcatgcggagacgaatcataataaaaagtccagactattcgttttgtgtgtttgactaaatgatggacgaagcatattttcttccaatgcttctgacataattttttctatgattgctggaggaatatatctattgaagtttccctcaggaatagaattttcttctaaccactgagttgttgcttcaagataccccattccaagttctgttaccatagactcaatagtaaatccgttagcttgcttatctaacagctgattaatggattcagagggggaggtatccccctcgtctttaagcgaaaatagagtcataagcttctaccacttcatctttttcagtttcaaaacgatcgcgtgtgcctttatggaacagagcaagcagttgattaaacagtttgccttctacgccaagttctttcttggcgcggtctttaatgtctttgttaagttcaagatagctttctgctttcaacttattacctgaggcttctttaatcatatctcgcagagcctgtccatgtaccgcttcatcaaatactacttgctctttttctttcttagccattatattcaccttaaaagttgttaatttctttcattaatttagacagaccggatttaacaaagtagctataaattttgccacgacccggtaattgatagttattataacaatctaaaatgttagcaacaatgtcttcgcggatgtaatcaaaatcgattaacacgcggttttccaagaaacgcttatactgttcttcagtaagcaaatctttaatgttttcgccagcatcaagacactcttcaacaaacgtcattttcgttgaaggagtacgctcaccatcaacatgagtgtaccaaaaatctgaacgaactttaatagaagcgacgttatctttcttgtcacctttaataattttaaccatacaatctaaagcaggagaaccggttttagattttaccagtttcttctgcattggtgaccattgcttaacattaggatacttatgcaattgagtaaagtcaccatccgaagaaacaatcatgactggatggccttcgagactgaactttttggttaataccgcaatgctgtcatcagcttcagctttatcaatatcaatgacataataaggcatatactgcttaaattcatcaattacagtacgaagaccttcaaagtatccatcccagtcccaattggattcttcacgggctttagcacggttctttttatagtaatatgctacgtcccgacgccaatacccattaactgcgttatcaacgcagatgacaattttagtgtatccatctttcttccacttaaaagcattaaattttaaagtagaaagaataagatgacgaaccataggagtggttagtttgtcaccttctttatacgtatgaagaattgtcgccattgcaatttgtgacaagtcaattaaaatgacgccctcttttacctggtcttcttcagcgaataagcaatttaaatcagacatttgaacctcgttcaattagttagtacagccattataaatacttctataatgaagcataaccccataggagactctatgagcgatttactgaaacaacatttccgtgcaacaaacggcttggacgcaggcggaaataaagttataaatgtggcactagctgaccgcaacgttaaaaccgacggcgtctccgtcgagtacgttattcaagaaaacactatccaaaaatatgacccgacacgtgggtatctcactgattttgctgtgacttatggacgtcgtatctggattgcaaataaagatattccaaagcctgctggagattttaaccaggcgaattggacttctttacgtgttgacccgaactggatttataccgtccgtaaaggagagtttgaaattcaatctggtcagttcatcaacgttgactctaacgctgcaggtaatgctacattactgcttccgttagcaccagatgaaggtgataccatcgtagttcgtgatattggcgggcgtcctggctataacggaatcttaattaaagcacaagatactggtgcgtctatcgtatttggtgaatcgcgtctgcgtgaggtaagacttacacgtccgtattcacaaattatgcttacgtttagtaatggtgcatggcgtgcaagtttaaccgattttggcgatactgccaagatggtagttccgaacgggattgttccgacgcaagttcaggcaggtgataacgtagttcgtcgttatacttccaactcagagattttcattactctgccgttgttcgctaattcaaacgatatcatcaattttactgaccttgacggtacatcgccaattaaccatatgactgtgcgtacgtttgacccaactatctcaattgggactcctggacaaacagaggttcaagtacgtacttcaggtaatgggtttttggtatatgactcgattgacaaaatctggcgtatttttgaaaatgatttacgcacccgagtaagaataattacttctgatgttactttaatgcctaatgagcatatttctgtatttggcgcagataacaatactgttaaaacaattaacgttactttgcctacagacgtagctgttggtgatactgtcacaatcgcaatgaattatatgcgtaaaggacagactgtagtaattaaagcttctgatggtgataccatcgctagtaatttgaatttactgcaatttccaaaacgctcagagtatccacctgatgcagcatgggtgcaatcaagctcaattacctttaacggaactacatcgtatgttcctgttcttgggcttgcatatattgaagataaagcatccggaaaaagctattggattgtaactgaatctgaccctaccgtagaacgagttgatgctaaagacaatacaactagagctcgattaggtgttattgctcttgctacgcaggctcaagctaatgcggagtcaaacccagaaaaagaattagcaattactccagaaaccttaaatggacgtcgttctactgaaacccaaactggtatagcaagaattgcaacttccagcgaagttaatcagtcaacaactgcttcttacttggataatgtaatcgttactcctaaaaagcttaacgaaaggtctgctactgaaacccgtagaggtttagcagagattgcgactaatgctaaaatggatgcaggaacagacgattttacaattgttactcctaagaagttgctttatcgtactacatcagattcacggttaggtgttattcaattagtaaaaactggtggtgctcctaacacaactgctgatcgttcttctgctggcaccggtatattcgatcattctgattacaaaaatgcagttactccaaaaactcttcgtgagtataaagctactgtaaatcagtcaggaatagtttggttagcaactgatagcgaagttagaaacggaactccggcttcttcaaatattcctacagtcgttacaccagaagctttgcataaaaaagttgctactgacggagcaattggattaatccaaatagctacacaaactgaagttaatgctggcggcgtgactaataaagcagttacacctaaaacattaaatgaccgtacagcaactaacgatcgtactggtattgctcgcttcgcgacacctggtgcccagggtgaatttgaagctggtacttcaagtacagtaatggtaaaccctaaattactgttcgataaatttgctaatactgatcgtatccaagttaatactagttctggcttaactattactgggaacctctgggaccattataccatcaacatacaggaagcaagtacttctcaaagaggtacaaccactcttgctactgctgctgaggttagaaccggcaccgacgccaagaaaatagttactgctgccacgctacatgctaaaacagcaactgaaggagctatcggtcttgctcagtatgctacacaggcacaagttgatgcaggcacattaagtgatagaattgttcctcctgcttacttgaaacagactattcaggtaacagagtcatggcaagctacagacagcgttagagggaccgtgaggctatctacaggcgatggaacgtggaaaggtaatgataccaatggctcaactcttccggataacgggtatgcctctaagggcgtcgcagtgtctccgtatgaattgaaccttacactgaaacattacttgcctcgtctcggtaaagcctatgacacaggaatgttaggtggtcaaaccccagacaaatatgctcgtcgcgatatcgcgcagactatttctggagcttggtcatttagtcaggacacttcatttagcaataatatttctgttcagaatattatatatgctaatggtggtgaagtgaagatttctccaacagctgatactggaaatgtgcatgttcgttttcaaaatagagacggaactgaacgcggtataatttatgctgagccacagactgcttcagctggaactttaaaaattcgtgtcaaaaacggaactggaactactgctacaagtcaaacttatgtatttggcggtaacggtacgttagaagttcctaatgaagtatcaactaaaactctgaggtcttctggaaatgcaatagttggcggaactgttatggttaaggacgttcagatgcttgctgtcgagggattgaattcaatattcggtgcccaatcacagtccgcatttattcgttcccgtgacgctgatacacaaatttttgcacaggattcaactggatcgtatccaattttaactaccaaaaactatgcaagactagctgatggccgttatgtcaagaaagctggtgatacaatgaccggcaatcttaacataagcggttctgctatcgtcattacaggttctgaatcatggtatgtgccaacgaatgaaaccgtaataagacaaggttcttggactgctgaaattaaagacgctactaagttaaaaggccttcgtggttatatggttccaatcagaacaccgattgacccgggtaacccaagcactttggtagtgaccggatatgaagaaaagactgctgctggcggtgttttaactcaggttggtgtaactacaaacaatacttatcagctttggacaccttatcctccgacaaccgaaactgctgataagcgtttcgcgcatactgtgtggatgaggatttataatccaaaccttaataagtttgatgattggatgcgagtgttcacgtctgctactcctccgactgcagctgatattggtgctccgagctcagtatcaactcaggttaaaacccttgaagtcctggaatggattaagcttggcccagttaaaatctggccagaccgtccaaaccaaactctcaaatttgaatgggtaggtgattaatggctgaaccaattttaatggcagcctttggcgaggatttcgtggaaacacgaatcctctctgaggcaaactctgtgaagtattggctaaaagcttatgctacgcattctaatgctgttcctaataagccagaattgaatattaatggtgcctttgatatgacctcctccttacggagggggattaatgttgttcaagttaatggtgacagttttattaactttaaaacatttgacgttaccactgatgataataacgctaataacaaagcgtttgtagaatatgcaaatggattaacgtcaggattgtatattataatgacacatgaacgatttcaatccagtccgttaatagacagatggtttaaaaacaagtggtctgcttcttggccaggttctgatttttccaaatcatttccaaactctgcctatgttggagtgctcggagcagcaaaaggacgcatattaattgagtcattttacggaaatgatggtgtagttaaagaagattccagagctaaagtagatactgtatatgataacgttggcgatgtaggatatacaggttgcccttatcgttccattgaagacactaatgagtactcggattctactggatatgaatataaacgttatccagtacaaaatgaatctataagcaaaatagctgattatggattatctcctggagattctgtatttttagtatgtgatatgtatgcatctaaaagccttcttgatgcgggttctacaactagagctagcttgcggtggttcaagggtacatctttattatcttcaaacgtatcattagaagttccaaaaaatggagctgatagatggttaagatttgaaagatttactgctgttcctacggacgctgatggatttactattgtggtatcacgatatccaaaaacgtctgtagttggtgattctaaaatcaaaaaccttgtatttgttcaaacctctcacagcgaaaaacttaacagtgttgttcaagagtttggtgtgaatggtataagaatgaataaaggcgttgaaggagaaaccacagtgattatggaacttccaaattcaaaagtcgatccgagcggtgttattccagttcaatcgttcagagaaacatcagactaaggaagccttcgggcttccttttttcgtataaatagaaaatatataagaggataaactatggccgatttaaaagcaggttcaacagttggtggaaatcctatttggcacgcgggtacttttcctcttgtgccggcaggaaactccctaacttatagaggtaaaaaggtttatactgagatagataaacctcaagcaaatgataacgattttgtatctaaagctaatggtggcacaggttctcaagggttccaaaaagaagttgaatttaaagctggcgttaagatttccgcaacgttttctggtggttcaaacttaaatggattgtattctggtaacggagatggagataccagagaaaaatctaacatggatttgcgttcatggtacggtatcggtatttggaactcatgtacaagtgatggggtccaggggcgtacaatctggttcagtgctaggcgtggtactatcggaacagttggtgatattgtttcaggttcccaagttattgctaatgcttctactccaacagccgctcagcatttaactcgtaaagattatgtcgatgggcgaataaatactgttagcaacgtagctaacgcagcagtcaagaaagctggtgatactatgaccggtgtacttagggctaacgctggcgtagttatagtaaataaagcaacatccggtgaatatgctcctagattagatcaggttatttcacgcggggtaacaatagattttggcacatactaagaggtagccatggccgatcaaaacttaaaacaaatacaatttaaaagaactagcacagagaataaagcaccaggtgcagatatcgtagcccgtggcgaaatagtgttgaatacacatgggcgtactctcgctatctacaccaaagatgaagccgataacgttgttcagcttgcaggtaaaggtgttcctttcttagatactgcaggtaatcttaatgttgatggaactactacgttaaaagacaacgttactatttctccgaataaagcgatcaattttgaagcttctgatttaagcggagcattagtacgtcatatcaccggtaagtgtgctaataatgatggctggtacattggagctggcggtgcatctgaccagggatttcttgaaatcggtacgtatgataacggaaatgaacctatctattttgttcaaagaaccggtggaacgactcaagctgaagttcgtcgtttagcattattagatgggtttggcgatacctctatacctggggaccttcgtttaactggtaaaacagtaaaaatttcaaacggcagcactcttactttggaaatgggtgtaggttctaatgacgcttatattaaaaaccaaagaggtactggcgttcttcaattaactaatgacagcaatttaacgttcagaaattcccaggtttattacgccatgaacggaagaggtcctggtaaatccggtactcttctgacgaatgtagaaaacaatcgtcaagcctggcaatacacaatttcagctgcaactgccacaaccccgcgctgggttaaagtagctacattgaaacacccaggaatggcttcttcacaactggatttaatgattacaggtggcattgattctggacacggaagacattatgttgattttatcacgttatcaggacgcaatttaacatcctggagcactagcaatttagataactgggttgaatggcgcaggatgggttctcctaataaaggaaacgttccagaatattacgttgttaaaaacgatgctgctacagattcagaggcttcatttgatttttacgctaaagttcctcgatacggcaatgggctttatgtcacagtgctgaacactgctggatacaacggccaggatagtggtaaagtaattatctatgaaaccaatcaggacactggtgatactggaccgtccggaagtattcttgtttcaatgaaacagatttttgatagtttagcaaaaccagatttcggtgataccacaggtactcttccggttaaccgtggtggtacaggtgctactaacgtaggagacgctcgaaataacctgggtcttagaactgcggctgttcgtgatgtcggtgaatccagtggaaacgtgatggaagttggtgccttcggtattggtggtcacggaaaatcacttgtagatattacttctgacgttgatttaatgactcgccttaaggctcttggcggtacaacgtttagagccaacgtagcgagtggttataccggggctccttattattcacatggcgcaggtttcttttctagaactggcgatacaatgtctgcgcttaatatagattacgcaactggtaatgtcagagtatttgctataaacgatagcggtttagcaagtggaagagtgaatgctaatatgctttacggtacagcaaacaaaccaactaaggctgacgtcggacttggtaatctgacaaacgatacccaggttaagaaagctggcgacaccatgaccggtgatttaactgctcctaacttgcatgcttctggatcaggaaccgcatcgctttatattaatgcgggaagcggaaatgctcatatatggtttagaacaaacaccaatgaacgtggtgtaatttgggcaactccaaatactgctgatttaggacaaattaatattcgtgcaaaaactactggtggtacttctgctggtgattttagcttccgttctgatggcagatttgatgttcctgtagcagttaaagttggtggagcagcaatgctaaccaaagacggaaacatcacctctggttcaatgtttggcggtaatcttaataactatttgaataccattaaaaacgacattgttgccggcgataataagcaagtaagtaagactggcgatactatgaccggtaacttgactattaacgctaacctaaaagtcgaaaatcctaatggaacatttgttgatttgggttcagagaactcagacaaatacagcagattgacccttgcacgtaaagttggtgatggcgcttccgtagcaatgcttaaaattactcctgaaggatacgtgcaatttggttatcaagatgcagttgctactccatctcctagcaagtacatccgagttaaatctgatggtcttgatgtagaaggggacttggtttttaatcagacatatcgtggtgctgaaaatgcagttgatatttctgataagactaatgaccttaacaacatggttattaaaggcagtgatttaggtactcgtctattatacaagtgtacttctaccggtggcgcttctaatatattgaacagacctacatctgatggtaactttgttcttgaagttctgtctttgcgtaaaatttctgatactgactggtcatgtaagcagacctttactacaaagaatggtaatgttgaaggcacatatgttcgatactgccaaaacggcacatggtccgcatggaaagaggttgtcgctggtgttcaaccgattaatttaggtggtactggagcaacttctgtagctgccgctcgtaataacctcggtgttggtgaatggcaatctgtggcatttggtgtattgaatgtcaacggcgttagtaatgcagacccggccatcacatttaaaaatggggctatggttcgtgaagcccaaggtggtagtctcggcgcgttaatcctgtcggcttctactgcatctccagacggcgcgaaatatattgcttttcgacccttcggtgattcgtctggtactgagattagagtaaaagccaacgggtcaagtgagtcactacttgaatggtcttatggcccaggtattcgttcaaattcatctggcgcttttgttatctacgcaaaaacaggtcaggcactccatttaagaccaaacggtgataattctaaccaagccacagttattgaccaaaatggtaaaatgactgtcggtggtgaatttgaggcccagaactcaaaaatcactggtaatttgaatgtatctgaagataatagaatgattgttcttggcaaaaactctgatattggtttagtcaagaaaagtggtatgccaggaaaaatggctatcggtaaatctaactcgtttactattatggtatcaacaaataccaacaaccaaattaatcctgctgatacgtttaatgacatattcaaagtagatgctgatggaaaccagactgtttacggaaatgcccaagtcaacagacagttaactgtttctagttcagctactgttaatggtattattaatgccaacggaggtattattgttcctactaccaagtatgtacaaattgccgatgctcctacgcagaataaccaagcaacaaataaacagtatgttgatgataaggttgcttctgctattagtaatgctggcgacacgtatcttccattagcgggtggtactgtaactggtaacttgattgttactggaagccagttaaaaagtacatcactctgggttaccggtgatgctgccgttaatggtgttttaactgttgacggaaaggctagatttaatcaagagttcagtgtatctacttcagttaacgtccagaacgatggtaatagccatgtgttcttccgtaaagcaaatggtacagaaaaaggacttctttgggctgacgaccctggtaacgttagtataagagcaggcggcgccattgggccggtgtggaatttctggagcagcggttcctgccaattcccaggagctatttctaactataacggaattagtaccactactaattatcctgcaggaaaacctaatggtacatataacaataccgcaggactagtaactagatttagtaatggtgcttatgcttcaatatacttccaagagtatgtaggaaactatcaccaggctattcttaatgttaacggatttggtcgagacgacaacttctttttccgatccggtggcgacttcttctgtactcgtaatggctcttttgataacgttgagattcgttctgaccgtagagccaaatcggatatcaaagttattgaaaatgctttggaaaaagtagaaaaactaaccggtaatacttatgagcttcacaacacatccggtggtactactcgttctgcgggtttaatcgcacaggaagttcaagaagttcttccggaagcagttactcaggatattgaagcagacgggggtttattgcgtctgaattacaactcagtaattgcacttctcgttgaatctgttaaagagctttctgctgaggttaaagagcttaaatctcaactgaaataatgtaaggggcttcggccccttttaggagaaataattatggcagtaacaggaccatgggtaggaagttcggcaaaggccgttactggtgaaacctggatggcccaggctggagcaaaattgagattggggacacccttttggatgtccaacatgattggaagaaacgtctggaatgctagaataactatttctggtaacaacccagctacaggacctaaggttcgtggcgcttggaaagataagaacagtgcttcatggaacgtgttactcgacgctcgtggggctttatcaggaatttgggaaactgggtttaatttggttgcctttggattatcagagccaagcaaaacgtttggttataatgacgcaattgttctagaaggcagtggaaactttaacgttaactggcgagttgatactgaagacggtaatcaattccattttaatagctcccgagattaccgaggaagacgctgttatagctgtacagacaacaatgctttttggaactggctttatgctaatgatggacgaacattccagctgtcgtttactgcatattaagcataagttagagcaataaatagctctgtaaggagagcaatatgtcaagcaaacaatcaataccattttttgatatgtttcttgggttgctcgagctattattcaaagatggagccacgggaagagttctcttttcccgtgtttttgttgtcatacttttagcattgttggcgtttgctggttataagtcagatagtcttattactgcttacgtcgatagtacatatgacaagtatgataaactggttcaaaaggatagggatacccgatttgataatacagcactcgaacaactccagatagtacatatctcaagtggtgcagatttttctgcggtctttacgttcagacctaaaaacttgaactacttcgtagacttaattgcttatgaggggactttacctagcacggtagattctaaaaacctaggaggatatccaatcgacaaaacgtctgctgaatacagtacgcatttatcgggtagatatttttggacggataaggaattcgttttcttaccgacaaaaagaaaaccacctgaaatatcgtacatgtttagctgtccgtatttcaatttagacaatgtttatgctggaactgttgaaatgtactggtacaattccaaacctgcattatctaacgaaagactaacatcgatatgtggtcaggcggttagagctcttggaagagctaagtgattacttattactatgcatagccatcgttcgatagatagactcaaatccctcgttgtattcttcaacgagaattctcttctcttcgtcagttaactcagaaaccattttacgaaagttgctctgatttaactgacgcccctgctcgttcttgattccaatttcattcaagaacgcaataaattcatctcgcttctccatgatatgttcagcattgaacttagtcagaatagaagcaacagtaacgatttcttggacaatttcaaacttagtcattatttttcctacaacataatggattatgtgattatagtatcatcttgataccgcgttgtaaaccagtttatgccaattcccaacgagaattcaaatcttccttggtagtgatatactcagcaccagaggacatccagagcccgtagcgaccatcttttactttagccgttaaataccattcctttccaattggacgaaccctacgattcatccagtgacatacgtcaattgcctcctgaaaagacaagtcaatcagacttccaagcgcgattttattcattaacgcttcgagatatctttgtgattcaacgacagattctaagttatgactcatgctaaaactacctctccacgattgtctaaaacacgttcaatgtattcaactgcatttataatgtcacctctatcctttgccttaatagtaataattccatacgtataaaagtcggctgacaaactgaatggcttagaagtgtcctggttaaacgtagacattactgcttgctctaagtgttttacttctaagtcattagcccaagagctaagaactttaagcctaacttgtaaagtgtattctactttaattgctgaaagcaattcaacacgtttatgatacgccttggcttcatcttctctgcgtaaagtttcagtattcatagataatctccaatatcataagcatcaacacatttctgaaattgttcaagaacttcttcaggttcaacgttagctataatagctacagtaaaggtaccattattccaatcatgtaccatccaatctccatatccaacattctgaaggtcttccattagttcagaatggatatctgctactaatccagaatggtcccctaatttcttgtggagagcttctaggtcatcacaaataatagttaaagtagtacatttggaattattcagaatgcgcattgtctttacctttgtgtttttgcttacgttttgattctttggcagcgcgctttttatctttatgcgcgcctcctttgttaaagtcattcttcgctactgggttgtacatgtgcaattacctcatttaagcagttgcgtgtaatatcaaaacgcttagcaataccacattcttggatatgtgcttttaaatctccggcatgcacataccccaattccaagataaaccgtttaatttgagccttttctgaacgatttaagctattgaagtaatctgccttggcgcttattgctctcacgctctatcttccttacattcaagttccttgatataatagtcaatatctttaatcatttcttctgtcattattttgtacatttcagcaagaaatggtttagcaccgccattaaatggatggctaaacgggcagatgtattccttatccatgagagttttcatgaatttgctatctgccattttaaacccggcttcattggtatatgtaccccaattatcgtccatcatttctaatgagcgctgaagcgatttacgttgaatttttaaaagcgtaatgttattctttaatgtactaatcattagtataaatcctctgagaataattcattggcgggtcccgatttaggacgaactgtattaacttggcctgcatgtgtagcgatgattaatgcttcttcacgcgtgaagtactcaccccattggtcaacaaatccttgattgtctccatggacatgatcagaaaccaatttatcgcgaaacatatctaaaacgttcgccatatcagcagaataatggcgagtgcctggaactacaattgttccaccagatttcaattcaaaacgatttgctgcacaaacgatacggcgttgaagtaatcgtccatcccaccaatcagctactttaaagcaaatttcaggaatactaacttcttctggttcattaattagagaaccgtgacgagaagcatcaacaaatttattcatttgttcggaaaacttgctcatttaaagaatcctttaattttctgccacaaacttttcttttcacgaataccgatttgccgaataacaggttcaccctgcattttctctaaccattccattgagttaacagcttccgccattggaacaaatttagcaagggccttttggtaattatctacatccatgatatgtttaccatctgcattgtagatagcatagcattttgtgaatttcttatcaatgtatccgataaagtgcccacggaaccatacatcccaacaatcagttgggatattagcattcaagttaactttttctacacaacgctgaagttcattcaatactttaaacttgttcattacagttccttaatagagcggatgatggtttcaatgttttcagcagtacgagcgatatctaagtaagtattgcctgttgcagctacacggcaagacattccgaggtcagtgaagtgtttctgatgctcttcagaaatcttgtaaccgaagatacggaaagtacctttgttgttaacttcaagactacgaataccgaatgtacgtttttccagaactgcgatatagttactacggtaaacagtaagttctttcagaggtaagatatcttccatctcaccgagaagtttcatcatcaggtctttgtgctcattcatgtcttcagtaagaggacgagctttacgagtattgcgtttcttcagaagttcaggcttgttctcttctgcatagataactgctgctttagagatgatgtcctgcgcttcaccagtgatgattaaaccgtcaccagatttctcgatgagacctttcttaatcagaacaccgatgtttgagtttacagaacttgcgttcatggtttcttcaaggatttcacgcagttcagaagaagtgatgaaatcctttttagctacctgaaccaggatagcagcagttttctcgttcagagcatcttcggaagctttgatgatgtaagttactttagacattgtgattctccatgatgttttattcaatttgtttggtatgatactataataacatctgctaaccagcttgtaaaccattttattctgctctctgaaaaattttcttcaaagagcagtaaaaatgctatacgttaaagatcaagaacttatcgccattctcaagtttaagcacccagaaatcatcatatacacaaagaacgacttggtactcttcaccgtcttcatagttacttgcttgaattacctgacgcataggatactcgcgattaacttcgaactcatcgagcaccacaatgttacctttgacatagtggctcagtcgagtgccatcagcttgagtagaaatataaagaatgtttttgatatcagattttaatgatgtaatcattttgtttactccgtgttgttttgatatggctataatacaacaaccgtgtaagcatgtaaacaactttatgaaaataatttagggcattctaaggagggattttggatggatatagatttatatggaaggacctggagatgacctccaggttccctagattaattgaggagcaataaaactagacctaatacggcaattacagaacctataactaaataaaattctatcatagttcttccaggtctttcagatactcagcttcaggagttgtcttttcccagtacttaacctcttgtgctaggcgttttgcttcctgagcaagtttcttggcttcatcatcagtgatgtgatagatgttcattgaaacgagtttttcagaatggtctttgaatagttcattctgttcaatttctttagtcaactgcttacgagttttaccttggataacgatgttacctgcaataacctctttaataaattgagcttttgcctgagcaagattaaacgcctgtttagtttcagctattttatgctcgattcgtttagcggtgaatgtcttacggacttctacaaaatgacgaatcagctcaccggaagttttgaacttgtcgttcagcttaccattctcatcgatgaccacaatgtattgactcattttctcaatgagtttaaaatccttcatgattttagcatgacgctgctcagggtcatcgctcaaagcatagtctttacggaatttcaccttaaagccaaacccggtcttagaacagtcatcatcatatgtgatgtatcctgcatcttccaacgggtcaagtactttttcaacgtaagaagctcgttcaaacttgtatggaatttcactgatatagattgagttccgtgaagtttctttatacacgccgtgcagctcaacagaaccgtcttcagtttgaacgatttttccgttaaatttagggaactgaacttcaggttccatcatttcgccacgaagtgctgctttagtgcattctaaaacagattcaaaactatgcggaagaatagaagttgaataacctgttgcaataccgcgaacaccattcagaagaacagttggaattaccggaagataataagcaggtggaacatgctctttatctttatgcaccggagcgatttctgtgtctttgtagattttacggaagttgtcagaaatccggcagaaaatataacgacttgccgcagcagattgaaccaaacgagaaccgaagttaccttgtccatctaatagaggatagttgttattccatgtgtttgccatcagtgcaccagcatcttgggcagacgtttcaccatgatgatatcctaaatcagctacaccaccggcgacagacgcaagtttgtggaatttttctttattaccacgagccaaatcaagggcacgagcaataacaaaacgctgtacaggtttaaacccatcaatcaagttcggaatagcgcggttttctacagtgtaaatcgcatactcttttgcttcattatcaatgatagatttcaaatcgcgatgacgaagatttgacgccttagccaaatcatcaatagaacctgcttgttttaatagagtgtcaaaaatatccattgtacctaccaaattagtgagccgatttgtactataacatcggaaatgaaaagcacaatataaatcattccgtaaatcattccatagtacaaaaccaaaagaatgatggaaataactgcggcagaaactaggagtttcttaatcatttgtaaactcctacaattttacaaatgcgctcaaacataataaatgctgcagtgaacgcaatgcttccaattactttagtggtaggcacaaggccataccacatgaatgttcctgagcaaatcattaaggccatcagaaacacatagcccatcacgaagaaggttctcattagtatttctgcaaagtaaagatgaagttatcattcagaatacgattcagctcagagtaggtctgcgcatcacttgaatgctgacgagtaaacgccaatgcaagctgacctttgccataaccagtggtgagtggtttcattttattagcaggaatccagaacacaccgtaagtcatgcaattcgagcgcagagtacgacccaactgagaacgtccagaacggatatgagaaagaacactttcaaatcctgcctttgaacgctgtttagctacaaagaaacgagcagatgcaccaatataccctgctttgccatcattgaacatcaaaaaataaaatccttcacgctcagtaatttcacgagatggagcacctgttgcccaatcaccgttacgaatagaaccgatcagttctgcgccagcgttatcgagatcagcaaaagtcataatattacgcatgttaatttcctcagttgattaaagtttattctccgataaggggccgaagccccttctactaccaaaaatatactactgccgttacaccaccaacccaaaacacaagaagacctaaagcaagcagacgatacacgatgtgtcgtttcatttttgaccttcccatacggtttctactaaggatttaaggccatcagtttgaataatatcaatcgcattaatggcaaaataaattccgaatccgaacacggtgacaatccccagtgctaccgcaacaataacagacagaacagctgttctcattaagttaaagcgacgatcaaaactattacgaaccattatattttcctcagataaatgcattaatccaaacgttaaccaaatcccatgcgaaaacaccaatgaaagtaacgataaggcagaatactacaaagatgttcttcagaatcgtaagtaactttttcattttgttctccagtttagctaacaagactatagtatcactggagaacaagaaagtaaactattaaatgcacaaattacgaattttttcttccagagctttgactttctctatgtgctcatcacgagcagcggcagctccattaggatacaacccgccatacgttgaatcaccgttatcacaagcaatgatagtataatgccaattcatagattcaagaatcttatactctttcaaaagctcagctttaatagaagcatttccgcgtttggctcgaagtgattttagctctaagtaactcatgttttactcccgttcagtttgtaaggccatagtatcatggccaatcccggaagtaaacaactttttaaaatttatgcatgatgtacccgccagcaccaactcgcgaaggttttacgacttccatgagctgttcgataccgccactgaacatcggtgtgtaccgtatgacattctgggacacttcttctgcaacgaatataattatacagtctgcgactttatgtttaaacatgggccctagatttattccacttccatctgggaatggaccgtctttaccagttgtaacattaatccatggcttatgatttgctcggtcatgaacaaagtgtgttttaacttcaactctaacaccttggtagtagggatgagctagtacgtcccaggcccattcatacggatcgttgttattatggtcaacaacttgatcgtttacgtatccatcaagaaaatccgctaccacatactctgccggtatagcaattctacatcttttaagaacatcaattctgtcttgagatggatcgatatctaaactatatcttgcagtatcaatgatttttacttttgcttcaccccttagcttattcaaatctagggtaaatgtccggagttggttcaatctctgcagggctttgttcatcaatgccataaattcctctgatatgtaattcaccaaaataaacacgatcgtcgtggttacaagtgtctggttccacaacaaaatcatcaccaagttctacaagttcatcacagtgcaaccaagcatagtgaacatcaccttcatgtttaactacatgatgacaaaacaccgtagcagcatgatgagtaccacgaagattaacaactttagaatgagatacgttaaatggattaatcatgtttcacccataataaaagaggagcccgaaggctccttataattagcgaagttctgaaccccaacgatcagttacatcttctaatactacataaccacatgtacgcattttagcgtcgttgtaatcaaccgggatagatactacatcacgcggatgaactttaactgaaacaatacggtcagaaccactaccgaagtgaccgatgtaagatttagagcagacatgcagacctgctgaacaagtacgctgatcgtcttcatctacctggttacgcggcattgtaacagttttaccgggagagttatcaaacgtgtttgaagcacagtccatataagtggaacgaactactttccaaccaatgaagtgaccatcatcagtgatgtcgatatcgtttgcattcaggaaatcaaacagacgataaactgcacgacgagatgggttcagcatcaggttttccaggaaaggcagataacgtttaaagtcttcgccatcttccatggctcgaacgatacgctcagtcagaccagatttcagctcgatatctttatagaataaagtaccatcttcaattcggacgttaccctgaacgaatttcttgatgccttgttccaggttaatgtggtcaatagcaccagcgatatcaccatctacaagtttctgcagtgcagatttaaacccaggatgttggctatcagcgttataagtagtacggccttcagtaattgaaatgaatttggaacttgctgcccatttaaattcacgctcaactggagcttctactttagcaggaacagctgccgcggcagctcgagcttcgcgttctttaaacacacgccgaatggtgtcacgggaaacaccataattctcggcgagctctttcttagtgtacagaccgtttttgaagtttttaacgattgcatctttttggatttcagacagacaggtaacagccatttattcacctttattttcagaattttgagtagaagctccatcaaggagctccatgatttttacgatatcatcgacgagtttgctgtcagtccgccaagtatccaagacacttgcgatgacaggataatcatctttaaactgttcaatctttttatagaagattgtctcagcatcaccagacagtttattataaattttattacataaagctaaatcatcgttttcatctttgattttactggtacggcaaaccttagcgattttgtttagttttgtcaggaacggatttttcattccagacgcagtaaacttactcgacaagaaattcaatttatcgtaatgcgcaatatttccacagatacggtttccagtagcatttgatggcatgtactggtcataatctaccttatcaatacacttgatgtattggtcgataataaatcggtcaaatgaaagcaatccatcagcttttgccgcggctttcatagcacccggacgaattgcatagaatttcttaattccacacgcttctgccagagaccgcatatctgtgatgctcatattccaccaccaaacattatctgggaaagtgtggatttcatcacgattgcgaccgattgcataaccttcaagctcagcaatttcagatgatactaaagtctgacggtcttcttcccagtacccgtctttatcaatccaatgcagagaaacattaggagattttggacgtttctcttttggaccagtatcataatcaggaagagcttttctctgggcttcaagttcagacacacggaatactacaacttcatcagtatccatgattttcttcagctcatcaatgacatgtaattcatcttcattgtctttgattacagtaatgtgtgcccagattggaactaacccagatttacacagagctcgaaccgtagcaatacgcttacccgctttatcgtcaataagaacgaacgctttagttctatcaaccccgcaaatatcagaaatgtttacttggttatgacgatgccaagaactgcttgacactttacgacgagcaggttcatcgcatgaaacataaactgatacttcgttgtctacataatatgaacgaattttatcgagattatacttcgcaactacttgtttaatatcgcggttcccaatggtaataccacggctctgaagaatagaacgttccttagaactcagcttattgaactcacgcaagaattcacggtcagattcatacgcttcaaacgctttaatatctgcggtaattacctcttcttcaagagcattcacacgcttctggatattagcaattgtttcttcgtcaagagaaagctcttcacgagatggagtaatgtctaattcgccaagagggaaatgaacataaaccttgccataacgattaagcagccaatctgccttaacatctacaccgctgatcggatatacgatttttccataaactgcatacagaccataactttcgtaagagctattaacgctgaaccagtcggtcttatctaccgggaaatattcaatttcacggcgaagagaatctacctttggaggtacagcaccaaaggtacgcaaaatatatgcgatttcataatgccaagtatcaatatcttctactttaaccggaacagtgatttcaagaccagtttcttcgtcttctttcatgtcatcaacgaacattggacgaatagtaggttcgccgcggtttttcatgacagtataacctgtagctttaccatcatgataagacactacgttaaatgtactcgtatagcttaatggtgatttagaaccaagaccaagagcaccgatgaaatcattactattattctttgtggattcaaagaacgttttgtacatcgtcatcatgtcattatgattaagacctggaccataatcacgaattacaaatcgtgggtcaagacgagtaggagccttgatataaaatggacgattttcattaccgttcagtttatgagcatcatcacagttagtagaaagttcacgaacaacagcacgaactttatacttatagagtttgtttgacaagatgtcaaaagctttacccgaggccttaatagtaaacgttgaatcatcagcgtcagaagaaccaatgattacttcatcatcacatttaattttcattttattcctatcaattatgtcgtttaatgatttctgctacttcaagtaactcttctgcagtagcggtattagttgtaaaaattttattatggatttctttgaagcgttctttgaattcctcagctgcttggatgtcaaagaaccgctggatgatacgatattcacgatatatagcatcgttgaataattcttctgatgggatgtaactacgtttcataatattttcctcagtgatttagggaaattatatcactataactttaagcaagaatcctagaatcatctccaagcacttcttgattaaagccatataaatccattcttataaagaaaaagggacccggaggtcccttagattaccacaccctactaactcgaccataaacctcatgtttagaaccatcaatgttttccacccagatagtaacccaggttccgggcagaggtttcttttcagcgaacagatatccatagtcgcctgagatcaaagtaatccaataacgttgcatgttaattccttctaagtaagggcaatagtacccttactatttattctttattcactcatccatgtcttacgtggtgcagcatcattacccataattaattcaaacagttctttccagttttcaggaagagtgactacatcataaaccgggtcttgaataacacgttcgtattcatcttcttcaagagagccaagacctttaatataacgaagtttccaacctttgaaatcatctttatggtcttcatattcaccaagagaatagaaccaacgttgttctttacctttggtgagaataataaccggagttttcacaaagcggattcgaccttgttcaaataattctggccaattactaaagaacgccaaaagacttgggaaaattgaaccaacaccatcaacgtctgcatcagtcatgatggcaatatttcgatagttagtattttcagcgggttcaccgatagtcaaaccagtgattgcacaaatgtcaaatacttccttgttcttcatagcatctgcagcagacattccccatgtattcatgaacttaccacgcaaaggatatccgccatgaagttcacggtcacgagttgtaagtagataaccgatcgcagaatcaccttcggttaagaataaagttgtgtcagcatctttaccatatttgttggctttgatgtgcttagctactttagctttctgcgctttcttggcagctttagtttctgcggctttctctgcagcaagtttacgagctaacatcgcctcaataatcggcatatgaatatcttcggatttcataatagcgttagcaagtttcttataatcaatatcaatatggctacgaatttctccccaaggagaagtcagacgctctttagtctgagaatcaaatcgcatgttagacatatcacgaataaacatgatgacagtcagacattctttaattcgcgctttattaacttctagtttgtacttacgctttaatgctggaataagttcattgctcagttcatcaagaactaggtcaacgtgagtaccaccgtttttggtgtgaatgttattaacatatgaaagttgacggaacccgtcatccgaacgaccgatggcaatagcacaagtatcagaatcctgcactacagcattttcgtcatacatgtgggcgtaagctttaaacttgccttgaacccgtttacccatgaatttaaattcaatatcaggataaactactgctaacgtcatcagacgatcgtgaatgattgattggtcaacatcagtcaatcctgtgctttcaaagtgactgaaatctggaatgaatgatactgcagtaccagtcttatctttgatgaattctttatcttttgctgggtgttcttcccaggagatattttctgagccgttagaacaacgaacgatgatttcatttttaccatcgcatgttgcaccagtaaaagatactgaaaagatgttggttaacgcagaaccgacaccgttcataccaccagttttacgctcagaatcatcaccaaagttaccacccgcacgaggacgagtccatgcggctactggtcctggaatagtttctccttcaggtgttactacaggagcctgcggaagaccacgaccgttatctgttacaataattttgttgcctttaatgtcaactgaaatcttattcgcgtgtttgaaattagtacgaatagcttcatcaacagagttatcaatgatttcatcaataagtttgataataccaggaacatactttactgattggaatttaccaaaaagaaaacggtcatgcgcttcaaacgcagaactaccaatgtacattccgctacgcttaatgatatgttctcggtcactcagaattttaatttcgttcttaatcattacatttcctcggttagtgaaggaattatatcaactattaattatagcaagtaattcttctttgatatacatcaatttaccaagaacctcatggcctcctttaaccgctttatactcgggatatcggggccgctgtcgttcaaacatagtccattgagcatcactaacgttagcgtatgcatatcgagttccgtagtactgttcaatccggtactcgttgttttcattaagtgaaatccactcttcacagacttcataatatttctgcatccaaatagtacgaccattcacgtcattaattggccaccaagcaaacctgtattttccaatagcccgctctactatttttaaatgtcgtttagcacgtctttgcgcagttgtcattccaataatcataatattctcctctggccaacaagactataataccaaaacatggtgtccatgtaaacaactaaatgacccgaaggtcatttattcataacgaattgtgctatttttgagaaaaagccctgagcacactgttccgttaacaggttttcctgttggcccaatagccgtaaagcctgtgtgctgaaaatcatcctctgagcaagaaaagaacttatatccggtgattttgatatcagtaaatcccgcgttatctaacacgcgagttgcgttatcagcgtcagtgcatccaatcatcatgaaggcaagcgctgtaattaaaatctttttcattttaatttaaccctataagttatattacctactttaataacccggatttctccgggtttcatggtaatgcgtgctttagttcccatcaataatcaccactctttaatccatcgtagtgaactgccggagcagaaaccacccgcttcatttgaccttcacacttagggttaaagcagttaacagtatagtcacgatgggaaattttacgcataatttctatcttttttccacagacttcacacttgtaatcatacgttggcattaacagcatccttccatttttgtgttttgactatgatttgctcattcagcgcacgagtaaccatcatggagatttcatcatctgatacatgagtatcatttttatgacgatttctgaaatgcagccaaagtgcatccactacacagttaataacatctgcgcactcgccttcaaattcttctttctgccgccatggacgattaatccaatcacacatttctccagtttctgaagaaagttgcagcatgacattcccaatgctacgattaggaataggataagacatttttgatgcttcaaaaataggagctaaatttaacattgatatgcactctgcagtgctgcaatagcagcgattgcttgaccacgattatgaatagaaagattcataaccaaatcggttggaattacattcgtggaagttccaacttcagtaaagtatttgaattcgctatcaaaaattacaaggtcttcaccgccgacttcatcgcattctgtgccattagcccacgtaattcctgatactctattattttggcggtcaactttagtaacagtaaaactcccgccattttcatagagttcatacacaaagtcttcattaacctcatagcgtgaagaaaattcttcttcagcttcatcattgacgaatttgtactgtacgccttctttaaaattcattacacaatctccatgtattctgggccatcaactgtgattacacgagcaaaggtacgaactgggacgatatcaccatggttcgcgaatacatacaaccaagtccagtgctcttctttaccgaaggttttctctttctgaacaacgattaagtccgggttgaacagaacatcttcaaaagcttcagcagtaatttttacggtattttcagttttcatgttattctcctcagtagttgataagataatagtaccacatccttgtggcaaagtaaacaactttttatactaaaccttgacgttgcgattctgtcggctctacatcggctttaggcagaactgcatagttgccttgaaacactacgtttactagggttttaccgtcttcttcccactcatcagtgacaagaacatttttatgcagcgacagattagtggctgaattagtagaactcaccgattgggtaataacattgtccagtgaattcacgtgtacccacttgcgcagatagctttcgttaaacatagaatcaagcaaatcacgcgattcgagagcaactacgaatttttgcagcgaatacactgctttgtcttcattttccagttgaagcaaatatgaagacattttgttagaacggttaaagattccaacaattacgccttctttaccgatatgcttaccaccaatcactttaacgttttcgcctacaatcaaatttttcatcgtgtttctctcagtttgttaatgtagagccattatataacggctctttcataaagtaaatagctatcggtgagaaatttcacatccaacatcgacgccgaacagatacccagcttcccaccctttagccatcatagccttggccaccagaaccatcgttggagagatttccgggaggatttcccggttgaaccactcttcgaagttttcatcgaactcaaactcttccattagccacgccccttaggtaaactcagtggatcggtatcttctggacttggtgcttcgcttaggcctagagcatagcgttgagcatatttaagcattagaatatctttggcacagtcatggatactatcatgcgcgataaatccgtcgagcgtaccctttggaagaggagtagttgtcaatccgcgtgtcagaagcagtgattcaatcgcggtacgaatatcacgctgattccagaacttacacggctcttctttaaatgtatcaatttcttcttcagaaatcccttgagctctctgcacatcgcgaagacaatctacaaaaatcggaaagtcaaaactctgtccacgacaccaaccaaaggaatcccatggatgaattccattatcaatcagatactgctgggcttctttaattccagcaattactgataaatcatctggcgttgaggcaaggttagcacgggcttcagctgactgcttcttccaccattcaagagtagacttaccaaacaatcggtgacctttctgagatttcaagtcaaacttaatacgatgaccacgcttgaccaattcatcgaagctttccagaacttcagggtcagaatcaaaggtgattagagcaaggtcaatcacagaagagcttgacacatttccgaatgtttcaaaatcaataataaagtctttagccattttgagcctctagcataaatttaatttcgcgtaactggcaaccaatatattcgctcagatacacctttgggtcatatcctgtgaaccaagtaatagcattagcattatctgctatatcacgaagctcattcagaactgtatcaattttaatgttaatagcacgcttaacattatccggtgcttcaaacttagattcttgtaagccaacaatcattgtttgaaggtcttctaatttcaattcaaacatattacc

SEQ ID NO: 12 - DNA, 171728 bp, synthetic construct
  misc_feature 1..171728: note = K1_colE6
  source 1..171728: mol_type = other DNA
tcacacataaaacacatcatatcgaccacgggtagtaccaacatataataactgctgtgcgagagaagcatctgccatgtgaatgcatggagtataaatgaagcttctgtcaattgagatgccctgggccttatggaaagtcgaagccggtaatgctttcactttatgaaacttacgcttagcgtcccagaactcagaccaaggagctttacctcctttattccaattcttatatgtatctgcagtttttgccaagaagaattgaaatttattcatttcttcttcggatgagatgacacagattttctctctagcgtactcttcatcgtcgccataggtttcaatatctaatacccaatgacgaaccagatattcacctggaacacctctggcacccaaaaatgtggtggtttcaactgcatccaatatgcgaacaaactgaccattattgaaaagaatttcgctgaatttcttcccttcaaatttaagttccttggtaagaggttcttgcataacaacaatctcgcctactacgaatggtcgttcagtttcgtatattcttcgtctgattatttcattcaatttgtctacagatttattcgtgaatgcaagcattcggttttcaaataaatcttctggtgttttaactaaattaaaataatttagcataaaatctttaagggcagttcctttcgtaaacccacggacaccatgaccatcaactacacagtcacgaatccatccaccatttctgatttcagtagcaacttcaatgattggagcattacttcgcatcacctcggtcaaatgaagctgtaagaaatctttatgagtgaagaatggactcagtgcaggttcattacttccaggttctaccggacgtatctgagccttatcaccaatggcaatgacaatacaccaggcaggaatagttgccatcaaaatcttaaacagcttacggtcatacattgaagcttcatcgcaaatgagaactcgaatagatgccatatccggaactttcttttgttcaaacagaacgttttcttcatatgtcgtcgggttaattttcagaagactatgaatagtactggcctgcattccgctgagcttagataaaacctttttggccccatgtgtaggtgctgccaacgcaatgccagagataccctgagaaatcaaagcatcaatgataaatttggttaaagttgttttacctgtaccggcaggtccattaatcgtaatatgttgacctttagctccttgtttgaccatttcaatgactttattaaaaatcgctttttgactttcttttaattggtcaaacgtaatcatgccacttttaccctcactacatgtagatttttaatttttgcttcgagtttttcacgctcaacatcgctaagtggttcatacactagctcagttgttttccaccaaagcattcctttggttttgctttttccagtaaaattcccttttgctaatttgtctgttaaaaccgacattgtacgaatccgtgctttattagccgattcttcattagtgaagaccacacatcgttctccatcgtacatatcagttgtgactggatggtcaaatccgtctttatccttatacgctactacatatccatagtgttgcattacattttacctctcaaaagttggaagaaggacgcagtcaatggaagaccttttttcaattttaacttatctagcattgagcatttttctaaccgacgaagtgagctaacaattagccgtattgattgtacacggatttcagcatctgatggacgattcggaactgatgctaaaatagcagataacttacgctcaactttagctaattcagacttaccaccgctgatacgagttctcaatgcattaataagttctaaatctgccgaggttgcagttccattcttttctttttgcacaaattgagaaagatgattttcgcgattacgtaagttagttttaattgatgttatagttttttcatactcacgaatcttttccaaacgagaagcttctttatcacttgttggcttaacagaatcagaagagcgaactatgcgtgccgcaatttcattcgcttttcgttcaaggccttcaatcgtattatttccacgcaaagtattatacttttgcttgacaggaataacattccctactacatatcccaagtcattattccaacgctcgagcgtcatgctatcaggatgatttcctttaacagttccaaacttttcgcctgagtatgcgcaatgtgtctgctgcatgatgttaaacagatattctggggtgagattgaactccttgtgccgacgttgagcagaacctaaagttgtaattaaacgagtataaactttagcggtttcagcagtaaatttcatcatgttttcctcaaaaatgctttcgtcttacggacggtataatgggtctaggtccctagttctagataatcactagttgactaagctatagtaacactaaagtagtccataagtaaaccagatttttcaactttgttatgaccaaccactttgaacttagttcccatcggtagcatcctttcttgttctttatcaatcatctcgatgtcagcgcttctgcgctgagcaatgttatcaatcacatcatttggtcgcatgaattcagaatctggtgcagtaattaaaagcgatttcatgttggtatgataatcaaatgattgctgacaattattgacttcaatgactacaaaggtcgagtaatgccatttgcctgcaaactctcgggcgatcgtttcatctgttgtgaatgatgctacctttccaaagtcaaatttctctcctttaataagagcgtcataaaaggctttagcctcacgacacgatagacctctatagagaatttctctgttatcgatttgatgacgtctaacgatagagtcaagtttcttatgaaattcttcgccaatcttattgttcatgcactgccacagaattgactgttctttgcagtcaaaacgattggctaatgcttcccatacgcttaaatcatataaaggtaatcctttgctttctcgcgcgaagttaagaacatcaatggagcgaatgggttcttcgataggaataacctttgataattttactgaaatagatgggtttaatgaaatagccatgatattctccattttggttacgagaggtatcttatcatggctttttggaagagtaaactactttgtgaaattattttgcccagggagaccagggcggcgggtcagaccagattgaagctagttcatctagaagagcttctggggctttaataccatacttctgtataattatacggtattcgtctttgatgtccttagaaatcactggatgaacttgaacctcttcctgaggctcttccatcatttcaaacaaatccatcacatgaaccactcagtattgcgatacagacaactactgctgttatatccatcagctgctttttgcaacagcgggcttggagcaagtttgataaaatctgcgcccatatataaccaaactaacttagtaaattctattagagaatctgtgctatcaatgataatctttttgcctcttgaaattatgtcattttcgtattcatataagctagtttcatgacatacattggtgtatcctttcaagtggagagcatgcagtatagaaacaggacttcctggaactgtatctacgtcaaagacatgagcagtcttaataatgccataatcttcagaaggacaccaaccaaatgcctcgaatttattaattaaatctttgaaatctttgtcgaacgtactgtatagagcaacagtaaaaattctatcttggtctagacgcaaagctccttttgcatcatttcttgattgaactgcgcgctgtaagcttactttatagatttttgcgtttgccacacatagctccttcagtcatgttgttgtcttcaaaccacttatcatttgctttaattaaagcaggcgcagcttttagtaataacgctgcagctcttacacctctgtaccaacaatcaaaatgagacttctttaatggcgattgataccagggcttagtataacatatcattttcttctcctcagttagtaggaataatatactattcccagtatagcataaaaggactcccgaaggagtccttaattttatacttcgccatcagccggaacagcttcaaacattttcgcgttggtggttgcccaagtagcagcatcatcaactactgttgaataagcagctttttcagatgggaaaatctgatactgcgcattagcaatacgatgcgaatcagaatacaccttaaaagctacagatacttctgtgcctttaacttcaccatcagcagttgcatggtcaaaagttttgatgtttacgtaagccattttaatctcctatttagtttacagaagtatttatacagctgctgtaaacatctttaatatttctttatcaatttctcgagtgatttcttctcgaagggccaatactaaggccctttctttttgttttctgataatttttaaacgacgcttagatattcttttagccatcaataaccactgtcttgacgagcaaagttctctgcgtttttcagataatacagcttaaagatttcttcagaatccagaccaagcgccataaacatattcagaacaaagtgcaggatatcaatcatttcaaatttgatttcaagctggtctttatcagacaggtctttgatataagtttcctgcatcttgacgtggtcagctttccatggtttccatacggcagatgctgccttttcaccgttactcataccgccaagagacgtcagcaattcgcggaattcgtcatcaatgtaatctttttggttacgcagccactgcacgatatcaccggcttgggccaattcatcaggatgcatgttagtaccaggcttatcgtttgctagacgaacctgaagagatttttgcatatcaagcattacttgcagagggtcaccaccaactttgcgtacgatacctgcgtatcgagcttcagctttatctgcaccagcgatcagttgactacattcgttgaaatgtggcatattatttttcctttcaattaaattagataaatattatatcacttaacataaatagcaggaggattcatgtctgaagtgaaacgagaatgtaaagacaaaggaggatttggaagatatctttacgtcggaatcgccactgctgctttagctgcatggaattatgtggtagttccattagctagcacacacgggctagttcttcctccaatgccgttagaaaaagttgtgtcgtttattatgactggaggattgctttaatttaaggggctttggcccctatatcttcgcatatttgtcaagacgtaatttagccattaaaccttgcgatatattttgattaatataatccgttatttcagaagcagttgccccctctttcataatcatatcatttatatctttgcttttccaaggcgacttatcccagaaaactaccttttcaccagcatctactaaacgtttcatacgcttaattgtatcaggatgacgaggttcatggtccataatccatgctcggttatcatgacatggaacttgagctaaatctaaagacccgccagtgattgcaatagcattatcaatgaacaacgaatctattggtccttccatgacgaatacgagttttgactcatcaatggtgtcgagaccataaattttggttgcatgttcatgggctttgattgtgatgtatttttgtggagcattctttcgtagtgctcgtccttgaaacgactcaatctctcctttcttgttgaagataggaataaccaaacgtggttcgttcgtctcattcttataggttcctggattaacagagttaacaagagaaggccattggttagtaaaccataaccttttccaagaagtgcttggaatacatctggcagtcacatatttaactatcggatgttccttcggaagtctatctaatcgctcgcagaaattaagtttttctattacggggagttttgcattaattttctcagacggttctacagcctttggcttatcaaagacttgttcctttcttttctcaagaagatactctcgatagaggtcaggctcattatctttaagatactgtgatagccacttgttatactcacagttgaagcaatggcagcgtaatccttgacctgcatcaaaaatccagaatcgggctttattgatatctttctgtgagtcaccacaaattgggcaacgacagtttaacttgaatgttgaagatgtagtaacgtgtctaaatttaggtaggtgagatattgcgcgaattgcatactcgttatcaacccaagacataatatttcctctggccttaaactaataaggccattttatcactttttcttggcagcgtctttatccgcttttcgtttctttggaagagtttcgggtcctttattgacgatgtccccggaagttgtacctgatgcaatattctgtggattgccgcccgcatcacctgcgaccatctcagtaacaaactctttgtatgttttcatagagcctcctactatttattcatgcgtaatacgtaagcatttatatgtaggatacagcgtcggagacattgattttggattgtctttgataagcataaactgcttgcctgtatcttcacacttttgcttaatcattgcttcatctttaccagtgaatgccatcttttcagtagacattccgcctgaacctgtagatagcgccattattaaaacgtatgtaatcatcctaaaatccacttaacaatgttgaagttatcaaactgggcatcacagtaaagaacataattcaacttaagtgctgcgccgtcgtctttaagttctgcttgcacttctgtttgtttgctcgggtctacgttttccacaatatgaccaacatctgcacgaatctgctgagctacttcagactcatcagcagtcattgaccactcgcataagtctttgtcatagttggccatggcaggaactgcagagcaacttgatactgcgaacactaaagcaagtacaatctttttcattttggtttcctcaagcagcttgtacgttaagagcagaaatcaggcgataatcaccgtttgcgtatactaacattgacacattgccatcagtgtttttgaatggctcaacaactactaaaactgtatcgccttcatctaatgcttttcgtactacgccatcacaacgcagattagcatgtggagatttaactactttgcttccaactaccataccacaatgcggtacggtttccgctgattcatctttactcttaaagactacgtctaatgctttttcaattgtccacatgatgttttcctctactcgttttgtttcagtaaggccatagtatcatggcctttggagaaagtaaactaccttttgaacaattttttcaacaaaatgtcagaggtcagattcttggtaggtaggtatgtagcagagttaacccagatgccatcgctgtcatacaccttgacctctccatagtcgcatacagataggtctgctttgttatatgcctcgatgcctcggtgaatggtatctgtggctgttacgacaaaagagtgacctgattggtcacggaccgcgctaaacacaaaaatcataaaatttacctagaattttaactcttctgccagagcatcaagcttagaacgtgatactcgttcttgacgattagattcggctacacggttctgtgcaccggcaccttctcggacggtattgcttggattaggcttagttgggtcgttttgctgctcaatttctacccagcgttgattagccttatgcacacccataaagaacttattgttgatgttcttatcgccataacgtgatttaatctgcttaattaactgttgcttcatctgagcaagttcaggagtttcaatcacagctaacataaagtctgccgtagcaggtagacccgcagattctgcaatatcactcatgtccatatcagaagcatcccaagctgaacgaccgacctgagccgcggtccaaagaacagtttcagattctacagccaatgcacgaagttcttctgcaatagctttaactaatgtgtaactgttttcagtatattgacgaatacggcaagaagcacaaataccaagatagtcaatgatgataacagtcggtttaaagttcttcttgagtttcaactcattcagaagagctcggaatgtattagcgttagcaccgccagtcggatactgtttaatgattaaacgaccaagagtactagaactacgccatttttccattttgcctttatattcggcgtatgatacacaaccatcatcaatatcgtcaagtgatacatcaagcaaattagcatcaatacgtttagcacaaacttcttctgccatttccatactgatgtaaagaacgttatgccccatctgaagatagtctgcagccaatgaacacaatcctaacgatttaccaacgttgacgcctgccatcaatacgttcagtgtaccagtctcggcaccacctttagtaattttgttcagaatgctaagtttaaacggaactttacgagctttattctggtatgataaccaacgagcttcataatcttccatccaatcatgaccaatatagctatcaaacgatactgataacgcttcacgcatgatatcaggaatagcccccatatcaggaagacgcttatctcgcttatttggctcaagctgggcattagcctgaatttcaataattcgagacgtagcgttatacatagccttttcttgaacgtacttttcagtttccttaactaaccaattcaaatcttcgggagcatcagataacttatcaataagtttctttgcgccttcatgttccgtttcagttatagacgaattatccagtgctacacacaacgcagtctttgaaggaattgctgtatattcattaacgtgtttcttaattatgttaaacaccgtctgagcaggtccttgctcgaagtactctttgtccatatatggccaaaccttcgtaaagaaagcctggttgtaaatcagattagctaagattgtttctaccactttaacctcttaaaagattttccataatgattttttcttggtctttaatgcactctggatttgttgtttaacacaagcttccacatgaggataaagttcatccttatgagcttcagatggagtactaaactcaatagttacttcccccgaaggagaaatatttaatttatgaacataaaccaagtgtgattgaccatttaattttatcacaatttcttggataacagtcttcatagcttcttggattatttcatggcttttcttgaacactcgttcttgacgctcgaagtctccctcttccgagggagattcttgttcaaatttctcgagttcagattctaaatcaaactcagtcttcattcatgaagttctctaattcatcttcaacttcagcagctgatactgaaccactctcagggagtttaacaccatcaaccttagttgaaacttttgagttaatcatttctgctaccgcttcatcaaccgcagcgtttgaatcaatagcacccaactgatagcgagctttgatagcgtcacggaatggctcatgcttaaacagaggaccccaaaattccgtactgctcgtatcttttgcccgccaggatttttcttcacgaatcatctcaccggtttcaacgtccaggaattctcgtgcgtaccatccatttttcggtttaacaacaaatccgatatccagagccatatcaagcagaccactgtacggatctataccaccatcgaatttaacatcgatgaagaacttacttttctctttgacagtacgtgatttctcggcgttcaggacaaactgatatccctcaagctcagtaccatctttaatttggcgtttaccgatgatgaacacagtatccgcagaatacataggacctgtaccaccggtcattaccgtcttactgaacatctcgatggtctcgattgtgtggttaaccgcgacacaaggaatgttcttaatagagaagtaaggagttacgatacggaagagagacttcagacttttcgcacgagtcatatctgcgacagatttctcgttcagtgcatcttcggtttcctttttagacgccatgttaccaatagagtcgataaacacgatgactttttcaccacgctcaatagcttcaagctggttaaccatatcgatttttaattgttcaaccgactgaaccggtgtatgaattacacggtcagggtcaacacccatagatttcagataagctggagtgataccaaattctgaatcatagaacaagcagactgcatcaggatacttattaagataagcactaaccattgtcagagacatgttagatttgaagtgtttagatggacctgcgaagatagtcaacccggactgcataccaccatccaacgctccgctgatcgcaatattgagcatcggaattttagttctaactacatctttctcgttaaagaattttgatttagtcagttctgctgtcattttagaagtggatgctttaatcaggcgagattttaagtcagacattcattatattccataagtctccattatatttttctcacaggttaaaggatagggtaattatattaccttgttcttgaagctattaacagaagttccatttcttcttggtgttataaaccactgtttccgtatctatttcataatgcattttacatccaacacacatgccatgccaccagcaatgcattccatctgagccagtagttccttcatgaacaaactcatcagatttacatacgaagcatctgaattcttcagccttgaatatgttaccagctacatcagatttattatagatgttcataagaggtcctttgagggctttcgccctcacagatatggttctaccttaccaaactcgtggaaggcctgagatttcactcgagtgttaatacacatacgaattgatttcagaggttcgttatcaccgaataacccacgtctttcgccgtctttagatttccaacgggcttgatttgggaaagcagcatgtagttgttcaagggctctattctgtcgagcagtatcacgctgtgtagaacaaccaccaggagactgcaccttaccagatttaacgaggtacttaaacagagccaggtgaggatgacccatgttaattaattttagaaaagcataagcatcttcgttaaggtcaataattccgtaaccaatatcttctgctgtaagtttagtcaaatcatagaaagtattggtgaacccaaaactattctcgcgataatgaccccagcttgatgtaattttgaaaatcggcaagcgagcatggccatgataataaccacaatccatagcagtctctacgtatttgaccatatcatcaaatacctcttgactcattgcctcgccgacaccaagtggaacacggcgatcgtcgcgttcacgaatttcagtcagatgaatggtagtatcatcatcaagcatccaaattcgctgccctgcatacatttcagtaatcagacggcgagtaccagcgattccatcaacatcatcggggacagtaacgattttagcagcatgaccgtgccaagtttcgtatgcttctttttctgattcacgcactacaagatgcggaacataaccttcaggaaacatagtcagggcagtaactgccccggcacgcttataacttggaattacaaactgaatcatttccactcacctttatagtctttctttgcaatatgagtttcaccagtataagcatagttatctacaagatagaaatgacgctcatacacgtgcaaagacccgacgttccaaataatgtcgccaactgaataatttttacctgatgcattcagaagtttggttaactgttccagaacatagagctgccatgcatagtcattacgatatccaaatactacatcatttgaacgcatgtttacaacagcatgaactttattatcacgaatcagatactgaacattgttagtacacatgaaatcactcatgccatcgcgctcaaaatcatactgcatttgaggccgtgtataaatcataattccgcggcgagaatcaggattactgataagttcttttgcacagttagcaaactgcgaatagttttgtgatgaccaaactgcccagccatagttagaattaatctcaccatgtttggatgcaattgctttccaaatagctggggtttcacctggaatatctttaacgaataaactttgagatttataccactcaagttcccgagcaatatatccatcattaactgcgccaaaaattaggttttcatctgcaataaatgatgcacctacgatttcaatagtcttcacacccgtcttatcaatcacaaattctttgttgagcaaagcatcagcgaattcttgacggatatcttgtactgtcattggagttacaatcatgagacctcttatttaacttgctggataataattgtattctgctgtgcgttagaagcagaccaaatcagcgcaattaaccaaccgataatggaccaaccgaatactagatttgtgataaagattccaccccgtgatttatgcttacgactgcaagctacaaaggtcggcaaaaaatagatgaagaaaagaatgattaaaccaaatactgcttccatgttaatctcctcagttagacatgcatttgttgtagatgtgattttggagagattttaactgctccatacgttgtttatgctcattataactcaatccgccgttagcaaaatcagttaaacgaatctggtcattcactgctgccgcttgagcagtacatgtacgttctttttgagttttacgcagacgcttaatttcttccagctcatgcttattctgctcaatcatgtctagttccatcgcagatagctgacgattaggattagctttttctttcgccaaccgacgctcaaccgcgagcgattcagcagagacctggttgctagcacgatagtatcctacagtaccgccaattgctcgcacctgtccaacagaagaagccgggacgatatcaccttgtggcatttgacaaccagtcagcgtgagagcaacgataacagcaagtaacgatttcattgtaatctcctcagtatgttatttcgaaaaccatggtaccacatccttgtggcaaagtaaacaacttttttaaaaatcgaacatgtcaagaagagacgatttctcttcatagtctaaccctgctgcttcagacatacccgtcagaggtttaacgaacgatttttggaacagaacactgtggtcaagccacactagaacttcctgtcggatttcttgtggcagctcagtgcccgatggccatgccatgcatttctcaccgtacgggttaccttcacgcagcgggatgaccatcaccttctcgccttccatgattggtgttataccttcaaagcccgcggtagctcggttatacgctaaagcacctttgacgtgatacggagtacctttatctggatatcccgcaccatcatcatacttaccgatgttgttggcggtcttaacttctgctattactttatagtcaagttcacgatactcagactcaaactgcttataatattgctgtaaagattcttcaccttcctgcagcatacgccgaatagattcttccaacgcattctgaacagcagttggtgtagaactttgctgagtttccatacccatgattttcaggtgcggttctgcataacgagtaccttccatatcatacacgttcagagcatatcgtttcttcgctttccaaaatccaccaatgccgtttgaacctaacggaggacaagaaatagcttcacggtccatgaacattaaatgttctttgttgttcatgtattcacacatctcacgatatgattggtcaatccaaggttccattttcttcttaccgaattggttcaggaattctaccaaatcgttagtttctttgaaacgctcaagacctactttctcaataaccttatcaacacaaacgtaaattgagtcagtatcaccggctactacaaacgaatgtccttcagtaccgcataccttgttgagatattcattaactttacgttcaatccattggattgccatttgaccaaacaaggtgattgctgatgcgttacgtaaatcataataacggaagtaaatgttacccaatgcaccataaagggagttgatcagaatcttacggtttaactggttagtgttacccaagatttcagcgtgtttacattcaaacatcagtttgtcaagacactcttcggtatatgtcagcagttctgctttcatgtcatcagagaaatcttcatagacattaacttctgcgaatttatcgatagttccaaacttcttatcattcagaacctttttaatcagttcttgatttcgtttggcacccatcattttatttttccactctttacgctgataaaataccttcgcgatttcaactggaatgacaccatctacatctttacgatacatccaaccattgggtgaacatgaatattcatcagacggacgaggagcagtcttgttaatgtactcacccagcggatgaagtttaaattgtccaacgatagtttctggtgaaatattaacttgtcggattattgacggatacagagatgtcaagtcaaacgacatgatataacgatatgcagcaggaactggttccttaacatacgcaccaggatatgactgtttaacgtgagaacgactttgcggaataactttgtcttgctctttcagactgttaaagatgattgcgtcccaggttttaatcgggctcattacaccttgatatggcatcttcgcataataagacattgagattgccaggtcaataaatccacgaacagcatcaattgcttgtaccgattcaacgtcgatgatgttatatgaaatatatcgttggtgattagtttcacgcaatttattgatcggaccatcatatgctaatttacctttcttggtttcataataagcaatgaaatccaacttatatgtcggttggttcgtgaaactaaatttcttatacaaatccatgtaatcaagaatagtcacacccatgatagaataaatttctttatcaccatacatgtttgtgataatcttagatgaaaccttgttcagaggagagaaccgtttcatcgtacgctcaccaagaatctgtttcacacgattcatgatgtacggaatatcaaatccttcaatgttccagccagtaaaaattgctgggcatttctgttcccaaagattgatgtactcaagcatcatttctttttctgaattgaacggcatatatactacgcggtcaagaatatgttgtggaacttcatcaccgccttcggaatctaaacgagcagcgagtttcttgtcccactcggaaacggagccataaagcgaatgcagtaaatcaaacacatagaacttatcatcaaccgaatcataatgagtgatagcatcaatttcatattctgctttcatcgggtctgggaattgagatgcagtaacctcaatgtcacagtttgcgattcggatgaattttttattatagacgatttctgaaccgtaagtatcactgatatacgcgagtttgaaatcatccatacccattgcttccattcccatatcttccatacgacgcatccaatcgcgtgcatctttcatggttgggaatgtattcttcttgcaatacttgccatagatgtctttgtactttgtttcttccatgcaatgactaaacataacaggagaatacggaacacgacgcatgcgttcctcaccagtagaatcgatataacgttctacaatgtcattgcctagagtttcaacgctgatataaaattctttcatgggtttcctttgtttatagaccgagttattagtctttagatgggacaattatactccaatttttataaagtaaaaggcccgaaggccttttcttatgcaccaatcgtatatttagattttaaggtccattcatgtttctgcttgaacgtaatgacccggaagttattctgcatctgagcaagagtttgaccacgattaatactcagtagaccccagtcagcaagtagttgtgcgattgagtctcgacgaatttcatcttccaaatcaatagtaacagggcgaccatcaagcttcagcatttctttaaaatgaacaatatagtaacgaccttgtttctgaagaatgtggcagctttgatatagtaccttatctttgttattagcaattcccatacgggttagagtttctttaactttcaggaagtcttcaggctgtttcagtgtaatttcaatcatctttaccattccaatgctgttttcttaagagttttctgttctttcacgtttttcgtgattgtcttgaccaattcatcagtcacaagacctttcattttcttgagagcaggtttaagcttgtttttagcttccagggtctctctatacatcctagcatcaatcgcattgaccttgtaatatgtcattataacttgaagaatcaatgcatcctggatgttttctgttaacttagcccatttaccataccgacgacctctaggaacagaggccatcatatagttatagtgtgcttggtcagataacccttgaccaacaaggttcataacataaaccgaaggcatacagtcagggtgttgagaaagagcgttttcaaccatgaattttgaataatccatcgtcgagatattcaaatgctcttgcttttcgttaatagacccgataattgtgaagaattgattttctgctttttctttatatgaatcagataattcctggactttcgtccagtctttacctaaccacgctatttgatgctcgttatactgatcatcatcttcaaataaactcatcatttccactgcatctctacaacaagttgaataagcatataaaccaagtgtaattcaatcgaagctgctatgccatgatactggttattttcaccgatgatttcatacattcggataatgcttgggccagtaaccattgtatacagctcagaagaaagtttatctacaaaccaagtatagtctgctgcatatttcggagcaagagcacggagttctttgatgttcttagttttaatagcttcaatgacatcttcaattgaaccacggtcattcagaacgatagacaagatacctgcatcaatcacacccttagaagaataatgatcaagcatgttaatggtcttacggaattctgggaaattctttttgaccaaagcagctacaactttcttatcttcaactaccacgccttcattttcacaaattgcgagacaacgcttgagcatctcgatttgcattggcttaacatcagatggagatggtttaccaaaattaattacacggcaacgagactgaagaggtttaatgatgccatcaaggttgtttgcagtaatgataatagtacagtttgtgctatacgcttccatgaatgaacgcagatgtcgttgagattctgcaagacctgcacgatcaaattcgtcaatcacgataattttctgcttgcctgcaatagaagcagaacttgcaaatgcagttaacggtccacgaacgaaatcaattttacagtcagaaccattcacgaacatcatttcagcattaatgtcattacacaatgctttagctactgtggtcttaccggtgccaggagaagtgctatggagaattaaatgaggaatttttcctttagctactaaagctgaaaaaatttctttatcttcagcaggcaatacacactcagaaatagtacctggacgatatttctgttcccacatgaagtctgcttcgtttactgtcaatttcatttatatttcctcattcagattaaagatggggccgaagccccgaaattattactcaaaatcaaaggtactgtctgcttccattgctactacataagaggctgatgcaccttcaaatttcgctgcagtctgtttcttggagccattcatttttgcccacagcatcagtttataatcgccgatagtcattttcatattgctcatgttgatgataaagttgaagttaccgtcaccttcataatcaccgagtgtcagggaatacttcggacgggtcagtgcagcgtcttctactttattataaccgcgcagaacaattttaccatcaacattggtgatagcaattgtgtcaatctgcatgccacgagatactcgcatcagctgttgcaggtcttcacctttaaaatcgataattacgtttgccaccgggaatgggattggtttagtcgggaacacgattgtgctcgggtcagctgctggccagaagatagttgagcgagcatctttaattgccagattaccatcttcctgcatgataatatctgcatcatcaccaaccagagacagaatgctcagaaaactgttcaggtcataaattgctacatcagtatcgatggtatcagaaattgttgcttcagcataagtcgtaccattaacagcacgagtcatgataaaattgccaggtttcagcatgataccggagttgatggtggagaagtttttcagaatgttcagagtttctttagagaatttcatttcaataccttttaattaagttcaggataattatatcaagctgcgaatgtagcagttaattcttctgcaacaatctgacctgccgcaacgagttgctcatcagcatctacgcagtaatcattttctagacgttcgccaccatgacggtcagtaacaattttagcaccagccttgattgattcgttgtaatgcttacgcatcagttcaatccatttttctgcgacttcatcatcgatagatttatagaaagcaaagcgagcttcggaatctttaatcttatctttgatagcctgtttagtttcttcggtcagagccagaacccaagacttacgaatacgattttggttattcgggttggaatctgcacgtacgtttttaacctggatatctttcacatcaacaaaattaatcattatatttaccttaatcgtaataatcttcaaccatccaaccgggattcctgctggacatgactctattatattcatttcctgtaaaagcgtttcgtaacatttcttcagttacgagatgttgctcattagaaaacaaattaattaacacatagcgctttaattcaggaaaggccaacagatgttggcccgtagtaaactcattcattccatcaccgtgaatcgtccgaccttcttcatttgaaggtgttggccatatgcctgcgggtcgtggtcacggtgagaaataataaacacattagcatctaccatcttattcagaatagcagttattgccttaacaccttctgcgtcggtagccgagtcatagacttcgtcaaggaacaaacagtttattttaacaccagaaaccttttcagcaatatcacgccacgtgaatagtaatgctatatcaattcgagctttttcaccttgactaaacgaggcataactaaattcttctcgtccacgtgatttaatcgtttcagagaactcttcgttcagtgtgaacgaataatcagcttccataatttttaggtagctgttaatttgcttattgaacatcgggatgtacttcttgatgatagctcctttaataccggagtctttcagcatttcagttaaaataccacgacgatatttttccataaccaaattagttttgacgaggataattttatctaattcttcttgtagcagtttaatcttgtctgagttatcaataaactcctgagatgctttatcaatagctgctttaatgcgacgtgccttttccacagcagtgatagtcatttgctttaaactagacatttgagttttgatatctctggcacgtgaccggacagtgttatactcgcgagctagttcatccagttcactctggcgcgtctttaactcaccaagaatggtattacattcttcaacatgatgattaatcttagtgattagagtgtcattagaatgcaaatcctgcaagcacgttgggcaatgaccacctttatcatacagtccaagaacctttgaatatgattcaattttagaccgaattttaaatgttttaccttgaacttcttggattgactctgctgggtcgtctccaattactaactcaagcagttctctctggagagtttctaattctgctttatatcctcgtgcctctttcacctgctcatcatacatcgcctgcaggcgagctacgttatcaccagaaagtttcttctgcttttctgcatactcatgatgagttttaatttcattagtcaatgcttcacgctgaacatcattaacctggatttgctgattgatttctcttatctgtgtcttgttcagtttgtccatatcagctaaaagagacacttcaagcaaatcttcaacgagctttcgtctattagcagttgataaccccatgaacggagtatatcctgccgttcctaatacgacaatctgcttaaacgatgtgtatgacatgccgatgagactttcaaagtaagattgaaaatcctttgaacttgcggcttcatcaagcttattgccatctcgtaaaatctcaaagacattcggtttttgtccacgtttaatgtagaaactatgaccgtcatactccatccacagttctactacagagtccttcttattgaaggagttaattaattgacctttcttaatatcacggaacggtttaccaaataaggcaaaagtaatagcttcgagcatagtacttttgccaccaccattcttacctgtgattaaggtcttttggcatttatcaagttgaatgtcaatggccgcttggccaactgacattatattcttatacttgacacgatttagtttaaaagtcttcactgattttgtgcctcaatgtataactgtttagacataacctttaaggctttgatatcatctgcggacaggtcttcaagtgcttggatatattcttccattaaatccaataagcttttaacttctacttcttcgccatcttcagactcaaccgagttgtcaactttagaaacagttcttaattcatgtactaccttttcaagttctgattcaaacttaggaaggtcttcatcgaccgcagtgataataatgcgtactgcgagattacgaaactcttcaaagtcaatttttccagtaacaggataaatcagttttctatgccaagtgatttcattagggacgaaatcaaaggttgataattcagtgtcttgaacccagaagccacgtgggtcgttctcgtcacccgctgtaagcgtccaaggcgttccgatgtacttaacgtttgctgcgcttgatatggtgtggaagtgcccagaccatacttgtttgtactttttgaggaaatctggttccagcccatgagacttcattcctttataaaaataaaagccattaagctcccagtgaccaatacagtattcagcagacgattctttgatatgcttcatgatttctgacgtgttctcttcacacatccatggacacaagtcaatcaaagtcccatcaaaatccatagtcacgggcttttcaataacagtaatatgcttatacttaccaagaacttctgttgatgcattaggcgtcaacgtattcttgtagtgcatatcatgatttccgacgatcgtaattaagttaattccttctttctcaagagactccgcaatttcacgagcgaattccattgtcttatgagtgatagctttacgaacgtcaaaaatatcaccgtattgaatgatagttttaattccatgctttttggcataatcaatatgctgcttaattccgtgtcgttgtacatcctgtacccacgggtcatctgcgcggacacctaaatgccaatcgcctgagtgaataattttcatataacctctctagtagagtttaattttatattattccatgaatagcaaaaagggcccgaaggcccattacttattttgtcattaactcaaattgttctttaaagcaatgctcagaatcttggtgttctaccaggaattcaaatgctttatttcgctctttatcatagagcttctggtcagatgacagatgtttcattcgttcaaagacttcatttttattttcatcattcaaccacagaatgccagaatcatgagaagtcaacggctttccatcaacccggaatttcaaagcatcaccagtagctttatggaacacaggaatagttccacaagcgcctagttctaaatgcgtgtattccagcgaacgctcaaggaatttatctggaagacgtgacagctgataaccaaatccagactgagacatacgctcaagcatttcagagttaacatatcggtcaagaacttgaggattcagacctggtccagttttaacctgatgataatgacggcaataatcaatttcatagcgttctttgatgttaataaatgcaggactgcgttctaacccttccaagatagtcgttttgcctgcggggcgcagatgactttcatgaaagtcaaacatcaagaaatagcctttccacgtagtagtacgaccaatccaacgatgaatatcaaaatcaatagcagagaagtctttccaatacttatcacgaattgctttgatgttcatagcaggttgaaagttataaaccggaggagctgagtcagaatcatcaaagaaactcaacccgccgcttggaaaatattcttccattagcacggtattaaaatcgccgtttgagctatgactaaacagtacatcagcacgcttaacggtttcttcaagaccagcatttctacgaagtgacaatgctctatggtcatgttgatatacgactaccctaacttcaggtttaatgttctctatgagcttcttatagttatcaatcgctgcttctggagcattgatagcaggtactgagttaatgataagaatgtcacatgcgttaagcagagataaagtcttatcatagtcatctgcaagagacacaggaatagttacatctttatagctatgtgctctattacgagtaaacgctttatctttagcgtaaatgatatttacttcatggccatgttttactaaccactcacggtgctcgagactgaacttggttacgccgcatccctcaagtccgcgagccattaaaatattaatcttcatatgttgacctttgttgttaattttgaatattttaccattcccgtaataaagcaaaagggccgaagccctttaaattttcttgtatacaacataacccgctgcttcacatatacgcttagcttcttcaaagcgtctaagcatatctaccttagcattatgaatcgcttcataatcgggagcaggtgcttctctccgagcagtatcacatttataacagaagtaactacgctttggtcctgtataacgttctgaacaattactgcaccggcatgtataatttccttccggccaatcatgtccaggattagaacccatcaaattcgtcatacatcccaattctcttcactagtaataaaatcagggtgttcatctaaatcaatgaatccccagttctcttcatttaccattcataccaccgtttaacttggaaggtgtcaacccagacaagagagttcttatctattagcttacatccttcggtagagcctaacacgcgatattgattatctgctacctttactgccatcgtaccagtcgcagtgtttaaagtaaatcctgcgtctttacgaacacgtttaaattttacttgtaccagcatttagaatgtcccaaacagatttacgagaggtattccaacaagtcagaataatctcatcattaaaaggttgttttaaaatagtacgcagtttttcaatagcatacttgtaagcagggaaattattgtctaataccgcgtctccagcatgagctcgtaatcgctcaagttcacgacggtttttacgaacaactttgttggctcgagcaatagcttgttcttctgccgcttccattagtttctgttgcagctcgtcgcgctcttcctgggtaatattgttcatgttattcctttggatggtaatttatttcaaatgtgaattcagtatcagtccaattataactgtgttcaattatagcagaatctgacctgaaatcagcgtcatgtggatttttcgggtcaatgtgaatatcaagatcaagcacctcccttaaatacatctttagcaaataagggatagcgtctaggtcttgcacatcttctaaaaacccgtcgaggttaatcttcagcctcatataaaaattccagattaggtccatcgcttgtaggttcgctctttttagcagaccctggcgccttataagcggtggattcatactgcgtcattttatcgtagatgtcctgaataaaggtttcatctgctaacgcaaccatatcatcgtcccgtgaatcatacacgttgtggacaaaatagctgtatttctttgccatttctttgcgttcttttttgatacgctgaacgaatgcattgaaacaagcttgggttatatacgcatgcgggttatcatacttagtttcatcgaagttgattaagcctttaattgcggcttcaatcccgtctgaaatcatttcttgcttccaggattgggtgtatcctgaaaagttgaaacgcttactcagaccttctgcgatcagcataatagcaaggccgatcgtatcgttctgttttactactcgaggaccgccagcagcttcagactcccgacacttctctttccatgcacagattgatttatacagttccttgttatttacataattactcatattgcctcttcgcttcaattaataatatctattataacaaatttgggaagcgagaggattaaagcattacttaatcaattcagcgcatgcaattaatttcatcatgatacgataaaaatcgttatacgtgaaatctaatggaacatcaatgacggcttcaaaatcttcaaatacacgctccattccataaccagcgatatcatctgattcagcataccagtacgttccatcttgtgcaaaagttatttggctattttcaagacagaacacacctttaatattttcatgtgtaagagtcaattgaattttcatagttcacccttcataatacgatagcattggaacagctgttccatgatacgtttgaactcaaccaaactaagttcaaaccaatcagattcatctacttcatgcatcatttccatgaatgaagagtataaactttcataatgggtttcatttaacatagaggcatgcgtttcccaatacatgccctcttcattgtcaaaccaaacacccatataagaatctatagtaaatccgccaatgccttctactacaatcataatttggtttactttagccatgctttcaccgagtcaatagcatcttcaaatttagagaaagcatccacggatgtgtattcattctcaccagagcgttcataaatccaaaacgcgtcaaaatcttcttcaatgatgaattctccgttaggagtttcaatcgtgtttctgccatcaggcgttttagatataaaccatccaagaaaaccaacttctacaatttgttcttcagtcatttagaatttccaccaattgattatagtttaatgcctttccagaagaaatcataacattacaaaatctgtataatgcttcttttgatactttatacacataatcagaagttgttataatgtatgaaatacgtacaaatgttggggatttttctgccaattcatacgccagttttctagctctgccaatatcatcggcaaacttggtatcagcaagcaaaatactatcaaatacccaacggttagtaaaaatttctgtgtatagaataaccttacgcatcaagatactctcgcagttcctgctcgtttaacccttcttgccacatctctgacggagatggaagttggctgtctagagtggatgaatcaattggaaatactctgataattacgctagtatcttcatcccattgatttgcgagtatccgtttagcttgactaatgtcaggctcagaatgagcccggatatacttaatccttctatgccatacaccggtaggaatagatgcgcacacgatatatgaaatcatttagccgccttaaccgctttaacatcgcggaagcctttcttacgttgattcttcatcttacgaatagtgctttcagaaatttcaccgatacccggagtgattggttctacaccgaaggctttgatgccaaattcagacagaagataagcaaccactaattcacggatgcgggctttaccaattttttggccttcttctttcatcgtaccgtgaagctcaacttcccactgatcaagcaaagacggagttacacaacgtccttcttccagcattgcagatactttatcataagcaaaagagttcagtacgtttttgattgcttgggacatattaatttcctcagtaacgattgttttgacagaggagattttaaatcaaatctcctgtagcaaatcaatctttgagagattttaactcttcgagcatatcgtagtattctttactagcaaccggagctacagtacagtggtagctattgaattcatggtatttcacgaagcgttcaagttgccactcaatcaggttgttaattcggtgaagcagaaccccctctgaaccgacgtagacaactacttcaaattgaagcccatcccaaattctggtacggacgatatcacctacattaaatgttttcatgcgatgtaccaatgttcgttttgccaagactcacccttgtaccagcgagtcatatcatatccattttcatcacagatgaccttgttcttcatcaagaagtattcgtcatcagtaaaatgcacatgctttactttacagcctttactcatagcttctagagcttcttgccaatttaaccagttcatattttcctctcgagttaaacggtatgctgttatccgttgatagagctatagtatcactcatcaactagcttgtaaacaactttgtgaaaggagtttaaaaataaaagagaggtcccataggaacctctaaatgaagggtatagaaatatacagaaggtggtcaagatgaccttagaaaggaactggttaatcttctatgatatctgggtcatgcccagcagcaataagattggttttgaatgttggaatgtcatactgcttaacgttatccataaaaatgacaggataccgaatagcaagcgatggatagcacccgatgcgtttagcaagtgactcaatcaacggacggtcataaaccggttgaccgtcaacctcgttgattacgttataaaactcatacggaagttgtagcttatcgagcaagtcacgaactgctttacatccagggcatctccaaacttcttccgggatgccatagatttctatcatagttcagccttaatctcagaaatcaatctttcaattaattcaagtttatccgctgtagtcataggataaattttgtcaacagtggcttcttcgagatagcaacggtcagcatcattgagtatacaccactgatcaaaatcatcagcatctatgctaacaccgttgaaggtcttaactcgttcaacagacccgtcctgtgtcagagctgttaccaaaaatggcttaaatttaagcatgttgtagaattcaacatcctttgacgatgcgttatttagccatttatcaacagagtcttctttaaacttgtaccacttatcgcaacaaaataattctatcatttcatgacctgttgaagtttagcagtcagagtattaacacgcttctgaaattcttcattagacagtttttcatctttcttagtaggattaatccagtcagaaataatgatgagaacaataaatggaatagctacgaaagcacctgcggttaatgcaaccagtgcaataacattagaaataaatttacgaatagcattaatgaatttcataattttccttaaatagttaagatgaatgctgtcatagccagaaattctggtccaaacagttcagtagccatgtggttcagagtaaacataattttgtaagtcagcatataaatttcctcaatcatgtgtccaggtagaaccgtttcttacccagagtctttggttgtcagaaccacgccagtttttagtagttggcagtgatttctcatatttcccatcaattataacatcgatgtgttgtagcaaatctaaatctttgatatcttcaaacttatatcctgtccacatccagatatctttctccggaaatcttgctttaacccaagaaactaaatttgaaatctcttctcggttctgtggataaagtgggtcaccgccagttaaggtaagaccttggatatacgatttgcttaagtgagatgcaatttctttaacggtattcatagtgaatagctgtccgttacgagcattccaagtagatttattataacacccttcacatttatgcaaacaccctgtgacaaaaagaacgaccctgcatccagggccgttcacaaagcaacatggatatattctatcatagttcatttatatatttccaattatagccttcaacacttttgcgttctccatttaaacattttaaaatatttcctttactagaaatgttaaaatatttcgcagcatccggtatatagttaaatgtttttaaaagaacaccgtttttatatgcaccaaatacattgagagtatatttttctcgaagacgctggtgctttcttttcataatttcaggattttcatacgccagctttaatgaatttttgtgccgctcttttacttcaggcttttgcattgctagcttagttaatctagaaattttgcttctaactttatcgtctttcattgtatttgataaatttaataaagttttatttctaacttcaggattttgcattgctagcttagttagttctgcatgtctttttctaaaatcatcattcttccacatggtcttagacaattttgacatagaatgatgaagcagttctctttcttttgaatataatttaagaatttcatccaattcgtcagtattaaatctattaacgtttgagtttatcattctatgaaaggcataacacattttaccgtttccagtttttgccaaataatagtgagctaacgcatggtcatagtatgataagttaacgatattccatttatctgatttatgctcaggaaatatagatttaggaagcacatggtgtgcttccgtctttccttttattttagaattattgtaatttctttgtattaaagctgtatacgatagtaaatcgttgtcatcttcgaatattgaagatagcttatcattcacaaaatcagaagggtagattctgtcgaaattcattgaaccttacctcattacgtgcttctacttctgcatcatatttccagggctcatcagtttgaatagccccagccgataatccactttcggggtcacgggttatagcaattccaagcgggtgcagaacctctttgttgattttccaaatcaatccccattcgctaagttggttccaatcaacttgcttcattggtttctctaacatgttttaccctatgcataatttctttgttcttaccaagattgaacccacgctcagaaggattaccaagatagccacaggttctgcggatggtattcattttctttggatcagtttcaccgcaaatcgagcaagtgaatccattttcagtaggtgtcatctcatgagtagaaccacaagaaagacatttatctactggcatattaacaccaaaataatccaacttctcgatagcatagtcccataccgcttcaagaccttcaaggttgcgcttcatgtcaggaagttcaacataagaaatatgaccacctttagcaatagaatgatatggtgcttcgcggtcaattttttcaaaaggcgacaggttttcttctactgacacatgaaaactattagtgtaccagcctttatcagttacgcccttaacatcaccaaacttggcttggtcaatcttacagaaacgatagcacagactttcagccggagttgagtacagactaaaggcatagccggtttcttccgtccacttgtttagcttagtgttgatgtacttcaggacgagtttaccgcttcctttaaaagtaagcatatcaaattcgtggatgccaatatatcctaatgaaattgaactacgtccatttttgaatagctcaagaatttcatcatcaggtttcatacgcacaccaaaagcaccttcctggtaaagaataggagcaactgacgcagtaacaccttcaagtgatttaattctagttaaaagagcttctttacaaatatcaaggcgttcatccagtagtttaaacagtttattactgtcatctgaacttttataatttgcatccagagctatcctagggaggttcagtgttactacccctaggttattacggccatcaagaacgggtttgccagaagagtctctccaagcaccaaggaaacttctacagcccattggagatacaggagtttctgaacctgtaattgctctattatttcgagcactgatgatatcaggatacatacgtttagctgcgcattctaatgcaagctgcttaatatcatagttcgggtcttctttacgtagattaatgccttcttctacaaacatcacaagctttggaaagattggagtaattccatcgcgacctaatccacgaatacgattatcaagaatagctcgttgaattaatttttcttcccatgacgttcccataccaaatgtgatagtcacaaacggagtttggccatttgagctgaacaaagtattcacttcatattcatatgcctggaaagcatcaaatacatctttctcggttttagaaatagcgtaatcttttactagagctacttgatatttgcgtgcatcacgtacatgtttagcgaatgtcttctccacataaggagccaatactaaatcgacgttagcaaacgtagttccaccatactggtgagatgctacttgtgcagtgatttgcgccatgatagcagtagctactccaatactcttaggagtttcaatttgagcgttaccaagtttaaagccattctgcaacatacctttcaaatctactaagcagcagttagtgaaaggcaaagctggactatagtccatatcatgaaaatggataacaccttctttgtgtgcttccattacagagaaaggaatgacctgattggcgatatgtttagatacgataccggccatcaggtcacgttgggtaggaaaaacacgagaatctttgttggcattctcgtttaaaaggtccttgttggttttattaataagtccctggatttctaattcgatattcattttaaactcttacgaagctgcttcttgtattttgaagcaagttgtgattttccatcactttcctcgtatgtaaacccatgcaattccatttcagcaatcatctcaggcttaccaagacgtgaaaagcgtttagccatatcggcaacatattgcgggtgaatattactgtctttacgattctggcggagatagaccagcaaattctctaaccattcgaggtagtcaatatcttgaccttttaaaccagagcggttgaacttatgcttcatttggccttctgccgcattacacaggttacagagcaagcctctgacctttcctgcattgtcaccttctaacgcatggtcatggtcgaggtgattcttttgaatatcctcatctaaaggacgtttgcagcaaggacataatccgttctgtgcctgatatagtttttctttttcttctttatataacttaccggttaataacatactcttacctcagcgattagataagagtatttatagttaaattaacgagtaactactatagatgttatgattagactcttttatgcagaaagaagtacagaaagcatagatgccttcataatcatccgcattgaactcaatatatgaattagtttcttcatgaagaagactcattttagtccaagccattccattgatgtcatcgtcgtaatagcctccactaaattctactacatcgccaacttcataccaatgactgcgtaaaatttctcttgtaacacgatgaatatcagcgaaatcgagaatttttactgtaatagttttagtaatgcacgatttagacatggcgaactccaagacgggtttccaatgcgacgatgtaatccgcggctttttgcattaaagcatactcttctgaatcacaattttcctgtccagcaaatgcgtaaagagctctggtaattggaacgattgcgccttggaaatggttaagtttaatttcagaaatcagaggaacatcttcaccttgaccgatttctttaatttggtgcatcgtatcttcactgtagaagcaccagaaccaagattctccgtgtggagttgggtcgttaatagtaatgattttgtttgtcagcaaatcaattacggcagtaattccacacatttcaaggtcatcttcattaactacagaaatgacttggaacttaaatcccggaataaacacaggaaattgctctgttaattcgtcatcattaataatgacttcaaactgcttaccaataagtcccattcactttgtcctcataatcaagtaattcatttatagtgggttcagaagtattataatcttcttcaggaatagcatcttcctctggctcgacagtttcccagcgagccgcataccagggttttagacctttgctactttgcatggtgttggttcagaatcattagcagaatcatgttcaatacgccattcaacttcagtgcgagtaaccactttttcatgacgtgtaacgatatctacttcaggaggactataataccaatcagtatgatatgagcctgaacgagattctgataccatgaaatgaacgccacgcgctggataataccaaatttgagtgcggtcttgatacttgtgctcttgcgtccaatctccatcttctactaaaacaaagatttcttctgcatcatcgtctggtgcattaggcggatattcgaaatcgtagttgtcgtcccaaccgccagtgacgccagcgatatgtttgatttcttttactaattcagcgttagtcattttaacctcgcagcttctgtaaatcttcatcatcaatccagctttctaaaccggatggaagcgcacattcaatttcccacagcaattcttcaattgcttgcaagcgttcaagctcttctgctgaaatagttaccatgcgtggagcttttaaatcgccaatatcataactcatagttcttcctcatgttaatcataatttcaccatacactcgccgtatttccatttagacataaccttaactccattagagtaagttacctctacctttgctcgatgatttttgatttgtttaatctcaccggtttctaatccgccatagccataataaagggctacaatatcaccctcccgaaggagggttccacgataatcatgcattgaacttgaatttacggagttcatcaaaaccgccgatatgtgtaccgtcaggagcaaaaatctgaggcatagttaatccaacctgtgattcacgacctaaacggcgaagcaaatcactgataaccacttcatcaaatacacctttttctggcattacattgatgaatgcatattcttgcttcttaacgtcgagcagacgttttgcgttatcgcaaaatacacacttatgaatgctgctgtcgtaaccaaaaaccgtgaacatcttcttctatttccttaaatacttgagcttgaactgttttccaatctgggtggcgtactgctttaacgtaatttgtcataccaagacgcttcattacttcgccatcaatagctgcttgagcaaaatttcttccgcgggtcatagctcctttgagtttagaactatcaactatttgaccagtctcattataataaaccgaatacatgagtagcattactcgttcggcttcttccatatatcgtttacgagccattttcagccttagtagttataactaatgttttaccatctaacgcatcgagaatatctttgatgcaattatctggcattggttgaacgctagctaattgcttggcaatatcatcaggaattcccatacgtggtatatttaatttgctaaaatcaattttatccattagcagttaccgggaagtgttctgccaatttagcagcaatggcagcgttaatttgatcagcgaaatttttattcattgcattaacaatgatttcttgaattcggagattagctctttcaatagacatcttaatacgaccttcagcttgcttaacagcgtcatcaatagtttgacgaaccatatcatcaatagcatttttagcgcatgattgggcagcgttacgcatcatctgcgacatttcttctgtagcagacatatcattccaaccgcgagtatggaacatctgctgaacttgcttcttaacttctgctcggacatctggaatagtcacagcagcaatattaacttcagattgtactgcttgcttcagcttattctgtgaatcttttaacaccatttctttaacgatgttattgattactgactgttgcagttgagcacgggctgctgtaccttctgggaataactggcgtactgcataagtatcaagtttaatatcaatcattttacctttttcactccaggaatattagagatagtttcaaatacttcgtcaaagttatctttatcaacagtgactaccatagtgcgagcggtctgtttctttttccaacgtttaaagaaagttgcaagactcaaatcatgggaagtgaagaaatcatcggttttgtaaacatatccgctttcaatttttactacagcatcaggtgaagggtcttcatattcttctacttcaacatcatcaaagagaattaaagtatcatcatgataatagccttcccagaaggcttcatcgttataaaattctttccaaagcgcgccagttgttttcatttaatcaccttcttccaagcttcgtgagcagcgcatgctaatacttcatcatcagtcaaattaaacttgccttcattacgacgagcaatcatttcattgaattcagtatcagttctaagcatcatgttaagaactgtaaaatccattgtcgctcgaagatattctttaagctgcatagggtcgatgccactttcgtatgcgtcaagaatcatatctgcaatgatgttatcaaagtttttgtcttttatgaggttattagcatactcgacaaaaaacttagtattagcaccagtaatagttttagtaatcattttaattttctctcaaatttatgcttacaagtccggcatttcattttcagaatatcggttgtccaatcgacaagctgtacttgaatactaccacatttttcgcaaggcacaacttgtttagctgcagcttctcgacggtctaccatttcaagacaggcatcccagtcaattttaaattcaggtacaggcggatactcaaactcaatttcaaggtcgttatcatcaacgaccatgtcttcttttaattgatttttcacagtaagctccgggcatactcgagagattcataacgctctttgtattcgttaagcgatttaaccaaatctgccatcatcaattcatgtttagccaattcagcttctttagtatcaatgaaccgcttaacagattccatttcaattgcaatagaattcttagcaatttcaatatgatttactgctgtcatctgtaaaggcttaacttgagctaggtacatatgagctacatcggtatcaatgacatgttttgtcattggaggaaaaatcttaaatgggtccaaatgcacttcaagagtagatgaactttcaagaagcattttgcattggacttcttttactatatccatatgatttaatgcattacgaacctgagccaaaagagcacgtgatggataatttccactagtccaatggctattaatatgaatacgtactgttacgttgtcaagttcttctgcgcgaatactgtgaatccctcttggatttttcggattagtagatacttggtatttcacacgatcagtatctttaagcaaagaaattgagcgattaagaatacggcgcagattgctattgaactcagtacagaaaatccgcgaagcagaatgaccaaattcttcatcagttttaaatgatttagacgcaaaattataacgataagatggaattttagtgtctccaacaatgaattgcttcagttgttcagcagcagacattgcacctaaccaacgagagcgacgaatattttctacaaagaaactaactacattggattcgctagtcgccatattatctagagttcgtttggcaaccttacccgcaattgctacatcataagcccttggatttaaatcatgtaaagctgataacaccttaacatgtttctcacgcttcgtgagagttttatctttcaacttattaaattcagcttctacaaacatctttaattcattcttattcattatcttttcctctattttggactgggctcaaagagtatctcaaaatctccctgaacccattatacaacaactattcatcaagcataataactttgcttggacgcttatagaaagcatgagttttatcatctttcgctaattcaaatgtagcagtaaactgtactttgcctctgtattcaaacggaatactttttggaagggagccgtaaaccgtagctccattctcaagcacaaccatcatcttacattgtacgccgtaatagtcttcataaacttttactgacgttactgtaccagagacggtcactcgtccttccggtgcatcccctttattcttattcagctcattgaatatattatcaaagacctcttttgaatgttcctggatagcctctaagatgctcttatgagctctaacttctgccataacaacatctgtgccatcttgcaatttccactctttatatggaatgcgtacttcaagaggataaccatactcccgaagttctttgtactcttcttgagttaagcggattttccaccaaccgtggtcaccggtatactcaggcttatccagtgaatccaattctgtaacatacggcaagtaactgcctgcgtgataagcttcaacttcacctaattcattttcccaaagataaccatcaaagggagcatgaggacgatcatctttgccccaagtaggagctaccactttatcaaagtattcacgaccgaagcgggtcttcgcccatccagcattcaactcctcggcgcgtttttcaactttcgctcggtgtgcttggcgggctacacgattttcttcaacaagtgcagagataatctcggttaaagttttcattttattctccagtttggttgacgagaccatcttatcaacagcctcgccgaaagtaaactactttgtgaaaaattttctccaaagcagaactgcgtctctacgagatacttctactgctcctagagcaactgcttgcttgcgacgaacatcacacaaatcatagtgtggaactcgcttatcctggaaccaagaacgtttcattccgatggcttctgccatagcatgcaactcatcaagattgtcgctaaacatgtggcagttctttacttgatgacctctcattttccaaccatgattcatcaagacatctacgtatactgtcatttatgattctctatgtaagtttcaatgatgaactgtgctaaacacagaagattatcttctgaaggagaatctactaaattctcaaccatttcagaaatagttccaaaagcttcttcagtattgaacatttcttgaagttcgttccaagtaggtgctttcatttcaatctcctcattagttaacggaagctatcttatcatggcttttctaagatgtaaacaacaaaagggcccgaaggcccttaaaaagatcggaaatcactgttaaaccatggcgactggtgttgtcgccgtttaagcaatttcagttggtgtttcctattgtcttctataatcatcttagaggcttttagctcttcagccaatgagacctgtttacggtccatcaagatgaggttctgggtcttctgggcaaatgtctgaatatctttaaggcattccacagattcctccattcctcgcttatacttggttcgggcagcatttaactgcccttcgtaatacgcatgtatagacactatagtattaaacatgggttaccctttagcataattgacgatttgttcacgatcagcgggccaatttaaatcagaacgtttcttgtttgaccaagcaatattttcttcagcccaatgaagtttagccgatacgctcttttgtacgtctctgatggcttcttcaagataaatgcctaaatctctcgggttagttccttgagttttaaatgcattgagcaaaatatttcttacgacttctttaaattgattttcaacttccgggtgaataaattcacgataaccgttgcacggatatccaaaagcatctaccatacgagtagtactaaattctttgttcataatccgagcgcctcgcgttcatcaggatttaatttagccaaagcggattctttaattttttccaaccgtttacgcttagcttcaggtgtttcttcctgaacactaatagcagcgcttttaggaaaagtccacgattcaccattttcatcggtgaatgtaattagttccgttggcttacgattaactgtaccatctgagccccaccaagactgccccttaactgcttcttcggcaacgcaatatgaaccataataaccaaacaactcactacgacgatcgtctggtgaaacatacgctgcataggcttcactttccgtcattacccagtttttcattttagcacctcataacgaataagttcaatacgatttttaagctcttggtatgatttacgccaaggcttataataggcatttaaatcttggtgttgtttatgcatttcgtctaaatgctttactgcatcctgcacatttgcaaggaaagtatcaaatactttattagcgtattctttcctgagctcaatgaatggaggagcacgaaatacgtttaccattacacgtaattcatgataagaagaatggacttcagctaatacatttttcttatcgccaaaattaaacttataaagtttttcacagattgcttcacaagctttctctgctttacccttaggtttacctgcaaagatgtgtcccggtggatatactttaatatcgtttaaccaacattcaatatctttaatagctgctaaactcattgtacccacgctccgttttcatcaatgtaattaatccactcgttaatagtccaggaagaggtattacctttaggagtatcaacgatatacattccgcctttaaacaaaacacgttttacatcattagaaattaaagtagccattatattttcctcagttagggaggagaaatcctcccgtttaaattatttcagcattgttacttcagcaatttcacgccagtttttacggtcagtcgcgacgaaatcaccgatataaagagcagtacggagagatacgttacgcagacgatttacgttatctttcataaattccaaaacttcaataacttcagaatttcttaacccacggttctgtaacatagaagtggtcattattacatcttgaacacgaaccataatctcttcattagtgtgaacaccaaggtcaagataaaccgaacgtgataccagagcttgaagatgcggagcaagtttagaaccacgctctaattcacggtcaatatcaacgttagtgataaagaccacagtaccttcaaactcaaactcattaggaattcctttatcttccaagaaagaagatgcagtgctccagcatactttacgtttctcccctgaatccaaagcagctttcagaaggttaagaatgtccatatcagagaatacatccacatcatcaatgagcagaactgaatttgcttcacgtgattcccaaagacggcagtataaaccaattcctgagattttaccgttcactgatttgtaatcaatagcgttagtatcatgagcatgttgtaatgctttatccaaagagtaagtcttaccgatacctgctgctccggagataatcagagaacgaatattcccatgaattaaaccgttagtcattaatcccatgacgttaaagcgtttcttgatacgctctttcatttcatcaacggattcaacaacttcaatcttagcagctactccgtcaattacgatatcatctttgaatacccaaacaccgcgctttttaccattcagttcaacaaagactttaccatcaccctgacgagagtcttcagcacttaagctatccgggaaccactcaccgagtaactcataagtacctgaaatctctttgccgaagtaaatccctttcttgatggtgatagttgacattttattctccgttactctgttttgttttgatggagctatagtatcattctacagctccaaagtaaactactttttaattatttttctaaaatttcattgatgtagtaaggacggacctttgaaccaagatagaagtcatctacaaaatcaatcaagttgtcagtttcaccacggatgatagcaagcttagagaacacttctcccaccatcattggttcaaattctacaccgtgagcttcagcagctttaaaggctttatcaatgttgtttacgacgatttctaaagttttcattttattctccattgtatctgtttgggtggtacaggtctatagtatcactagctcgcgagcttgtatactactttatgcattcttttgaaacaaaaagaggagcccgaaggctcctcagttatgcgtgcttgttgatagcgttttctgcgatacgctttggaagtttacctgcccagcggaagaacatgataatcgctccggcaataaacgcagggaaccaaaagatgagataaaaccaatactctcctgctttctcgatggttccatttttgattagatgcttacagacagaccaacccacgataaagtaaattattgcaacaacgattggcactactacgctccaaagtaaaatcatatttcagcccagtaaagtgagaaccggagctcttctccggcccatgacataaattggtggatttgttttcgagttggtcgagcagagaatttagcattttctctacgaccagtctctctgcaaactgcttccaaataccaccgtctacctttatgaggtcttccataattcaagaagaccttcattgtatcatttgtagtaagaattgtggttttcaagataaaccttctcgacgaaatcgtcccagaacttcatgtctactttcttaggcattccattcttttcggcttgatgagctagaatttctacttcatctactacagactcgagaagctcctgtacttctttgaacggtaactcacctgctttgaccatcttgaccattttagcatgggtcagagggaattgaaggtcaccagtcatatagatttcctgaagctgcagacctgcacgaagagcatgactcagtgctttccaatctacaccttcgttagcttctgccttacgagcacgttcaccatattcagcatcaagcttctcaagggagtacttcatctctttgatagtgatagtcgtctggaatttacgacccagaacgttataaaacttctgctcgcctgatttgtggtcaacgaaggtggtccattcgaggaattcaccgagaggaagtttctctgcgatatcctgtactttccaacgctcattgatacccttctgctgaggacgatcgtcatatttccattcaggaacatctctgataacatccaggactttatgcaggtcagctaaacgagaacccttaacaccatacttacctgcttgcttacggacatatccaagataagccttcatgtcagtagtataaaaacgagctcggttgtcttgaatgaatttccatacttcaggaaggtcagatgcaactaccaattccggtggagtatgcagcatatccaacgcgacagtttcaccgtcagcagcgagcttgaagaaatactttaagctgaacagctcatggtcgacgtcgtctttcgtatttttggttgcgctgttattagtattacgattagtatgattcatcgcttgacacaacagaacatcacgcggatgaggtacaaagatttctttaaaatccacatctgactcgggagttgaagtaccatacagatgtgaaccaaaataagattttacgattgttttcataagtaaatatgattccctttagcgaatttaatcaaatcatttgaagatttagcacaggcttcaacatgttctttatcagtactcttcttagaattgcgatgaacattcccgattttctgcatagtatggtagtatactacgtcatggaaatgatattcttgaccgtctggatgcggttcgcggcgggcggttttaataacatgtgtatcatacataggaactaatgcccaatcattcccggtattaatgattgctacttggatatccattttgttccatttaaaggcattaacatatccaagaacacgatgaactcggtcaaacattgcgaatttgatttcagaagagcttgccattttcatctgcttaagcaagctcatagagagtttctttttggttgttacgatttcaatttccataacccaccctcataatatatgtctaaatcaatgttatctttgccgctgtacttgccagtcaaaggaataaatttaaccgtaatcttttcgccgtcatcaaaagtaaattcagcaataggatatgtagaaattataccacgttcggttttagcacgaaagacggcccgaaggccgttcacgatataaacttgatcattcttcactagttttaccttctacataatcaatcattgggcagactttccgcttacgggcttttaaatactggacaaataccgatggttcggcttctgcaggaagacccgcttttactcgagcaagttttttggtatactgtttcttattgcgatagcgtttaaatttttctaaaccaaaaataaatccaaacgctatagctgcaaataaaagcacaaatgctgctataaccactgcgccaactggtactgctacaacatttagccaaaaggcggataaactaacacctatccaagcgagaattcctgtctctgccacaatcggccaaccgaacatccatgcaatagaaccaatgaatatagcaattgctgaagagaacagaatatgaagtactgtggtccaaaagtatccacatagagtttttggcattttccatatattgccagatttaaaccataggttcattttgaaatgccaagaatttttattgatattcattataagttatcctgtttcatagttggaatcattgcggtaagatatttgaccagttcaatagcgtcgcttttatcaatagctacacaatctccgtcacgttcaatttcgatgatagtattatgttcatacgtgtgaaataccgtaagatacaaatcaataatatgcgggctttcatcttcaattactgcatcgcctttacgggattttccgtcccatactaatttactcgccatcttttgcctctatcaagaattgaattaatgaatcaatttgtttagtgtcaagatgaattatatcattgccttgttttagcacgatacgactcaactttttagtgaaatacgaattcacaacctttacatgcacatcgctgtacggattatctaaattggtactatcaagaatactttccataattacctcaattgtgaatcttttgaaccgcggcgattataggcagaagtcattactgtatcccactttccttgacattctacacaccgttgacagcctttaaccaacagacgacgagctactgggatttcctcatcacaatcaacacaaaactcttcggattcccgctgttcttggagttgtttctgaagacgggcccattcaatcccgtctgctattgtagcttcacgagttgcaaatccgtcatctgatgggccccatccattcatttcaaactctccagaatcatttgcaccaaattatatgtaaacatcggatactggtattgtaccacaatgtagatgataagtaaaacgtttctcattcttcgccatcatcaaagtcgtagtaatcataatcacaactgtcaagataagaatccataaattcttgttgacggcggaaatcttcagaaggggtcagtctgtctgcatatgcttgatcatctggatcgctgaacttatcttcttgcaattctttaatgaactgttcagcttcttcacgtgtccaaaacccacgattaagattatgaacagaacgcttttcacctggcttgaatacacccatatcatgggcagaccgttcagttgaataactttcagtttggccagcatagttttcatattcacaaatcacttggaagaaaggagatttacgtgaatatacaccacgaagaccaagttctacatcatatgtgcctgaagcaacaatgtaacgcgttatttcgccggttttagtttctgtgcgattaacaccacacacgtgataaaagatttttcctggttgaagctcggtagttaacttaatcataatgtttttctcgtttggttgttgatatgtctatagtatcatgtaatgaagggaagtaaacaactttttgaaaagaaaatgcctcccgaaggaggcggagggtattactgcaatgataacaaatacttagtcttgtagcatagacctgtaatgtcatccagaacactttggagggcggcaggaactgacttgtagataccatcggccttagctagaatgaggtctagcatttcaatggtgtcctttggcagctctttctgcgatggtaaagccggtgtataactcttacctgagaatcctaaccactgctcaccaaaagcatctatcaaatctggaatctcgttaaagaaaacttcatacgctttatgtctggcatacgatttggtatcaaaatgcgctgaatgaaaatacgcctgagacgccataagtaaaccgatgaattcatcttgtggagtaagtttaccgtcctttacaaaatcattgaatttcattatcgagttgtatcctcatgcggttagcatattcttcacctgctgaacgtcctaaagaatcgcaatctttagaacaagactcactcttccatttactttgtataaaagaatagaactgttcagactcttgcttactaggctccttaaatttagcataaacttgtagagctccctcaacatacgagttataatccgaaatgtcgttgtgtgatgcagctgggagtgaaatcccgcagcccaacaccagggctaagcaaatgtgattaaaggccatacggcctcctattatttttgtccagtattacgtttgtgctgaagtacagccttaacttctttgaggtatttgtccagcttacgtttacgggtataatctgcttttgaactgtgctgacgaatttcttcctgaaggtgcgaaataccatgcccaatctcacgacgaagttcgtccagttgttctacagtaagattacgaagttgcttttcacttaaatgctgcatatacacctcatcagttagtaatagtatttatataagtatgtgttacttaatcccaaagccattcgcagatgccttgctcaatagttctagcacctgcttcgtcccagttatattcttcgtcatacttcaatgcgcgtttaatttcggctttatgaaatagacgtgggatcggcatagcataacgggtccaacgtaaagttttccagaatccatcgcgctttgatttagcaattaatttcttggcctctagcggtctttcccgattttcagaaatacgcagttcaacatatttctgttgggtttctttatctttctgagttttaacgtattcgttatagcttttaatataagcaaattcgttattattctgatcgttccatttggaagattttactacatgccagcctttgcggcgaattgttctagacattattacctcgttaagttaaattacctcaacgatagtaaaatcctgatttgaaaaatttaatattcatgaatagatgaccttgcatttacattttggacattcaggttctttggttttaagacgcttggtagcagtctttggagcagtgttgttaatcatatacatgaagacaacgatagcacatcacatattttttcatattaaaccaataacgaaagcaatattacgtatagtaagaatccaactacgaatcctagtactataccaccgactataacaaataagctactcatgtttaatataacacccatttgtattagcaataaagtctttaccttgagctaatactttgcattcggaatcaagacgattttgaagttcttctcgtctatcgctttgaatagatgctgctacacccatccaaatgaatagcatacttaaaactagcatcaggatagtgttatacgttcttggcttcattataaacacctaccagttcgcaccagtgtttacgacaaagagaaacgtatttgtcttcaccaccaagttctactacttcaccatcggtaatagcatttccgttttcgtcaatacgagctaccattgtagccttacgtccacagtggcaaacgcccttgagctcaacaagtttatcggctacagaaagaagagctttagaaccttcgaataactcgccgcgaaaatcagtgcgaagcccatatgccattactggaacatcatacaagtcaacgattttacatagctgaagaacatgttcagcagtcaagaattgtgcttcatctacaaatacacaatgaatatcacgttgtgtttgtgcccacttgaaaaactcaaggatatcaatagattcgtctactgtattagcttcatgacgaagaccaatacgtgatgttacctcggtggcagaatctcgagtatcaatagcaggtttaagaatgagagttcccattcctcgttctttgtagttatgcgccgcggtaagaagattagctgatttgcctgcattcatgctcgcgtagttgaaataaagctgtgccattaaagggtctccataaaatcagaaatagcattcttagaacgaatgagttcatcgtattcttcgggtagaccatttccgtaaatggcactaatagctactacttgctcggcacctgcataatcgtcaatcaactgccacagtttatttttttgctctttagtaatcatctatttacctctaacaagatggatttagcttttagcctcttcatattctaccactgtaatgtcaatatcaggggttgctaaattaataagtttctcaattagttcccaatcaccgccagcaataccagcaccaatctttggaatgtatagaggacgattataaacaatacgaccagaatttagttcatggaatgcattaaaaattgcgccgtaatcaacatttggacctggagcatactgagtatacaaattatagcaatatgcagtgccattcttgtgaatggctcgagtatgagttccaagcttggctaaattattgtcataataacggtcttcatcgatgtcaatatcgagaattggaggatatgctttagcaagctgtcctgctacaccggcacccattgtagtaaagcaattacacccatgagcgatatcgcattcatgcttcatgaataactctacaatattgcccttaatatatccagtaatcatttattcacctatggaattttataagttgcgtattcattaagattattgtatactcttaaaaatatagcattgttacaattaaggatagggtttagcactccttgttctttaggatgcattactccatcaacagaaacaccgtcactctgcattccacatccgcgagcattatattcgacgtgtggaactattacctggtcatctttatctagataattataaaatgacattagcaattttctactgctaggaacaaatgctatttcaatattgttcttgaatggaccgttgctttctattttagtcccctgtgctgcaagtatagtttcaggatagcctgggagcttttcccaggcattaactgaaaatgcgcagcataataaaatagctgcttttttcattttgatgatagtcctgacatataacgagccattaattggtcacgatacattaaacatatattttcgttaggagcattgacacacaaatctttcatgctcttagccttacgatttattagtgttgtccactgggccgggctacgtgaatcttttactccatcgctgaatgctgaatctaattcaagcgctaatatatcaacgcattcagagttcgtattgcaaaatgttttagcgatacgaagtgaatctgtcattgaattttcagcattagcagagaatgccaatactaatccaagaagcgcggcgtactttaccattattccacctttatatgtagcattttatgtttctttaagaaatgagctttctctaggacatctgacgcataagagtttcctcttttgacattccatcctgcattataactagcaagagcttttcgcatattgccgttatgtatatttaaccaatatgaaagctcaatatatgcccactccgcagaattacgtctggatttaagcatttttcttatttcagaatcactaaggtttttaccttccagtttagctctggccttaacggtgggtaagtaattttgaaaaaccccataagaatgatggcctttacctgcctttaaattggctcctgccgaagactctttccatgatatagcagccattatatatcctaagccattattatcatatcggttttgtggaggtttttcctttccggatttttgatattgttcaccaaaattatatgcgtaatgcaagttgtcaagttggacattactgaaagttggctcagacccaaaggccgttgaacacaaggccattagaccgacaagcgcttttttcatgtttacctcaattaatgtgtataacttttgtgctgattttacctttcaaacgtttatcattaacgaatgccatacgacactttatactaggtccttttcccggtcttggaatatccatagtaaaccctagccacagatttccatccgtaatttctaaccgcatgggtttatactcgatattttcatcaatgtcttttgggtcaattggaagccaaggcattgctaaaaattcattaatttctttaaggtgattaggaattttggaaagaacagagaatacatactcttcatcaatttcacgttggatagcacggtccaacaaatgatcagagtacttagtgaagaaaggctctttaccctcggctttcgcccgggcacgaacagataaattcaaagagcgaaatgcttcctcaaacttacgacgcagtttagttctgcgaatgaatacttctgggttagttgacatagttcattctcctttgtttatagggccatagtatcatggcccgcaaggaaagtaaactactttttaatatttttcttctggttgaaacactgaacgacacgcccacattgaggcttccttcaggtgctgaatagcattgcgaatttgagtaatacgctcatgtgctaaatcaaattctttgtcgctcattgtgctaacatctaaattcatgtatttttcaacatgctcttcttctaatgctttaaaaattaatccaagacgaatttccgcgtctttgatagcatttactttaccaatcttttcatcggtatgtggcttatatcctttgatatcttcaattgccattatagtgcctctgtgaaagtacgagcgataacgtcgcgctgctgttccggagtcagggagttgaagcgtaccgcatagccggaaacacgaatggtcagctgcggatatttttccggatgctcaaccgcgtccagcagagtttcacgacgcagcacgttcacgttcaggtgctgaccgccttcaatttttaccgctggctggtattcaatttctacttcacgtgccttgtagccataaaaagtttcagcatccgtaatagtatcttctttaagaacttttgaaacgattactcgtgcgtcatcaccatcttcgatgtaaatggtgcctttaagttcaccttcaagaatttgatatgctttcatatttcctcttaattagattctttattccaaccacgcatgtatgcggtaattacactcattttattccattcgtctgaatgaaactttgcagctgcttctagataagttattttatcttcatgataagtaacttcttcatcagtttctttatcgtattccacaatttcaataggctcgttaactccatatccgcgagtgcctatatacgttgtagcttcttcccactgtttggttgtttcattccaagttccattctgatgggcttcatagaaatgctgctcgccagaattactgaaccaagcacagaagctttcaactaaatgtggaggacaccttataacaatttcagccattgcattgttttctcttgaatgcgttggtcatatgtgattaaacttgaactaatcacgcctttgagcttaccggatataaactcaattctaaaattaggatagcgattcatccacttcgtgttgggagcattagaaatgaattctgcgcctttgaatgggccagacagaaacttgtagcgcttgtactcaagcaggttgccagccgtaaccattgttattaattgcttcatatcggcaaatcctgtattttccatcactgtaatcatatcaacaatttctgtctgtgtcatcattgcattcctatcacgaaaaataaaggtaaggtatcattaggcatagaccatctgatagcttcctggtacatatcatagaacttcatcatatcgggaactttcattggttcttcaatgataattaatgctcttccaaactttcttcctctgaacttataagaggaatcattggatagaaattccctgattgtcatcggaacaattgatttagctatctcgttagccggtaatttattaattaaatgcgatgaattatattctcgtagaataccttccatcagttcagatgattgtgtgtatcgagtagataagattataaccgaaccatcttcaagcaaccaatcggtagcgaattggcataaggctgcggtctttccggtttgtcttccaccatctagacgaagggtaccgtactctcgcataaggcaagacggttcataaaaactgtagttgggattatttaatcgtctgtctgcagcgtctttgaaagcatgcatcagggtcaaataaattggtgttaagtatttcataagctctcttttaatggggccattccttggcgcatggagtgagtccattccgataccttatgtaactggcattgccacacttgggctcgaccttattacaggtaggcgggaatccctcatagaatcatgaggtccaggttattccaatgttgtttaaatgtaaatatgaatatactatcacaattctaggagaaagtaaactgttatttacctttaattactttagctgcttcgatagccgcttgctgaaggtcatccatagacataccgaatttagaagcaaagttatcaattttcttttcgacagcattcaaaggcttggcctgtttaccttcattagcgccaggaagagcgagaatacgctctttgtcaatataaaggcttacaagtttcttacggtctttatctgacaaatcatgaaatgaatgggcctttttatttatagcggcttctaatttacctgcactcactcgcgcttcagtgataaattctttataagttttcatttttaaatccagaaaggtaaaagttttaaattaaatggggccattccttggcacatgtttaatccatcgacacactatgtaaaccccttaccgcacttgcgctcgaccttattacaggtaggaaaagctacttcactcagaggactcgacgttcatgaggagaggtcgtgttcggctttattaggaaattgcttacttaattgatttagcgtaacgaatagcgccgcgatcgtttacgaatgcaattttaccattacgcatgtacatggtaaccgtacgctggtaaccgttagaagttttaccagactgataacctactaatgcaaagttatcttcaccaggtttgttctgcttagacttaatacgcatatgtccatgggccattaaagagcgtgcatcgccagatgctactgctttgcgagaagattcatcttcaaccgaagagacaaaatcatcgaatgaatcaaacttagcatggctcttattatataacttgccgtctactacgtagttatatccaacaacgtccatttcaatttctgtgccatcttctagtgtggcggtcatcttctggccttttttaaatttcagaagattacttccaacagattcagtcattacgccaactgttgctaaacgggattcatttaaaaattcttgataggttttcatttattttccttgataagcagaccaagttccggtccgcattgtttcaattacacgacgagcacgattaggtgtctgacgataccaacgtgaatttgcaagttccttggcagcagcatcccattttttagtgagtaataacttcattgaagctgggaacccggctacaccagacacacccatttggaataccatgttaatcagagcagctctacgaacatcatctaatacattatataccgggtttaatgtagcattagcaacaatacctttaattgccttctcaacatctttggcaaaaattacttctgcctcagcctgagtaatttgaccaccagtagaacgacctaccagtttgtccagattagaaatagccaaagattttgacgggtctttagtcagtaagtgaccaataccgatagtccaatacccttcgctatctttataaattttgctgtcgtatccttcatcaatacgcagcatgccaaaaatatccataaggacctcctattaattataggagtatttatttggccctgcacttggctatgaataactcaaggctgcacttctcgtatggtgtccatttatctttccaccacacataatctcttctatcgtcctctggaatttcattaaatccgggatacagcttttctgctatgtaatatgttgattttgtatactcgccgtcaccgaagacgtatcgtgatttcaatagtatacgcgacattttatctctaggatgaaatatgctaacccattttccatcgtgaataaatcgtagctcatgcttataaatgtgtggaatgcctaattcaacggcttcttccataataacctcactgagctgtgctatacatttgtgtcatgattttatacaaacttggtcccatcacatatttccactggcttggtttaattaaagcaaatgcatcgatttcaggaaaattaattccattttcatctttatggtaagctgtacaacggcaatttctgaacatttctgggctcacagggagcatatatccaaacagatggatatccttgttgcttgcataatcatgtcgtccaaggtcatataagaggtcttggtcaaactcggtaaatccagtctcttccttgcattcgcgaatagcagcctcttttggtgtttcaccaggctcaacatgtccttttggaatatcccatctagagcctctgccctggatatatgtatttgtcatacgacccatgaaaagccgtttgtcatcggtaaagaataaaattcctgcactgagctctttcattggcattcgttccagctttcttcaagaatatcttccatggcagtatagaccatagactctaatacaccatcacagttatatgaaccctctaccgagaaatcacagataggtccattaataccaagcagttcttctttaagtgaaatctcgataccgctcagtgattcattatcgctgtaacacagaaggcgagtatcaccattttcaaattttacatgcactgcaacagccattatttcatctccttaatccaggataaagtttcattgcgagagtcatctttagatttttctttctttactttgggcttatcaaatacaccccgctgtcgttgggaaacgaattgcaaccaacgagcaagcattgcaaaccaagttccaacacctgacatccaacctagatagtacaatgtatcaccaaatactggtgaaaagaagtagaatccccagaatatcccaacaccaacaaatgttgagaaggaaaacaggataagcagaaataggaagaaatacaagaaatcatcgtctttaatcattccacgataacaagttttaatcattttctgcagctcctaatccaggtgttgaaatcttctttttctttccacttcttgtatttcatacggtaagctaaaaatgtgcagcaattaatcaacgcgataattagcatccacatgaggctgaatacgaaaacacctaaaaataaaagcataatcataaactctgagacgttcaatccaaagaatgtccctccaacaattacaaaagcacaatataaaatccatgtcacgattccaaaagctggcgccagcccatcttggttccaaaacccgtcaggtttacattcattcattttcttctcacctctttaataaactcaaacgactttttgcggttccattcaagagttaaattcttgcactgttctttccattcagcctttcgttcacagttatgcttaacatactttacccaacgaaatagctcaattaatcctagaccaagtaaacctattaatccccatgtaagtaatagtacattcactaatgatgtactgctaatttcagccaaattcattacgtcgattatgataagcgttatcatagttccagcagcacagaccatccccggaattagaacataatcagtttggtcaaatttatagacataattataaacgggaggttcacttggcagatataaattactcatttctgcaccctctcgcggcagtatttgataaattcatcaatgattaattgtttgcctaccatgttgttagagtcaaacatacccatgacttttggtggtaattcattaacgcagtaatttaaataattgctataatcatcctgagatgtcacgtatttaaccagattaataccgagacgataactagttttattatagataatctcgataactactgtatatgttgtggagctagaagtaaaatattcatcggcattagtacgggctgattttaaatttgatggagaatcgttgaaagaataaattccgtaccgaagtgcaaaaatatccacaagcttaactccgtcggaaatagacgaaatactggaaattaagtttttcagcttgtagtagtctttaagaacgatagcccgcggcaaaactgtggtgttatacccgttatagcgagttttccaattttcaggccgagtatcaggatgagcaaatttttcgagaacatcagtgatttctgttgggaatcctgctgcaattaattctttaatttgaggtgttgccattggaatatctccagcgcattcatataacattttattatccaagttaggggcccgaaggccccggtaaaattacttcagactttccagatattcctggacatcagcagtggtggtttcaataccaggctgagtaccgctgaaggtttcaactttcatcatgatgtcttgtacatctactttagcgagttccgcgatttcaatcacgtcatcagcagaggtaatacccagagcagaagcattacgggtctcacggatgtattcgagtttcactgccaaatcaagacgctggtcatcaagcttaactacagtttcttcaatttgggcccgcatttctttatattcggcagctttatcacgtaaagccttagcagtacgacgatacagaagacccagtttagcatgggtttctacattcataccttctgccatcaagcgacgaatttcacgctctttggaagcacctgcctggtctttttcgtcagcaagtttcagcagacgcttttcttcatttaccgatttaacatgcgtggtacgcagtttagtgatttcatcaataatacgatttgctgcagtggtgtactggtcttcaacagaagtgttctgtgcaacaaaggtaccgaatttagaacggatgaattcaacaagttttttcagaatagacattttatttcctttcaatagttatggtggttttattcgtacggattaatccaatcataaacatatggtttaatgattagaccctgttcatttttgctgcgctcgaatatctcgatataatcagtaacgtatgattctaatccgagaataagtacagactctttgccttcttctactgttgctttaattaaacgctcgatggctattttagcttcaagacgaatatcagcaagagtttttggaacttcatttgtatgcattaatgagttcctccattttgtccaaaactgcgatatcaacaagacgattaacctccgggtcatcggcaaattcattgtaagttgaaatcaccaggttctcgatagttttcagtgcagccattcgttcttcaccggatggaaaatttggagtttcaccaaacagcctagcaaaagatttaaaataagtttgcgctactaatttcaacttatcttgatacataccaatttcctcagtaggtggggagttcattataactccccaaaattattagcagttaattaccgcttcaattcgtttaaccaaagcaggaacagttttagcaaacttgatagccatttgaaccgtagcagcttcttcatggtaaactcgaacatagtactcttcaacagcaggccaatctttgcgaacgtgtttaatcaaatctttcagttcacgggtttctgctacgctgaacactgcattctcatgttcgcctttaatccaaaccgcgcgataacgatcaggagtaccgtattgattataaccacgttcaatttggataaagttgaatttagacattttattctccgttactctgttttgttttgatggagctatagtaaccgagttaactggcgttgtaaacaactttgtgcacaaattttcaaataattttagggaatctggaaggactttctggagagtagaatggatttatacagcttgggatatagaaatgccctagatgatttctagggcaataggatttcattatacggtataggataacccagtttggcgacttagttcaacaagatgatgacgcagctgagacagcagaacttttacttcgccaatgtgttgtgtctcatgggcagatggcttagatccttgtgacgcgcgatatttgtatagattatcgagataaacctcaattgatttgtagagggctccattgtcacgtactagcggaatcatctggtcgattgcgctgaacagttcgccagaaccaataatgctaccatattttccacgaacttttagacctggaacatctttcggagcttctttaacaactggcttaacaggttctgctttaggtgcttgtggcgcaggagttgcttttgtggttggcgcagatttttgcccagtcagagatttgaatgcattctgtactttatagtagtcaccaggattgttagtgctgatgccataaagcttttctacggacgcagcaaatttcataaaatctccacgctcaccttttggtaccatgtccatagctgactgccatttaccctttgtcatccgtacggatgcttcgtttaaaaattctttaaaattcattataaattcctaagtattagtgttgatttactatatactatttatactaaaaagccccgtccgaagacagggctctgagaatcgacagcatcacctactggcagatgacctgcgaaattcatttctttggactcggaggcatcagtctcatccaaagaagtatagcgtcaggaggttatgcttgcgacagggaacaaccggctagcggtaatggacgaaccattctcttctatctgacgactcaacgagggcatacgcaagtttcccttcgaattacattacatcgtattcttcaactagatactgataataggaatcgtttgcttcaagttcttccgcatatgatgttgcttcggatttagtgtgaaaaatcttaagaggcaaagaatattcttcatagccatattcacagttccagttattttttactacagcatatactttcatattttcctcattaatttttggtatgggtaggaatcgaacctacaagccattcagcaccagggcctcacgctctacctatttgagctatcacataccagaatttggtgccgattgcaggagtcgaacccgcggcatcttcattacaagtgaagcgctctaccaactgagctaaatcggcgtggtatccccacctggactcgaaccagggactagggtttagaagacccttgttatatcctcttaactatagggacatttggtgcgtcgaacgagactcgaactcgtacgggtttaatcccgggagattttaagtctcctttgtctaccaattccaacatcgacgcaaatatttgttcaggcaggactcgaacctgcacgactgattccgtcggcgatttaccaccatcgccagcatatgatgcaatatgcgagctcaaaaggtgtccgtcaccatgtctaccgatttcaacactgaacaagataattatattactgattatttatagcatttctcaaacgataaagttgattacagaattcgcgttcagtcaaaatcgtttcagaaattttatttttacccatactgtgagtgagcgtagcattccgggtagcagccaaagcttttctgaatccttcatttttactaagtgcatcatatgctcctgttagtaaattctgatatgcttctgaagctcgatgaataggaacacctttccaataaagcgtttgtgttggccaccaacgtttcttcttacctttaaacttagcggactttccgactagtgtacatacatgtgcttgcatttcaggcgaagaaaatttgagggactgcaagaatccctccattgatgcgcattctacgccatcatagataaatttatgaggagcgaaattactcaaagcacatgatggatatgaactacctgaaccgatatccattacttttccttcacgtatttcaaccaatcaacttttaatgggctttctttctgcttatacgtaattccaacatggaatgcaatcggtgcgtcaggaatacgaatttcttcttcaatgttgaagatttctactttctcaaatactcgcatgaaatcatagtcatattcaattggattacccagccaagcctgaatagcatacataacttcatttgagcaagaataatggttatctaaataagcatcaaactcttcatctgtgcaatcatatgcaggaacatcaacaccaaagaatttcttggaaaattcaggagttacatacttctgttcagtatgaagcttttcaagaattgcttcatggttgtaatcattatttccaaggcattcaccacgccgaccattagaagagaaccattcaagaacatgaattacttgattaatctcttccttttctaagccataaaccatttgggtagaataccggtcagcatcattttcccaagtggtaattgccattgctaagcctttaggaataacttgtccaaatttaatatgcatttcaatttccttagttgataatttggtgaccctggcaaagactcgaacatgcaaccaatcccttatgaggggaacgctctaccaattgagctacagggcctttatagaaatcttatgacttttataaaagccctccgaagagggcgccttgtcgggcttatccacctgctaggcagaattactcacacataaaatcagctacttcccagaagtcatttttaactgctactttaaccaccggataaatttcagatgttttaatagaaacaattacatcacctgcgacagtttctaccagaccaacgattttctcgctgcgagcaacaaatttactcaccggatgaaatttaccggtagcagcgaacatagcttcttggtcaacaatcagtgcgatacgtttcattctttttccttgtttgttttgatgtagtaataataacaggttattcttgtagcattaaatctcgaaaatcgttccgttttcccacattgttgtgaacataggagaaaccttaacgaatgatttgcttcgcattgcaacgtagtcgttatctactttagccaatcctgaagcaatatcagtaatgcggccacacttcatagaaccgcgaccacctttattgtatgtgcgttctccgtagaaaacgatatcaccaacttgtacttctcggcctttagaatctttcatcatattttgcctgctgaattcgtttaaaatcgttaacaagttcttttgggtccaacgcattgttaaatggaagaacttgacgtagtttacttactttacaaccagagtgataagcaataacctcttgaatatcacgctcactgaagtattcatatttaatcagtgaatcatatcggcatttaatccatacccacatacctttgcgttcatcaaatgcatatgcaaagtcagcgttaatcattaaatcccgtttagcaaaagatgaaagccctaatgctaaattaaccggtccatccaaagacagcttcaccgtaatagcatttactttatttgcaacaccaataaaaatattcattctatttccttcgcttgttttggccttcttgtcgtgcacgagaacgtcctgctttatgcagtgattcgtaatatgctcggcgtctatcaatgttttctgtacgatatgctttcccgaaatgggatgttttgaagccgtaatatttcataatataattctcaatggcaagtgattggacggtatgcccggcctcgaaccgagtcacatggactttgcagaatccgtgtgtttaatatatcacccatactcgatagcatatctgaacgagactgcaatcccgctactcagcttacaccatcttgtattgtgtcataccgataatttggtctccatagaatgactcgaacattcgacctctccatcccaaatggagcgctctaccagactgagctatacggagtaattttgatttaaaattcttcttgcttgagtgtgacttacaccaatatgtttagcatatttagataattcgcctcgtttagaaaaatcatataatttagaaatttccattctgtaagctctttcatctgtactaactctagctaagtttaattcggatatctttttcttgaattcagccgaatggtgttttcctgcaaatccgcttggcttaccagccatattatctttccatgtaggtaaatccaaggatttcactgattttgaaatctttttcttatgctcatctgataaaggtttattagcacaagattttccaacttttgacatattagttcttcgttgttcggacaagatttcattattacatatgtggtcccatccgccttcaccaccaagctttaagttatatgtatcaggccttttaataaattcttcatttactaggtgtctttccgcatcatacatatctttagcattatcaaaagtttcgagaatttctttttcaaaattttctttgccgtactttttaatagcacgctttaaattcttaccagaacccatgtatccatcttccaacttagaagtagaatgaactccaatataaaacttttgatttattttatttgtaattttataaagatagtaatgcatatcagttcctattaaaagaaccgagcgtctctcgacgagtcacaatttggagcatccaaagggaatcgaacccttatcaagtgagtggaagtcacctataatagccgttatacgatggatgcaaatttggcaggccctgaaggaatcgaaccctcatcactgggtttggagcccagcataatagccgttatactaagaacctgttatttggtgggagtaactggactcgaaccagtcaccgctcgattatcggtcgagagctctaccaaatgagctatactcccatggaaagctaatcatctaattgttgatgtaccactgctatgggcagcgtttaactttcataaatttggcggagagtaaaggagttgaaccctcaccgtttccgatggcccggatttcaagtccggtttgctaccactagcgctactctccaatatttggtgaaggaagtgccatatagacacaattcgcttagcgacaacccagcatgactgtgggtcgtgtatttttccaccattccttcattgttggggtgaccggcggaatttgaatccgcgactacgagaatcacaatctcgagttctaccaactgaactacggccacatcaatattcactccatccatcatgaggacttcatacgaaattaagagaagaatgatcagttcaacccctgtagacgcgttgaatgaatattaatttggctggactatctggattcgaaccagagataccggagtcaaaggccggtgacttaaccgcttgtctatagtccaattatttggaggcggaggcaggactcgaacctgcgcgtgtcgggatatgagcccaacattctaccaactgaagttactccgcatttatccgggttcttgaagtactaacaagtagcttgatgtagaacacgctaaagatataatcttacgaatatagagcttattccgtgggaacaaacagcttcgtcctcggcattatctcacaggactcaaactcatcttcaagaactgccacgttcttatttggcggacctaacggaattcgaatccgtgactctcgcgtgacaggcgagtattttaaccgctgaaactataggtccataattcgctttcagagatactctggcacgatgccgaagcaaaggggaacaggactctcatcaccttggtaccagatgaatcttgtttagcactctgttctaagatgtatccctgaaagcgaactttcaacgccgtaagaaattataacatgaacaagcattaagcaggatgaaatcatactccttaatacaaacgccatgccagggatttctgtgccgacgattttatcagaacgtcttctgacttcttcatttggcgggccgtgcaggtatcgaacctgcctagtcatttctgacacggattaacagtccgtcgcttaccctctcagccaacgacccgaatttggtgggacaccgaagactcgaacttcggacacccggattaaaagtccggtgctctaaccaactgagctagtatccctaaatttggtggggagtaatggagtcgaaccactcgagccttttgagcaacagatttacagtctgtcccgctacccctacggtctaactccccaatgggtaattttatttatactgctctaaaattaatcagagcagttgatagattaataataacaaagaaaacctaaagcatattacacaatcggtgagctctttgatttaaccaggaatacccgatgtggtgaatccatatgagagagcaatacccggtgctcaggaattggacttgtatggaaaggaaccacacgataacctttaggagtaaatcctagcaaaataccaacgcttgctgcagaaagtgacccaccacagtagtatgataccaaatcaccaggctggatttcattgtcaagagaatcggttttgacatgcttaggcgtaactaaatcactaggaattggaacgccttgtgcatcatagtattcatgggcaagaagcttataattctcttgatagaaagtattaaacgcagctctgatattcatcacaatttcctcacaattaatctttgtatgcttcagttgaacctttagcaacggtctcaaatcgggaattcagtatctcaaaatagtcttgatacgttccctggagggcttcatagcattcttctaccgtagaatagacacctctgatttggtcagagccaggagcaggataataattagaccaagttaaaagtgcatacattacttacgtttccagctataatgagccaaaataagaagcactgcaatagcaagtagtgatgaatgcagtgctgccagtagtgcacctagtcctacgcccaaagtaacataatcatacttagttacttcttcacggtgtaaatcatagtttttgatgaaccactgcttaatctttttcatgtgctattttatccattatgaaagaaatgatacccattagaaatgcaacacttaacactgatactgtttcaggaagagacataaaggctgcaccgataatgccaaaacctaacgctcccatgcagatagttgatgcaacatttctaattaattcacaacgtttcattttattctcctcaagttgatagggttatagtatcactactacaacccgttgtaaacaactttattcagcgccagcggcttttaaaagctttttaagattagcagaacctcgggcagaaaaagttaccttaccatctttttcaccgatgctgccggtcaatttagaaagtttatcgctaggaacttttttaaaatcggctaatgtcccgtcaacggtttttgtaacaatcggcagttcatcatcctgtcttttagcttctgtaataaattcttggtacgttttcatgttgcttccgtttggttagtttgttttgatggagctatagtatcaccactaggaccggttgtaaacaactttgtgaaataaattcctatttcaaatcttctgaccagtccagttttagtggctcttggtactctctatcaagcactacaggtacttgaacttcaccctcgaagtgagctggacctacattgtagctgagagtaatgtgcggtgagtaatctgggaaatcatgagttgctcccaaagctcttgcatattggtgacggaattttaagtattctgaatctagcttaagaactagcgtacgtccgtcttgtgtgtcccatacttcaagtttacctgatgtagcaacttcaaaacttcctgaagcacaaacgtatggaacatgaactcttgaatagcatatcgtcgtatgaattttatgacgaggaactggattagggaccttcaactcacgctgaaggtcctcaatagcatcaagagttttctcagagaatttagcagctacatatagaccagtgctaaaatcactgaagttcattaggcatcagcttcttcagtggtttcttctgcgaactgtgcttcgatttttgcaacgaggtcatcaagtttaacctgaccgtcttcgctgatttcaacgccggatacagcaatcagcttctgcagtacttcttcatactgtgcacgcagagcagaaaggccttggatagtttcagacaggtcaaatacacgaactttcagagtatcgacttgggcttgcagttgttcagtagtcatttttgaattcctaatatagtgttgatttttgaataaagttcttctagagaaccgtcgttagttattacgatatcgccttcgcgaatcggaagtccacgctctgtgacgtgagtatcttttttagaaccttcttgctcaggacgaactacatgaataactgtagcacccatcgccctggctacatcaagttcatggtcttggcgggtatctgggacaatgaaataatcataatcaccaaaagtatcagccataaccaaagtgaatcgttttacccaatacatgcgatcgagcttatcacagacaatgtcagtcccaagggtctgcatgagacgacgaattgaccatggctcaacaggtttatttattacaactttacggatgacttccatcgtatcaccgtcaagtattttacgtttgttatcataaaccacaccaggtaaaggcaaatcatgatgaacatattcaatcgcgttcgccatgatacgaatcacgtctttagtagacagatttaaatcttgttcacgatcgtaatcaataccttcaatcatcgaccgagtaatgcgaggaaactgacgtgatgtatcgcgataccactcagtaagcattgcatcagccaacgcatctttaattggacctgctaactgatgctttgttgcgttatagttatccataatgtagtcagcagttgtatctttgccactacgttttttaccaatcaaaaataaaagcttcaaattattacctcatagaaggatgcattcccataactttctgttgatactgggattcgcgagtatcattgacagaaggtctaccagtaattattataccatctttttcaacttcgatgtatttgtactgcaaagttgctacacataccattgctgggtcggattcttcggttaaagaatactcaatttcagataaatcactcacccaacctccgatgtagcggacagttaatactatatcatgtttatcgttatcaagaacatgcattaaaactgcgccaggaaatccttcaccgccgttattccatccagacttgtctcggtcaatgtagttttgacagcttaacatccatttgtacatttgtacccatgaatcaagattttcatctactaaaaatctaacaggaacagcgtcaaactcaaaagtagacccaggcaatttagcacgatgcatgccttgaggcgagcctacagtatcagtagcaggaatatgaattccaggaactacagctgtttgaagattagctttaaacgcttgggtgaggcccccatcagggacctctaatataaagttagttgtgttagtttgattaaacagtccagtagacattatgatttccatacagaagtagcagagtagcgtttgcctttcgacatgaactgctgcagtggtaacatgactacattcgcccaatcagccggttttatctcaattaaagcaccctttatattaccaggaatatatgctttaatcattttgtcagcgccagcaaatcctttaacttggctccagtttatctttaatctggtcttattagatatcactggcgtattagcatactgtttaagaagttcttctaaaaactgctgacgagcctttggcggaatgtagtgaaggtttaacccatacatcaatgtggttgtaccttgctttccaagaccaagataaactatcaaaggaaatttatcccagaatggaagagtgtctttgtgcttagcgtcatacatgtaagcatatagctttccaggttgaggcttggttacagaatgaccacgtatatttttctttatagtttctgcaaaccatttagcagatttattgtttactgctgcgccttcattacgaattttatctttgatagagcttcgaaatgaatttaccatcacaagagcacgctcctgtttggtcattttgttagcaggttttttctcaatttctgctactttaattgccgttttaattcttgatgcatgacgagccattgctttactgaacgtagcaggatttattcctttgctttcagcgaatgatttagacgtcatgccttttttacgagcagcagagtattcaactcctaatgctacccattgattttcactacgggatttagctttaggcgattctgcagcttcagtgataaattcaaatatagccatcagcctttccatcctaattttttaagtgaatcttcggtaattaacctaaattctatacccattttactggcagtagcttgagctgctttccacttatcaacgtttacagaccatgtgtaaatttcatcaatgtaccgtttcttcgctgatgtcgtcaactttgtgggtttgaccggaggtctagtttctttcttcggcttaacttcaaaaaagaactgttgaccattagaaaacttagcccagaaatccatgaaataacggcgtttctttccatcagcattgctgaagtatggaattaccacgcattctgagttccaactaactacatctgggtggttatctaaccaccgcatcatgaaattgctcccaagtagatcggtatgtgatcttacgagggtcccccttatatttgcttaagttttttggtaaaaattttccgctatacgccattaggcttctccttacatttgtcaaagtgccaacacttcattccacgaggttttcctgatttgccacagtgaggacatgttactacaggttgagattctgaaacagccctaagctttgctcgagtttcttccgatctcttctttccggtgttagctaaatttaatttattttggtgctctttagttctatttttagctgcagtagacatgttttgtttcattgtatcgctttttgaaacacctgtcatagaaatactgcgcttttcatttgattctaatgtctgagactttccagtaagagctgcagacagtttagctgaccattcctttgacctttgacttcgcttctttcctgttaatatcacagaattagcaatagaaactcttttgcgaatccattcatatgatttgttatttcttcctgctaatttagaagacatgatatgaactgcgtatgataacttgtgattatctggataaatcttagctaaaagctgatgcgcaacataatgttcagctgcagtcaaatctacgaggttatcttcatcatcagtaccacccatacatcttggtacaatatgatgtcgttctttatatccttccaagctgcgagatttgcctctctcaataagctgatcataaattttacgataattcatattattctcctcagtagttgatagggtaataataccataaaccactcgtcatgtatactacaactttataaatactgttattaatatttataagaggataaactatgctcttctcattttttagtccgatagattattctgcaaagaccgtaaaaggtgctaaggcaaaagctatcccaaccgctgacatatttcgtaattatcgcaaatattttgacactgtggcagaaaactatcttttacaaacatattacataagtggagctcctagaccagaagaattagcatatattctttatggaaatagtcagctgtactggattcttttaatgtgtaataatgtatatgacccgtttagagattggattaaaacccaggatgcatgctatcaatttgcacaacaaaaatatgcagatgtaggtggagaccaaatactctatcacgtggatgcaaacggcaatcgttattataacctcgagcaatatcctgaaaattcaggcatttggtatgataaaggggactttaatcaccagtaccctcaatatactggggctttagctggtgttgacatttatgaagactctattatagaaaatgaaaaactgcgccaaataaacattatcaatcctagtgatattgaggcatttctttctgatattatacgagaaatggaaaaagcacctgacagcgaatacgaatcaggccggtacaaatcccagactacaatcggagaagttttatgattgaaatgaatgattcattaaaatggtttaccggtgttgttgaagacagacaagacccgttgaaacaaggaagagtgcgagtacgtgtttatgggcttcatccatttgaaaaggtgcaaggagctataaccggtcttcctaccgaagaccttccttggatgtcagtgattcagcctactaactcagctggaatttccggagttggctcgtctataactggaatggtggaaggaacatcggtatttggcttatggcttgatgaattcaaaacagcaggattagtaataggaacatattctgcgcacagaaaaactaagccaaactacacggaaggtttttctgaccccacaggtcaatatcctagacaggttgggtcagataccaacccactagttcaaggcgatgaaactgggtatagtgctataccaaacatcatccaagatagaaacttggatattggcattaatcctgacgatgctgacctaagcgatattcctgaagacccaaatcctgcaattacaataacagatatgcttaatagggatgaaggtcttagattgaaagtctattgggatacagaaggatatcctactgtaggtattggacaccttatcatggcacaaaaagtacgtgatatgtctgtcattaataaaactttatctaatcaggttggtcgtactgttacaggaaatcccggtatcattacaatggacgaagcagttgcactatttaagaaagatcgtgataaaatgctttctgatattaaaacgaattcacgggtaggacctgtatatgctaaagtcaacaaatcaaggcaaatggctttagaaaatatgagttttcaaatgggcgtaggtggattagcaaaatttggtaaaatgcttgatgccatgctcattggtgattggaaaaccgcttatacagaagcaagaaactctgtttggtttaatcagacaaaaggtcgtgcttctcgtgtttccatgattattctaacgggtaatatggaatcatatggagttcctgctccaaagccagaaggaaaaaacctgtctgcggcttatgtagaaccgaagtctggtggtaatcctgaagacccatggaccccagaggattcaagaattctttttaaagagcccgaatcttcatataatggtcaatatccatatgtacatacgatggaaacagaatcaggccatatccaagaatttgatgatacgcctggctatgaacgctatcgtattgttcatccaaccggttcatatgaagaggttgctcctgatggacgtcgtaccagaaaaactgtagccgatttatatgacatgactcagggcgatggaaatattttaatctctggggataagaaggttaacgttggagggaacgagacctattataacatgtataatcgtcgacagcaaattgatggcgataacacgctttatgtacgtggaaatgaaactaaaacgattgaaggtgatggtactatttttgtcaagggtaacattaagatagtcgttgaaggaaatgctgatatccaagtcaatggtgatgccactactaaagtagatggcaaccacgacgtgaccgtcggtggtaatttaacttggcaggtagcaggtactgtgaattggaatgttggtggggcttggactgaaacaatggcttctatgagctcaatcgcccaaggccaatacactgttgatggttcacgaattgatgtaggttaatcatggctgatatacttcctattaataccacgttacgcgaagtaatagaaggtgaatacgttgagcagtactttactgctcaattatctaccaacgaaacattaaaatcaataaatattatcgactatcaaccagtatctgatatctctgtgtctgaaacctattataaaggtaattataactcagtttttacttttggaaacgatgtgcttaaataccgtgaaggtgatgagctaaagtccgcttcagcgtgggaggatttacctaatcccaaaactgctgatttgtatctatggaaagcccccagaacactagagaagacatttacctatacagttgagataatatatacagtgacagaagaatcgtctggaggttcatccggaggttctagcgctccaatcataacagaacataaaaagcaaaagatttactctcaaaccgttaaaggcaactggagtagatggggcgaccaacttcgtgcttacgtatatgcggggaattaaatggctggtctttcatatgataaatgcataactgccgggcatagtgcgtatcctccgacagaagtaaatgctacacaaagtaaagtattcactggtggaatagcggtattagttgatggcgactcaattaccccacacaccaagacggttgaccctcatgatacgcatggaggagttgttcaacctcgcacatccaaggtatttgtaacaggcaaaaaagctgttcaaatggccgatccaatttcttgtggcgacactgtcgcgcaatcaagctcaaaggtattcatacactaatggctattaaagaacctttaaattatcagttaacgcgtactgcaaacgctatcccagacgcatttactggagcaacattcgatgaaattaaaaatcagcttattaactggcttagcggtcaaaaagagtttcaggactttgattttgctggttcgcgtttaaacgtgctattagacttattagcatataacacgctttacatacagcaatttagtaatactgctttatacgaaagctttatcggaacagctaacttgagaagttccgttgttcaagcagctcagcaaaacgggtatttgccaagttccaaatcagcggctactgcgtctattatgcttgaggtaactcatccaaatccagagccagcaataaaaatacctcgtggaaccaagtttttagcatatgcacgagattcatcagtagacccatacaactttgttgttactgaaaatgttattgcgctaagagatacttcagcaccagaaggggttaatagatatcttcctattgtcaatttggcgcagggacgtattattcgtactcagttgtcatatgacccgaagaaacctattgttattcgcgatcagtcaattgaccgcaagcaggttaagctgtgggtggatggcgctgaatggactaactggacagaccggtcaatggttcatgcttcgtctatttcaacgatttattatatgcgtgaaactgtcgatggaaataccgaattcttctttggtgaaggcgtggcagaagcctctgtagcaggaggagttcttgaaagtaatttcattggtggattaaaacctactaagggtgcgcaagtcgttattgaatatattcgtactgatggtgaagctgcgaatggtgcgactgatttcagctatgctgataccctgcaatatatcgtagtaaacaaaatcattgaaaactggtcagattctcctgattatgttggtgctgatggtggtggggaacctgaagacatcgagcgtattcgtgagctcgcccagattaagcgcgaatctcaaatgcgttgcgtgtctaaaactgactatgaatcattcgttagttcacgctttggttctatcgtacaagcagtgcaatgctttactgatcaggacaaacccggatatgcatttatcgcaattaaaccaaaatctgggttgcagttaactgcggttcaacgagaagacattcaggattatctaaaacctttctgtcttgctccgattactccttcggtaatgagtccagactacttgttcatccgtcacaatattaaagcttcttatgcattgaataagttgcaagaatcagagcagtggttacagtcaaaaattatagactcgattaatagatattatgttgatgaagttgaaatgttcaacaaaaatttcagtaaatctaagttgttgacttacattgatgacactgaccactcaatcatcggttcttctgtggatattcagatggttcgtgaaattgtcaactatttcactcttcctagcgcaggtattaaatactataatactattactccgcggacgttacgttctggtgatttggtctttactgttaccccaactgctgaaccgtattcagttaatatcgttggaactgacccagataaaaatggcaaaggaaatatggttattggaccatttaaaccaggtgacattaaagagaatactcatatccagccatatactgaaaacgattttgatagaactaccgtcggcgaaagaactcgttggtacaaaatcggtgaagtagattattatggtgataatatttactggagccttggagctattggagccgatcctcttcagtttgaagaccagagtattgagctttattctactcctacccaggatatcgtcttcgcccgcgatggaacacttatcgtatttgagaatgaccttcgtcctcaatacacaactattaaattggagcctattacagcttaatgaagtataatgaaatttatgatagtttaattaaaagaggcctcgaaagaggccttaataaaaagaagcttgattatcatacagaaaaacatcacattattcctaagtgtatgggaggagttaataataattctaactatgtattgctaactcccagagaacattttgtagctcatcaattgttagtaaaaatatataaagatactaagtatttctataagttagttagagctctcaacgcgatgtcaatgtttaatgataaatattctagacccaacgctaaagaatatgaatgggtacgaactttatgttataacgcgaataaattgactaatgtgggaagaaagcataaacctgaaactctacgtctgttctcggagcaacgtagaggtgctaataacccaatgtatggaagaaagggtgaattgtctccatcatttggtaaaaagaggagtaaagaatctaatgataagatatggttaaatcgaagcagaaatattagtcagaaagcaaaatataatatttcaaaggggaaacgaacatctcctatatggaaagaacctatgtataatgaattgtttaatttatacataagtaatccggtaggaggatgcgcgtttagaactaaagccgtgtctttaggatatcctaatacttcataccacagactagtacaagaatttaaggaaattactcaatgacaattgcaccgttcgtcaccagcttacgaattcataagctatctgcgaatcaggtcaatattcgttgggatgacgttggtgcaaacttctactattttgtagaactggccgaaactcgaaacagagcgggggaagttatccccgctgataacttgagttggtcttcactgggttataccgcggataatgattggttcgaacaaaatcgtattgaaccgcttacttattataaaatgcgtgttcaaactacgtcagcagggtttgagccgtctgaatgggttgaaacagaagagttccaaacttttgaagaaaacgcatacacatttgagcatatgcaagaattcagtttagtgaaagaattcattaaacagaagttttctttaaacaacatgtcgtatgttaacttcaacacatctgccatgatggcatctttgatgactgagtcttttcagtttagtcctgaatattctcatttatcagctattgaaaacttcgttgtaggtgaatctggatatcatgaaattcagggacctattgaagcagtgtgtgttgataaaaatagaactatgctgggagaaatagacggaattttgtatctgtttgaaagattccaacatatggttaaagtatcaaacgataaaggacagaactggcaatacgttcagttatttaatgaccgtgtaggaaatcctgtttcacgagtagtaatttatcaatcaagtaccacatcatatgttttaggctatgataaaatcttttacggaagaaaatcatctgacgtacgctggtcatcaaatgaggttaaatttagcgataacgaagtcacgttcgctaaattgggagaccagttaaaactgggatttgaagtagagttatttggtacatatgcatcactacctgctgatgttaccaaatatgcagaagcctttacatgcaatgatgaccacttatatgtagttgcaaaggatacagtacgcagagttaaattaaaagatgctccaatagacactgaccctttaagccctacatttggtgaaaaagtgtttgaaaaggaagtatctcatataacaggcaatcctaaatctgtatgctttaaaatggattccgttggaggcaaaatctttgcccttattaccggggaagttaaaaccttaggattagacccaacagacccaaggaacgttgtggattctgcaactaaaggcgtctatgtttaccaggaaggcacaaatacttggaagcgtgtatttggtaataccgatgaagaaaaacgtcgtatagagcatttatggacttctatgtcaactgacggaaaggaaatattcttttcatcagctaattttaagacaacagagtacgctcaggatattgagcttgagacgaaatatccagaactaatttctactgcagttaaaaatgttaatccaattcagtatcactctgataagcattatcacatgatgagtttcagagcagatgaattttcaggatgggaaacatttgttcctggacctatgaggttttatgctgaaccttggtttgtctggatggctcgtgaaggcaacagatgctggataagtacagctgaccatgcagttgtcatttataatgatattctttatcaaaaaagagtagatgcagcggcgcagggaactaccgagcgtattctatcggaagtgtgggataaaggtgacgcaacgttttattgccctccagtttcatttaatggatttttgcagtatgcttctggcatcatgtttcacgaaccagacggaaaactgataggctattacgcatttgactaccgtgttcgtgaccaggtaacgcttaactggaaaccaactgatgtaatgtttaaggcgtttctgcagaaccaaacacgggaagaagactggacacctgaacatactccaggcttacgtgacccagatttgcgtccgtatcttactaaaatgatgccggatagttacttgctacaagatagtaattttgagcacttttgtaagtactatctccaattcctttcagatggaaatggaacacattacaacagtctcgttaatcttgttaagaacaaatatcctcgcgaagaaaatgcatgggaatatctgtggtcagaagtttataaacgcaacatttatctgagtaaagacgctcgtgacgctgtcgtccgtttctttgaagcacgcaagaatgatttctatgctactaaaggaattgaagactcatataagttcctgtttaaacttctttataacgaagacgtcgaaatcgatattgagtcaaagaacactaccgaatatgacattattgttgaaagtacaaatatttctgacgatttagttggtcgtacgatttatactgcttccggtcgtagtaatgtgacttatatcgagagagaataccgggatggtcgtctgttatggcgtattactattcataacttatcaggacggttcattgaaggccaggaaattaaatcagagcgtacggactttgagggtattatagttcaaggtgtccgtggaaaggatatgctgagtaataacattgattatataaaccgcagccgttcttactatgttatgaaaattaagtctcagcttcctacttctcgtttccgcgacgatgtattaaggtttgttcatccggtaggtttcggtttcattggtataacattgctgacaatgtttatcaatagtggcttaaatatgaagcatgttgagactatcataaataaactcaagaactataaatgggatgcaggactgccatcagtttatcctgatagagttgctattatcgcctcagatgatacaatagaaagggatccaataactaatgagcctagatattcttctcgtgctcaagctggcgaacctttcccattacctgctaactataatcaagaaaataataatagtgttatcgctggacaaaacccaggacaaagacgtaaacctctgagtcctacatttgaccaatcagcagtaacgtttgccaattatcgtgatttagttaaccaacgtcttaaagacgatgcaggtaatcctcgcgatcctgaaaatccgacacaggtaaaaattgatgagtaattcaacaagagcaagttcaacgcgtagcacgatttatcgtgctatcattacatctaagtttagaactgaaaagatgtacacattttataaatcgattggtccgggaacggaccaaaacacactgtatgtttcatttggcaaaagcactccgtggtcagataacgaatctgaacccggatttgcacctccatatcccgctgataatggagatggggtagttgatgtttggacaaatatgatgggcgcggtcaaaattgaatcatcaatgcttgattgcgttgttccaagaagagactggggtgatactagatatcctaacccgcgtacatttttgattggtgatattgttgttgctaactctgcgccatataacagaactgacgctggatttggatggatggtatatagatgtattgatgttccaaaagacggaatgtgttcaattggaaatcttacaagcaaagatgaatgtattaagcttggaggtaaatggacaccatcagctatttcaggttcagctcctcgtggtcgtggtgatgcaaatggtactgtcgatttaggtgatggatatctttgggaatatctatatgaaatcccagctgatgtatcaatcaacagatgcacaaatgaatatattgtagttccttggccagaagagattcaagaatctccggctcgttggggatttcaaaacaacttaacatggcagcaaaatgactttaatttaatttatcgcatgaagtgcaatacgattagatttaaagcatatcttgacgcaatttatttcccagaatttagtcttccaggaaatactgggtttagacagctgtcaattataactaatccgcttgaagttaagccaatgccaaattcacctaatgttaaggctgaaaaaggctggtatagtgcttctggtcttgaaagacagtcaggtgaaatgatttacatggaaaatcggcaacctattatacgttcaatggaccaaacagaagagttaaatttaattttcgagttttaattatggggagcctttggctccccatttttatataaataagactatactttgatatgaggttaacctatgtatacagataagggtaaaaaaataattgacgtcggtgagattggtaatgcttctaccggcgacattctgtatgatggcggtgtgaaaattaatgataacttcgacgccatttacaacgccttcgccgaccaacgattatttgcagctggcggcggagcattgaaccaaaaaattcatgcaacaagctattaccaaaagataaaatttggagatgctaactctgcagggacagttccaatggggtcatgcatagatgctgattgttcagaaggcgcagttcaaatacgtctttcaaaaggtaaagcgggagaagctgtattcgttgtaaatagtaatggctcagcatcaaaagctagatccataaaaataacaacaaacggcgaaggcgtagcagatgcatttaaagacggatcgcgagagttgattatcaacacgccaagatgcagaattgagctatggtgtgttgaggtaaaagctaacggtgctgctgtttgggattattcaatttcaagtatgtttggcagcacatattcgccattagaagctacatataatttaacaagttctcctattaatatccgcattggatataatgatgattactccaccgttaaattgttattaagcttcagtgcaaatccgggtggtcaaaccatcaaaaggcaatcatctgaagtcatgcttatgattgacccgactattacttcatcagcgccaaacggaagagtatttgacactgaatatgcagtgttaagaagtggtgaatcatctgaaaatgaaaagatgtattctatttcatactctattaacgcgcagaaagatttaatatgcacagcttcaacatcttatggaaacgcacgtttggcagttaaagttattgctacacagaccgtaggggtatctcaataatgaaacaaaatttgatagtaggccaatcagtagatgatgggtctggtgattacctccgtaaaggtggtcttaaaattaataacaactttgatgatttatattcagagttaggtgatggttcagttccattcgcagcaggtgcatggaaaacttttaaagctagccctactggaactactttaaatgctaagtttggtcaggcctttgctattaatacccaggcagcaagagttaacgttcagcttccaaagggtacagccaacgactataacaaagttattaaacttcgtgatgtttggtcaacctggcgattaagcccaatcacagttattcctgctcaaggcgatacattaaaaggttcagcttctcctaaaattttcaatactaacttccaagatttggaattagtttattgcgcccctggccgctgggaatatattgaaaataaaacggtagataagctaactaacggtaacttaagtactgtagcgaaaaaatcaattattgctactgcgggtcagactgactttcttaacatttttgatggcgtagaatataacgaagactcgcttaatgtatatcgtcgtggtaatattttatattacggtgaaaccagtgttatggataaagccaatgctgattacggttctcctggaacagtagcaggtcaattggtagaattaaacggtaaagacattcgtttaaaagttccatgcgttgaaggggaagtaataacatttgaaaccttcctagatggaattggtgtttatcggtcttcatacaacaagttggctatccagatacgagattcagcccagactacatcccagacgattcctgggtcaatgatagtagataaccttgctactctccgcagaatcactctggatgacatgggtgtacttccaggcgtaggggtaaatcctaactcgcttgaaatttcattgaacggaaaggaattactcgaagctggaactgctggtcttcctttattttattgtgaaggcgcagaaggtggatacgcagaagactgtataaacaatggtggtcaatgggtaaattctaaccaagattatagactggaatttgactcaactggtactaacgtcgaagctattatttttggtgaggcgtttgaagataaagaccttcttaccgtccgttggttcaataataacatcggtactactatggatatcaatgatatcatggcagaaaccgaccaagtgtatatgaatgctgagcaattagtaactctaaaaaatcgcattgaatacacaaattatgatgaacctaatcagaaaaatatgcgtccggttgctgacgatattatgattaaagtcaataatattgcagcattttttgacgtaatttatccgattggcacgatttatgaaaacgctcacaaccacgcaaaccctgctgactatatgggatttggggtgtggaagctttattcacaaggccgtgttactgctggttggaataatgattcatctgatccttatttttcgcgtaacaacaataacttaaacgaaaatggtcagccatcattaacagcaggtggaacggttggagatttgacatttacgttaggaaaagaacacattcctgaactaatgtcaagagataaagttctaatttcagaccctgaacatggaagcgtagttatcggtggatgtcaattagacccagacgcgcagggaccaggttattctaaataccgtgaagacactgttgcggtaaacaacggtgtagttccaaatgacatcactaaaattcagccaacaatcaccgtttatcgttggattagggtaggttaaaatgacgattgaaactaaaactcgtgaaggagctaaagttaattcaagattagctgctttttcagaatatcgcgttgacccgcaaaatattgcggtaggaaatacggctcctatagggagcctaacctttgaacaaatggatttaggggtttggtatccaaatactgaagctgctattaatgatttgatgtcattgcagtcagcagaaattggaactattatttgcaatgacactggaatatctccacagcccgcacagcaaattacgcgtgctactttttcaggtgtcgttgcgttagagccaaaagaagacggctctgtcggtgacccagtaataattcatattcttggcttaccaattagaattgcaaacggtgatgactttgcagcagtagcaacacgttggtatgataaagtaaaagaattagaagctgttggaaaggttgttcaacaggttactcaatcgccggcaacaccccagtatgttgatattattcatttagattatcagaaccataattttgaaacatataaaaagtatggtttaactgttgaatttactattacttcaccagctaaagcaggttatgggcaatgggatgctatcggcaacgaatctaaaacattcggcgcgaacacatttactttccactattttagaaggatgggataatggcccagaataactataatcactacagtgatttggccaaatatacgatatttgacccaacaaatacacaatggcctgttgctataaaagacgtccaatcagcgttagagctgattggtagctgggcaagaactgataccggattacctgtagcatctcctacagtagccggtgtaattcgcacagcaacacaggctgaagttgatgctggaactattggtaatgctgcggtaactcctgctacattaaaatccacagttacccgtcctgaagcaactacagcagttcttggcttaacacgatatgctactaatactgaagccgcagcattaaccgcaggaaatagaactattaccgcggcggctctcggtcatgtgtttaaaaccgtaaaagcccaagaaaacgtagatggaactgttaggttaactactgcggctcaagcgcaagcaggaactgacgaaactaccgcagtaactcctaagcgtgttgtagaaatgattggaaagttcagcgttagtcctcctagttatacctctgcgacagaaagcaacttgggattagttcgtgtcgcaacccaagcccaggtagcagcaggcgctgttcacgatggatacgcagtaactccaaaaaccttcatggaatcaaaagcgtctgacagtgtatttggtatagtaaaatttgctaaagactcagatgtggcttcagctacttctaacaatttggctgttactccaaaaagtcttcaagcgctaaaatccaccaaggataaatatggattaaccagattatcaggttctccaactactgatgcttcattggcagcggctgcaacagatgcagtctttaaaacccgtagaataaacggaaaaactcttgacaatgacataacgattactaacaatgatattaattgttatacaagacaagaatctgacgggcgttacatgccagctggaaccagagtaggtaatgttacttgggttgaaggtcaatcttggattagtcgaggtgcaacgtttacatgtaatgcaccatgggaagcttctagtagattagctctaaatgttaatgtaaaatttgagcgtaacaacgacggatatgacaatcgtattttcagatttgttgtaatagttaacggttcccaatggggcggtgaacttactcttaacatcgaaaatactaaaggcggacgaaatggtcattcatggagatttgaagcttacgcatctagcaactttttcttcaataacattcctccaaatgccactgttcaaataagaccaacagaagacagtcgtattatattttatgactgcatgcttacattctgtacaaatagaccgtaaggaacaatatgaccaaactagtagattcgcttccgttcgtagacggaattccagacgattttcaacagagaattaactggataaaaaatacagagcctcttaatggggcttcaacccgctatggaaatgatggagaactgaatagagcttctgttcaaatccagaaaaacgttgttcaggtacataacgatttgaacaacgttggaactgctgtagaaaatattcaagtagatgtagaccaaatcaaaaaatcgttagaaattacaggttcttctgacgccattgagcaggtttatatcaataaaaagaatattgaaaagcatgatggacaaattcttaaattagaagaagacaccgaaaaacttcgaactgaccttgattttctcgaagaggatgtaggtgtttatgattctagtaaagatgactattacagaacagttcgtgataatatagtttgggttaaacgtgaaattggtgcgtatcctgggcaagatattaacggacagccgaagcaagactctccgggttctggtatgaaataccgaatcatcaataatgcgtcagctatagtaaaacatgacgagcgtattcaggcgctagaggatgcatacaatgattcagacgtaggttctctgactattgaagtaaacgacctgcgtaaagaagttggtcctaaatccggagctacgtcagcttcaatttatgcaaggcttgtgaataacgctgatgctatttccgcagctaataatgaaatctttgctattaaccaagccattgattttaccaatccagtaaaaattggagctcgtactactagattagaaaacgattatcgtatagttgacgcaacacttaactctgcacaaaccgggttagttcctcgtgtcaataatattgatgctcgtttagggtcttctgataagcctgatactattgaaggaaaaattagttctctttcaactgaccaagggtacatttctgatgttgtaggacgtgatacttcatcagggcttcagggtcaagtagcatggataaaccaacaggttggtattgttcctagcgagcagccgattcctcctgggtcaattttagcgagaatgaccaatgttgaaggtatgcaaaactctcaacagtctgctattcaggacattcaagtagaacttggcaataacaatgaagggttaaagggttctgtatttacattacagactcaaatgaatggtgacttttcgtcagaaaacccagttcaacgtgatggtgtatacgctactgtagtagaattgcaagataaattcgtgactgcagttactgacgtagaacaagctggagcatacctccgtaaacagggcgaatggtttaaaaaaccttcatcaataggtgaattcagtaaagaagatttcactgttgatttaagttctgatgcattggtaaatcctaactcattggtcgctgctccattcaatgctggcattcgtattgtcgatgacattgttgttgatgacgatggcgtattttgcgtagaaactgatacggttatcgaagcttctgattcagataaaggcgtgaaaattgttattctcgttaataacattgaggtgttttcctacggacttggtgttaaagcagtaacgggcgagcagttgattaaaaccaagaaactcattgagttttcatctggtgatgcaatcaaaatcgtgtatagagctgcttcagaagaatcgcaggttcttgttaaaattaaatctttggatattactattcatccagctgtataacaaaaggggaccttcgggtccctttttcgtataaataggaatataaagaggagttcatatgtcatacaacacgtacaacccaaaaacgcttaaagacgctatacttcgacgtctaggagcgccggtaattaatgtagaagtaactgaagaccaaatttatgattgtattcaacgagcattagagttgtatggtgaataccactttaacggattgaataaaggttatcaggttttttatattggaaaagacgaagctgacaacgcaagatttttaaacggcgtgtttgatttgcgcggtcgtaatgtatttgctgtcacccaaattgttagaacaaatgtaggttcattaacttcaatggatggtaatgcgacatatccatggtttactgactttctaatgggaatggcaggaattaatggcggaatggggtcaagctgtaataaaagctatgggccaaacgctttcggtgctgaccttggctattttacacaattgatgacttactggtcaatgatgcaagatttacttgctcctctcccagattattggtataactctgataatgaaatgcttaaagtaatgggcaacttcatgaagggtgacatcattgtctgtgaatgctggaccaaatcatttatgaatacagatgtgatggtaggcaatacagcaggatatggattcgccggagcccaaactgctgaccactggggtttaggagatagataccagaatcctgaccttcgcaataacggccaatatgctggtgaaggcaatacaaatagagaaggtgcatataataatcgttgggtaaaagattatgctacagcattaactaaaaagctgtggggtgaaattctttttaaacatcagggtctgcaattggcaggtggagttacagttgatggtcaaacacttaaggtagaggcccaagaagaaatcgagaggctccgagaggaacttgatttacttgacccgggttgtcctattctgttggggtaaaagatgtctacatttgattctaggctcttcgctaaactcgaagattatcgaggatataataaaactaatgagactgaaattctcaatccttatgtgaatttttacaatcataaaaatagccaaacgttagcagatgctttatcggctgaggctattcaaatgagaggaattgagttttatttccttcctcgtgaatataacaatcctgatttgctttttggagaagacccatcaagtaaattcaccaaagcttggaaatttgctgcttatttagattcatttgaaggatattctggcgataacacattctttagtaaatttggtatgatggttaatgatgaagtcaatctgactattaatcctaatttattcaagcatcaaactaataattctgaaccaaaagccggtgatctaatttattttcctatggataactcattattcgaaattaactgggttcagccatacgatccattttatcagttaggtcaaaatgttcaacgcaagattactgcacaaaaatacatttattctggtgagcagcttcagccagaattgcaacgtaatgaaggcattaatattcctgaattttctgagcttgatttagaaccaatcaaaaatatagatgctcttgctgatatttctgatgtgcaatacgcagaaagtgacgcaatcaataaagaagccgctgaatatgttcatccgtattatgttaataacggaagaggacttgaatctcctcctaaagcagattcatttgatgacggatttttcgaataaataaaataaagatgggacctttgggtcccttaggagaaatcatgtttggacattggtataattcgtccttacgccgatacattgtattgcttggagatttattttctcatgtacaaattgctcgttggcgtgaagacactggactaaaatatattaaagtacctatcacttatgcttcaaaggaaaagttcctttctcagcttggaaaatggactgctattcagtctaccgagaataaagcaaaaatagaaactgttttgccaagaatgaatttgcacttggttgatatgcaatacaacgcgatgtataaaacatcacagctgaatagaacaaaatcatataaaactccttcaaaaattacatctcaatataatcctactcctattaagatgatttttgaattaggaatttatacacgcaatcaagatgatatgtatcaaatcatcgagcaaatcgttccttattttcagcctcacttcaatacgaccataactgagctttacgacaaagacacaagttttaatcgtgatgttagaattgtattacagtcattttctccggatgaagctgttgatggagacaatatcactcgtcgtagattagaatggtcattaatgtttgaagtcaatggttggctgtatccgcctgtagctgaaattgatggcgaaattagaaccatttatttagatttcttcgctaacagcaaagagttaactccagaaggaaactttgaatcagtagatagcgaagttactccacgagatgttcagcatgaagattggaatggttctagtaaacaaacgtattctcatgatattcctattccggtaaatccggaggctcctggaccgagaggtgaaaaatgagtgaattacaattagatatggctaaattattagacatcgaaggaattcctggaatagaaggacaagaaattccggtttatgaaaaactcgaattagttgaggttaaatctaacccaaatgaccgtaagcctgacctcgaagatgactattcggtcgttcgtaagaacatgcactttcaacagcaaatgttaatggacgcagctaaaatatttttggaaactgctaagaatgctgactctcctagacatatggaagtatttgcaactcttatgggtcagatgactacaaccaacaaagaaattcttaagcttcataaagaaatgaaagacattacttctgagcaggttggcaccggaaagggagctaatcctcagcaaggaatgaatattcaaaatgcaacagtctttgtagggtctaccgctgatatgatggatgaattcggtgatgcctatgaagcacaagaagctcgagagaaaatagtaaatggaacagactcaaccgtttaacgttctgagcgatgcccatcctttaaatgacgggaaactgacggttattcgtcacccgtctgaaatggaaacgaaaattgaaaacggagttcgtttctttaaatcgcaatgggatgataagtggtatcctgagaagtttgaagactatcttaagttgcatgggatagttaaaattcgtttgcaaggtgaagacccagctcatttccaaacgtttaaggacaaaaacaataagcgcacccgctatatgggattaccaaaccttaaacgagcaaatattaaaatgcagttgacgcgtgaaatagttgcagaatggaagaaatgccgagatgatattgtgtacttcgcagagacctactgtgcaattactcacattgactatggtaccattaaagtccagcttcgtgattaccagagggacatgctggaaatcatggcagccaaacgtatgacttgttgtaacctcagtcgtcagctcggtaaaactactgtagtagcaatctttcttgcgcacttcgtgtgttttaataaggataaagcagtaggtattcttgcgcataaaggctcaatgtctgcggaagttctcgaccgtactaagcaagcaattgaattacttcctgactttcttcagcctggtattgttgaatggaacaaaggctcaatcgaattagataatggctcatctattggggcatacgcttcgagtcctgatgccgttcgtggtaactcatttgcaatgatttacattgacgaatgtgcgtttattccaaacttcatcgatgcatggcttgctatccaacctgttatttcatcaggtcgtcgttctaaaattattatcacgactacaccaagtggattaaaccacttctatgatatttggactgcagctgttgaaggtaaatccggctttacgccttatactgcaatttggaactcggttaaagaacgtctatataacgacgaagatatgtttgatgatgggtggcaatggtcacttcaaactatcagtgcttcttctcttgaacagtttaaacaagagcactgtgcggaatttcatggcacatccggtactctcatttccggtatgaaacttgccaatatggattggattgaagttactcctgactcgcacgggttttataaatttaaagaagcggaagcagaccacaaatatattgcaactcttgactctgctgaaggacgcggtcaggattaccatgcactaaatattattgacgtgactacatctgaatgggaacaagttggagtattacattctaatacaatttctcacttaatcctcccggatatagttattaaatatctaatggagtacaacgaagctccgatctatatagaacttaactctacaggtgtttctgtagcgaagagtctttatatggatttagaatatgagaatgtcatttgcgattcaatagttgatttaggaatgaaacagacgaaaaggtcaaaagccgtcggatgttctgcactaaaagaccttatcgaaaaggataaactcattattcaccatcgtgctactgttcaagaatttcgtactttctctgagaaaggagtatcctgggcggcagaagatggatatcatgacgatttaattatgtcactcgtaattttcgcatggttaacaacacagcaaaaatttgctgatttcgtggataaagatgaaatgcgtttagcatctgaagtttttaaacgcgaattagaagatatgaacgacgattacgctcctgtagtgttcgttgacgccgtgaatagcgcagaatatgcgcctcaagaacatggtctttcatttgtataaataataaaaagcaaacaacattgaggatatatcatgcctttagtctctcctggaattgagctcaaagaaacgagcgtacagagcacggtagtacttaacgctacaggtcgtgccgcaattgtcgggaagttccaatggggtcctgcatatcaagttactcaaatcactaatgaagttgaactggttgatatgtttggcggccctaataaccaaactgctgattactttatgtcagcaatgaactttctgcaatatggtaatgatctacgcaccgtccgtgtagttaaccgtgaagctgctaaaaacgcatctccgctggttgataatattgaatggactatcactactgctggtagtaactatgaagttggtgataagattacggttaaatatgcagaccaaactgtagatgacaccggttcagttactgaagtagatagtgacggaaaaattaagtcggtgttcattccgacatcgaagattattgcatatgcaaaaagcattaatcagtacccagatttagggtcttcgtggacaactaccattacttcacagagttctggtgtttccgctgtcattactttaggtaaaattatttctgagtctacagttttactgactgagcatgaaactgcccatgaagaaatgacaaaaaccgaattccagactgcgcttgcgcaatataaaatgcctggaattgtagctgcgtatccgggcgagctcggaaaccaactggaaattgaaatcgtatcaaaagctgcatttgataaaggtgaacagctgacgatttatccggctggtggaaaacgcgcttcgactgcaaaagctgtatttggatatggtcctcagaccgatactcagtacgctatcattgttcgtagagatggcgcggtagttgaatcaactgtgttatcaacaagtcgtcaagataaagacatctacggaaataacatctttatggacgattatttctccaaaggttcttcacgttatatatttgctaccgcgcaaggatggcctgaaggattttccggtgttattcgtctgggtggtggggtttcagctaatgaatcagttactgctggcgatttaattcaaggttgggatttatttggtgaccgtgaagcactgcgggtaaaccttctgattgctggtgcttgtgctggtgaaacggatgaaatcgcaagtacagtgcaaaaacatgtgtcgtctattgcagatgaacgtcaagattgtttagcactcatttcaccaccaaggtcaacgattgtaaatattcctctgacccgtgctgttgataatttaattgattggcgtcaaggtgaaggaagctacgactctgcaaacatgaacatcaatactacgtacgcagcaattgatggtaactataaatatcagtatgataaatataacgacgtaaaccgttgggttccgttagctgctgatattgcaggcctgtgtgctcgtacagatgatgttgctcaaccttggatgtcaccggctggttatcgtcgtggtcagattctgaactgcattaaacttgcgattgaacctcgtcaagcacatcgtgaccgtatgtatcaagcaggtattaacccggtaacgggtcaaggtaccggtgatggtttcattctgtttggtgataagactgcaactactgttccaacgccgtttgaccgaattaacgttcgtcgtctgtttaacatgctgaagaacaatatcggtgattcttctaagtggcagctgttcgagttaaacgataactttacccgttcttctttccgtatggaaacaagccaatacttggcgggtattaaagctctgggtggtgtatatgacttccgagttgtatgtgataccacgaacaacacccctgctgttatcgatcgcaacgagtttgtagcgagcttctatatcaaaccggcgcgcagtataaattatattacgcttaacttcgttgctacggcaactggtgcagatttcgatgagttgatcggaccacagtaatatgaaccccaggacattctggggtcatctaacctttagatgataaattatattaccgcacactttaatagcctctatgatgatgtagtcaatcgagaggctatataaatatctataggaaacaacgatggaattaacagacatcacccgtgcgtttgaatctggtgactttgcacgtcctaacctgtttgaggtagaaattccttacctgggtcgtaacttcagtttcaaatgtaaagcagcaccgatgccggcaggtatcgtagaaaaagttccagttgggtacatgaaccgtaagattaacgtcgctggtgaccgtacttatgacgactggactgttaccatctataacgatgataaacacgaagtacgtaaggcaattattgcttggcaggctcaggcccacgctcaaggcaatgatatctctggtatgactccagccgattacaaaaaggttgctacggtacgccagtttagtcgtgatggcaaaactatcacaaatgaacacaccattactggtctgtggccaactaacgttggtgaagtacagatggactgggattcgaataacgaggtagaaacgtttgaaactacctttgccatcgactggtgggaataatgctatggggcttcggccccgtatcgaagttctgtgagttatttgcttaaatatctgacaaaacttcgatataaatatacttatagataatttcggagactccaatggcctttcatattttggacttattcgctccgtgggaaaaacgcgacgaagctgaatataagcaacaaatcaacaatgacctagagtcaatcactgctccaaaatttgatgatggagctcgtgaagttgaatcaaacgaaaacgaaatccagtacaattcattcaaccaaatgatgtttggttccaatgaacctggaatgaaaacaactgctgatttaatcaacacttatcgtagtttaatgaataactacgaagttgacaatgctgttgaagaaatagtttctgacgcagttgtatacgaagacggtcatccagtagtttctcttgatttagattctaccgacttcagtcaagcaattaaagaccgcattcttgaagaatttaatacagttttaacatgccttaatttcgagcgaaaaggagccgaccatttccgccgttggtatgttgactcaagaatattcttccataaaatcgtcaacacaaagaaaatgaaagacggaattcaggaactgagacgtcttgacccgcgcaacttacaattcatccgtgaaatcgttaccgctgatgacgctggtactaaaatcgttaaggggtacaaagagtatttcatttacgatactggcaaagaaagctattatgcagatggcagattatattccgccggaacgaaaattaaaattccacgcgatgctatcgtatatgcacattctggactagttgattgttcaggtcaaaacatcattggttatttacaccgagccgttaaacctgccaaccagttaaagctattagaagatgcgttggtaatttatcgtattactcgtgctcctgaccgtcgtgtgttttacatcgacactggtaatatgccttctcgtaaagcggcagcacacatgcagcatattatgaacacgatgaaaaaccgtgttgtatatgatgcgtcaactggtaagattaaaaaccaacagcataatatgtcaatgacagaagactattggttgcagcgtagagatggtaaagcagttactgaagtagatactcttcctggtatgtccggtatgagtgatatggatgacgtccgttactttagaacagcgttatacatggcattgcgagttcctctttcgcgcatgccggatgcaaataatcaaggcggtgtgcagtttgatgctggtacagcaatcactcgtgacgaacttgattttgccaaatttattcgtagattacagcataaatttgaagagattatgcttgatccacttcgcactaatctaattcttaaaaaagttttgtctaaagatgagtgggaagacgaaataaataatattaagattgtgttccataaagactcatatttcaccgagttgaaagatgctgaagttatggagcgtagaatcaatatgctcacaatggctgagccgtttatcggtaagtatatttctcacaagacagcaatgaaagatttccttcagatgtctgatgaagaaattgaacaagaagccaagcaaattgaattagagtctaaagaggctcgcttccaagaccaagaaaatgaagaggatttctaatggaaaattatatttccgcaattgaatccagagacctcgtagcagccaaaaaagcttttggtgcaattatggctgaacggacatctggtttaattgaagagcgcaaaaaatttatcgcagcgtctgtcatgattgagggtgaagagcccgttgacgatgaagatgaagacgacgaagatgaagataagtctgagaaagacgacgacgaagaggacgagtaatgcttatactgcctgaaaatcatgaattagttatcgacgctgtcgaagcttttcttcctgaagcacaggcacgttttgataagttgtccgcagcgctttctaaagatgatataaataaaattgtagagaacatggttacttctgagcctgatttagcaattgctttaggttcaattaacgaatctctacaattaaatgaatttatcgttaagcacgttgattctaaaggtactattacccgtaccaaagatcgtaaaacacgtgagcgtaacgcgtttcaaacaaccggactttctaaagctaaacgccgtcaaatcgcgcgtaaagcagtaaaatcaaaacgtgctaatccatcggctcaaactcgtggattacgtaaacgtaagaaagcacttaaacgccgtcaggctctggggctaagttaatggaaaacctcaatgaacaacttttaattgagcattggggtcaaccgggcgatgtaattgatggtaaacccatgctggaatctattatcgttgaaggcgaaaatgaatctggcttaaaacctggtctgtatatcgaaggtgtttttatgcaggcagaagtagtaaaccgtaataaacgtctttatccaaaacgcattcttgagactgcggtaagccgttatattaaggaacaggttgctactcgtcaggctctaggagaattaaaccatccacctcgtgcaaatgttgacccgatgcaagccgcaatcattatcgaagatatgtggtggaaaggcaacgatgtttatgggcgtgcaagaatcatcgaaggagaccacggtccaggtgataaattagccgctaacatccgtgctggttggattcctggtgtatcaagccgtgggctcggttctttaaaagactcaggaaaaggatataacatcgtacaagaaggctttcgtctgactgttggtgtagacgcagtttggggtcctagtgctccggatgcatgggtacaaccgaaacaaatttcggaaaatacctcggcacaagttgccaatagtgctgatgatgcttttatggctctcgcagagaagttaaaagcgttataaagtacgaggaggtaaatatatatgtctggtggtgacggtcgtggtcacaacaccggtgctcactctacctctggtaacatcaacggtggtccgaccggtctgggtgttggtggtggtgcttctgacggttctggttggtcttctgaaaacaacccgtggggtggtggttctggttctggtatccactggggtggtggttcaggtcacggtaacggtggtggtaacggtaactctggtggtggttctggcaccggtggtaacctgtctgctgttgctgctccggttgctttcggtttcccggctctgtctaccccgggtgctggtggtctggctgtttctatctctgctggtgctctgtctgctgctatcgctgacatcatggctgctctgaaaggtccgttcaaattcggtctgtggggtgttgctctgtacggtgttctgccgtctcagatcgctaaagacgacccgaacatgatgtctaaaatcgttacctctctgccggctgacgacatcaccgaatctccggtttcttctctgccgctggacaaagctaccgttaacgttaacgttcgtgttgttgacgacgttaaagacgaacgtcagaacatctctgttgtttctggtgttccgatgtctgttccggttgttgacgctaaaccgaccgaacgtccgggtgttttcaccgcttctatcccgggtgctccggttctgaacatctctgttaacaactctaccccggctgttcagaccctgtctccgggtgttaccaacaacaccgacaaagacgttcgtccggctggtttcacccagggtggtaacacccgtgacgctgttatccgtttcccgaaagactctggtcacaacgctgtttacgtttctgtttctgacgttctgtctccggaccaggttaaacagcgtcaggacgaagaaaaccgtcgtcagcaggaatgggacgctacccacccggttgaagctgctgaacgtaactacgaacgtgctcgtgctgaactgaaccaggctaacgaagacgttgctcgtaaccaggaacgtcaggctaaagctgttcaggtttacaactctcgtaaatctgaactggacgctgctaacaaaaccctggctgacgctatcgctgaaatcaaacagttcaaccgtttcgctcacgacccgatggctggtggtcaccgtatgtggcagatggctggtctgaaagctcagcgtgctcagaccgacgttaacaacaaacaggctgctttcgacgctgctgctaaagaaaaatctgacgctgacgctgctctgtcttctgcaatggaatctcgtaaaaaaaaagaagacaaaaaacgttctgctgaaaacaaactgaacgaagaaaaaaacaaaccgcgtaaaggtgttaaagactacggtcacgactaccacccggacccgaaaaccgaagacatcaaaggtctgggtgaactgaaagaaggtaaaccgaaaaccccgaaacagggtggtggtggtaaacgtgctcgttggtacggtgacaaaggtcgtaaaatctacgaatgggactctcagcacggtgaactggaaggttaccgtgcttctgacggtcagcacctgggttctttcgaaccgaaaaccggtaaccagctgaaaggtccggacccgaaacgtaacatcaaaaaatacctgtaaataattatgtaacttaacacaggacatcaaaaatgcttaaagaacttttaatgaccgaagctaaaactatcgatgcttccgtcgctcttgacagtattttcgaatcagttcagctttctccggaagctaaagctaacttcagcactgtattcgaagcaacagtcaaaaaacacgcagtagctctggcagaatctcacattgaaaagattgctgagaaagcagaagaaaaagtagaagaagaaaaagaaaaagctaaagaagaagctcgcgaagagctgaaagaagctgcttctaaatactttgaccatatcgctgccgaatggatggcggaaaatcagctggcggttgatcgtggtattaaggctgaactgtttgaatccatgtttagcggtatgaaagaactgtttgttgagcacaatgttgtaattcctgaagaatcagtagacgtagtcgctgaaatggaagaagaacttgctgagcaaaaagcagaaactgctcgtttatttgaagaagtttctaaacgtgatgcttatatcaattacgcccaacgcgagtatgctattcaagaagcaacccgtgaattgactgatactcaaaaagagaaagtagtttctctgacagagggtatggattattctgactcgttttcaactaagctgaaagctattgttgaaatggtgcagggttctgtagagcagtctgtaacggaatctgccgatataaatactatcgacaaagaagcagacggtttaaacttcacaactgaagcagtcgaagaaactcctgcgactaaaaccccatccgttatggatgcttatgtagcccaagcggctcgtctttcttaatttaaaaggttatacaacacatgaaaaagaataaacttatcgaaaaatggcagccgctgcttgagaacgaagctctgccggaaattgttggcgctagcaaaaaagctctgatcgctaagatttttgaaaaccaggaagctgatattaatcaggctccggaataccgcgatgaaaaaatcgctgaagcatttggttctttcctgtctgaagcagaaattggcggtgaccacggttatgatgcacagaacatcgcagctggtcagacctctggtgctgtaacccagattggaccggcagttatgggtatggttcgtcgtgctatccctaacctgattgctttcgatatctgtggtgtacagccgatgtctaacccaaccggtcaggtattcgctctccgcgctgtttacggcaaagacccgctggctgctggtgctaaagaagctttccatccgatgtacgctccggatgcaatgttctctggtcagggtgcaaccgagaaatttgaagcagttaaagctggtgatgctctgactgttggtgatatcgttgttcacgatttcgcacagaccggtcgtgctcatctgcaggttgttgaagatttcactgtagacgctggtgctaccgatgctgctaaactggacgctgcagttactgctgctctggaagctggtaaagttgtagaaatcgccgaaggtatggctacctctgttgctgaactgcaagaagcctttaacggttcgaaagataacccgtggaatgaaatgggcttccgtatcgataaacaaaccatcgaagcgaaatctcgtcagctgaaagcacagtattcaatcgaactggctcaggacctccgtgctgttcacggtatggacgctgatgctgaactgagttcaatcctggctactgaaattatgctggaaatcaaccgtgaagttgtcgactggattaactactccgctcaggttggtaaatctggtatgacccagactgttggttctaaagccggtgtattcgacttccaagacccgattgatatccgcggtgctcgttgggcaggtgaaagctttaaagctctgctgttccagattgacaaagaatccgctgaaatcgctcgtcagaccggtcgcggtgaaggtaacttcattatcgcttcccgtaacgtagttaacgtactggcagctgttgatactaacgtatctccggcagctcagggtctgggtcgtggttataacaccgacaccactaaagcagtatttgctggtgttctgggtggtcgctaccgtgtatacatcgaccagtatgctcgtcaggattacttcaccatcggttataaaggtgctaacgaaatggatgctggtatctactatgctccgtatgttgcactgaccccgctgcgtggttccgatccgaagaacttccaaccggtcatggggttcaaaacccgttacggtatcggtattaacccgttcgccgattctgctgctcaacagccgaaaggtcgtattacctctggtatgccttctatcgtcaactctgttggtaagaatgcttacttccgtcgtgtatgggttaaaggtatctaataccaataagggagccttcgggctccctttagttgttttaatggatataaataaacttataaatccacagaggaaagcgcaatggctaaaatcaacgaacttctgcgcgagtcaactacaacgagtagcaacttaattggtcgccctaatctcgttgcattaacgcgcgcaactactaaattaatctataccgatcttgttgctacacagcgtactaaacagcctgtagcagcgctatatggtatcaaatatcttaaccctaatggtgatttgacatttgcaacaggtgcaacctatgcaggtcaaatcggagccacagaacgtgagtcaattgaagaactcactatggcaaataaagactcattcaataaagacgatatgttcaaatatcagaatgtggtctttaaagtacttaaagatagcccgtttactgatacaacagaaaccgatgaatttggacttgtatctgaagctgtagcagctaataatattcgtatgctgtcagatgctgcagtcactgaaaaatttgaaggacctgattcagacccaatcaccgaagccagttttaaaattgataaatggcagacccaggttaaatcacgtaagcttaaaacagatttaacggtagaattagctcaagatttagaagctaatgggttcgatgctccagaacttattgatgatttacttgctactgaaatggcagaagacattaataaagacatcctgcaatcattgattacggtttcttctcggtttaaagtagctggtgtatccgataaaggtgtattagatttaactaagcaggattctgctccggaacaaggtcgtactctgtatcgtttcatttgtgaaatgaattcagcagttcaacgtaatacttcttattctggtacttatgcagtagcatctactcgttgtgctgcggtgcttgcagcttccggttggttaacacagaagaatgatggaagtattccggaaaacgcatacggtatgctgaataacggtttacctctttattgtgatactaacagtccggttgattacgttattgttggtgttaaggcagaatttggtgggaaagaaactgtaggttctttattttatgcgccatataccgaaggcttggatttagacgaccctgagcatgttggtgcatttaaggttattgttgacccagctagcttgcagccttctgttgctttactggtacgatatgcgctgtcagttaacccatatactataggattggacgaggacgaagctcgtgtgattaatgctgcggatatggataagatggcaggaagaagtaagatgtctgtactgctcggtgttaagttacctaagcttattgcggactaatttgcggggagcttcggctccccttttttgctataaactaaatatgtcaaacctcggggagtattcctcctcgagggatttaaacacgttcttatcatagagattgacgcattctattccatgtctacgggctatatcaacagctactctcgtccctccagatacactcccgcatcttttttcaggcgcccaatataataccttatctacaggctcagtgcattctaggcccaatacctgcatagaattccgtgcaaatagtgtctgtactatcttcgagcattcatcccagtacgacgtaacttctctcgccttaatgatgcttttgattttggcttcgtttgataattcagaccatacaacaacacctgtatcaggaacatggccacaaaagccagaataaggaataatcctacaagaatttgacctatcgtatttcgccaaccacgcttcatctgaacccggagctccacctgaatatgaaaaatgcccctcttccgagaggcgttgaccgattatagtcattagactcagaactctgcgtggcgcttctcttgaaccaatcagcgccagcctcattattctaaaacctcatgccatttgctacgaatagtgttttgaattaaagtagtcagttctttcttaacagcagaaggattatcagcgaatagcatgtcatgaccttcacgagctgcttcgttgatgatatctttcatagtcagtcccataactcgaccaaaatctttggcagttacagtaccaatatgagacagaacgttacttacacggttccaggttacatactcggaaaagatttccagaacacgcttatcagtatcagtgagttcaaccttagctttaataggcttatcagatttagctttctcgctgaacttagaattcttacacttaatagctacacgggtaccgttattaaagaatttaggattaaccggtttaagaacatagccttcagctacaccggtttcagaagaagcctgtggaccgaacacatgtttatttgcatgttcaaggtcagtcgtgtcaacaagttcattatagtaattgacaatagatttaaagtcatttacatactgagatagctcagcgaatgaaccacgaccaagcagtggagctaatttaagaccaagaccagtagcaaacgattctactacataatcgtcccaataaactttttcgttaccggaatccgacaggatatcaaacacgtagaaatctttatcaccataatctacgcccttctgaataccaccgccagcaaattcaccgaagatttgaacagatactaaatccatggtgttcagcatgttctgcatcttaacgaaagaatccttgtacttcttcatgataatctcatgaccaaagaagctttcaccttctaaaataggaccagtacgcttagccggaacgatttcggtaggggtaataatcacactgaagttagtgccatgaattttctcacgagccacccactcaacggtatgcatatcaaaaccagcaccacgaatcttctcgatgaacttaccgttgtaatgattctcaagactagaatattttgcaaacattataatttccttagaatgtgattttcataaagtcagtatcaccgttacgctgggaactggtataatttgtaacaaatccttcatcatgcaaataattaagaacacttgtaatgtgtttcttaactagactactcggatacataattaactcacgcttacccgctaaagcggttttctcaatctgagttaatacttcttcttttgctgccgataattcttctgtagcaacattaatagcagtattagccattctatcggcaaggttcataatttttctctcaataaataaaataaaaccaggagtccatctatcttggacaagggtaatggtatcagaggatttcccctgagcccattataccacatcgatttttaaagcaattaataaccgctcggtacgaagcgatacatgatatatccgcttttagttagcatgatttcaaattgacttttgcttccaacctcaagtactaatggaatatctttatccattagcatccaatcaatttttccataccgttcattaatcaaatccgttattttacgtgcaccacttttatagtagtaagaactctgaacagccatcattttactaacaaatttagatgcaaacaaccagacatttaccccattagcagctggcgtaaatttcttagaaagcatttcttcaaatcgttctactacaattgggtctactttagacattataaagtcctcatgtgtttaacaagtttcttatgacgagattttataccaacgtttgttaagcgtttccgatatacgactttttctttttgcttaaaccgttcgtgtgctttctcaactgagacccacaatttagcagcttccgctggagtgatatctaatgctctcgcaatttcttgaaaatctttaccgctttcatgcattaagtgagcttgtagtgctttcataataacctcatctatgtgacgaggacataataaaccaatccgtgaatagcaaaaaagggagcccgaaggctcccgaatattaaggatagataatacccgcttccagcgcagtacgatgaacaatgtatccatttctagattcttgtacatcgacttctggataatcatctagcattttagccagagtataccgatgcaggtaatagtcgctgtcagggtcgtcgagtttccaatctttgccctcaacagtcattcgctggatttcatccattacccaccatccgcaccagatataggctgttccacggaacggtagaggatgaatatacggaagttctccgtctggctcaggggctactcttttggtaatagttacatcgccagttttagtgactgtaatcggggtgtaatcttctgcggaaacctcaacagaaacctcaatcacttgagaccctatatcagacgtgtcaatcactaaagtgctagtagaaccttctacaggagaaccgtctttggtccaagaataaaccccagttgcaccttctggagcaccgataacgttggctttaaaagatgcttcagacccttgttctgccgtaatagactcaggagtcaaagtaacagaaacaccactcattgtctttttagtaaaagcaacagcaatacctttagttgcagttccattattataatctggagcagaaaccgttacttcacaattcaatgtgtagctggtttccgttgactcggttaaggtaattgttttacccgtttggccagaaataacagaagagccacgtttccaaacataagcaatgcttgctcctgacggggcgccagtaacatcagctgtgactacttgggattgaccaatttctttagaaacagaagttgggctcaaagttaaagtaatggccggcatagttttgttcttaactgtcagagtagtttctgcttcagctgtttcgggatcgccttcagccggagtaacagtagcaactactttaacggtcttactacctgcaggtcctgcagcaacataattcatagctgcggtaacagaagattgttttacaccatttacggtccatacaaacgtttctgtgccttcagctgcggctccagaagttgttgcagtaaaattggttgttgctccaatgactgccgaagcagccaaaggagcaatagatacgctataagccataggtgttccttattttaaagttacaaatgaagaattacgtgtttcacgaatcataacagacccgtttcttttgatgtaatagattaaactaaacagtgtctggtgtgctgatgggtgttcaaacgacgttggccgagatttccaatctggggtatctttaatccattggtaaatccaccatggaagagtaatatatcctgggttcttacctagcaattgcatgtttggactaaagtttttaggaagctcaatggtttcatcagttttaacaattttaactactttgtccattgctttgaagaattcttcagggtccgtagtactaattggaatgtttgtaagttttccttcatcatcgatatggataacgctgtctccaataggagcttcagcataaaatcctttatcattgatagaaggagtttttacttcaaatccagggtcatttactttgggtgtttctttataaaaatctgggtcaatatcatgaattttaacacttgcacttactggagcatcaaacagtagttttgcttcatcagacgcttcatcattgaaaagtgcttttccttcaatttcatcatctgcttggattaaatcagcaattgatagaccatcgttgtcttctggcataggctcatcggccaatttagccagttctttttctaagtcagcaaccatattgtcaaatgagcgggtcttcttcagtttaataccgaaggttttggcatattcgtcgagcttgtctttagcttcttttttatcgagtgcctgaatttctttaatatagtctttatctagcattgggtgtgcctcatgtaatgtataaatatgattgtatttataaactgaggatagtacagtgcacgacatccaagtcaaatttaaagattttagtcatgttcatattgagtgtgatgactcaattttctatgaactcagagactattttagcttcgaagccgatggatacagattcaacccgaaatatcgttatggacattgggatggaagaattcgtctgctagattataatcgtctcttaccgtttggtcttgttggccaaattagaaaattcgctgaccaattcggatataaagtttatttcgatccaactatattcgagcaagaaactctttcacgggaggattttgacaattggttatcgactaaagaaatttattcaggattaactaagattgagccacactggtatcagaaagatgctgtatatgaaggtctagttaatcgacgtagaattcttaatcttccaacgtctgccggtaagtctcttattcaggcattacttgctcgttattatgtagaaaattacgaaggcaaaattcttatcatcgttcctaccacagcgttagttgaccagatgattgatgatttttgtgattatcgtttatttcctcgcaatgctatgttgggtattcgaggtggtactgctcgtgattcgaatgcattagtttatgtatctacctggcagaccgctgttaagcagcctaaagaatggttttctcaattcggcatgatgatgaatgatgaatgtcatcttgcaacgggtaagtcaatttcaacaatcattgcgggtctcaccaattgcatgtttaagtacggactgtctggttctcttaaagacggcaaagctaatatcatgcaatatgttggcatgtttggtgaaatcttccgtccggtatcaacttctaagttaatggaagacggacaagtaactgagcttaaaattaatacaatcttcttaagatatccagatgcagccgcaaatgctttaaaaggaaaaacgtatcaagaagaaattaaattcatcaccaatgttaagaaaagaaaccgttgggttgctaatttagctgctaagctagcatcgcgtgatgaaaacgcttttgtgatgtttaaacatgtagctcacggtaaagagctattcgagatgattaaagctactggtcatgagcaagtttattacgtatcaggtgaagttaatactgaaacacgtaatgctttaaaggctatggcagaaaacggaaagggaattattatcgtcgcaagttacggtgtattctctacaggtatttctgtaaaaaacctgcatcatgtaattttagctcatcccgttaaatcgaagattatcgttctccaaacaattggtcgtgttcttcgtaaacacaaagataaatctttagctactgtctgggatatcatcgacgacctcggtgtaaagccgaaatccgccaatgctaaaaagaaatacacgcatttgaattattgcttaaaacatgcattagagcgtattcaacgatatgctgatgaaaaatttaactacgtaatgaaaacggtaaatctatgattaaatttgaagatatttacgaagccacaattcgtgaggctactatcgataacttcatgagtaaaattaatgcttgccaaaccttagatggtctgaaagaactcgagaagtattacgataagcgctctaaagaaactactcttgctgattctgatgacatcattgtgcgggatgctttggcggggcgtagacaggctcttgaagctgattctgaagatgacgaagacgaagacttctgatataaaaaagccccaaccgaaaggaaggggcaaagccaattggctacatcaacactagactaaattaaaagttgcgtttcttgtaattgctcttctgtgtcttcagtgacaggcaattcaatcgcataattatagcaagctccgggatgaaccgggcctttgtctgtgtggacaaccaatgcttcatcgattggtcctttacagacgacacataccgtattcgacatgattgtctccttagtttacaagtttatttattacgcgccagcttcaaactgacgaaggtcaataatgtgcttaatgctaaaacctcgtgacttgatagcatccattgcatcgctacagaactccaaaagaattccccaatattgcaatttagtatctacacccaagatttctttatcagcgcttaaaacagttttcatttctgatttttcatatacatccatgcatacttcaccaccaacctcgccacggccagtgtaataatccaaccgtgctttaagattttgctttttgagggcatctaatcttaacatctcttttcgacaggtcgagtgcttacgcacccatttaccatacagaacggggttattagccgcttcatactgtagtttagtctggtcgataatcaaatcattatccaattcatcctgtaattcttctaatctcattctatctccactctactgtttctttggaaggactagtcccattatactctactgctagagttagcattactacgcatctgtatgcgtatacgttctagcgtatcggggtcgtctactatagaaaactgcacggtgacaattatagcattatcgtcatataacggaagcacatcaactgatagacgattaatcctaggctcataattacgcacagcagagactatattacgctttatcgtatcaccagttaatggagtcatgttttcaaataattcgtttgtgatatcacaaccaaacgctgggtcaaatggccgagacccctttcttgtggttattattccaagaaggctgtttttaactgatcgagctcctactgtttttgacacgtcagtgtcccaagcaagtcgcatttctgggtcaaggtcagaatagagtttatcgatattgctcatgacataatcttaaagaattctttaagccccttaattacatgaatgtgagaaattccgcattcacaagtaatgggaactgccaattgaacctgtggcttcaatagcatatttttaatgttaactacatcttcggttgtaatagcagaatataaatcatcgatttctgcatcgtttaaatcattaaagtaaatctgctcatttccaaccacgatataatctatgcattttgatatcatcattggaatgtcggaatcgtcaaaaagattaggatacttgaactttatcttgaatccctttaagtcataccagaggtcttctggaggatcgatttgcgcatgtgtataatttaatggcacaggaattttacgcccacaggtgcaattccaggtcacctcatgattaacctcgcctatactatgcgcccaaagtataactataagtaattccgattcttgtttgtttaacccagtagcattagtacattctctgagcaatgctttaacacattcatcgattgtaccgtttttcttcgctgcaattaaattagcgtattcttctagtgtaaaagctcggcactggatattcttgccatttattcttgtttcaaatttatatgtgatgttcatatccactcctcttattcaattatttataaatagtataaagaggattaccttatggccaacatagttagatgcgaattaccagatggtgtccaacgttttaagccatttaccgtagaagattatagagaccttttattggttagaaacgacatgaacaccaagtctgaagaagaccaaaaacagcttatagcagaattaatggatgattattttcatgaccatcctgtcgagtatcgtccttatatatttcttaaagtatttttgtcaagtattggtaaaactaaaataccagtcagaatgaagtgcccaaaatgcggaaaatataagcagtatctttttaatcttaatcagcctccgttgacaaatccgaaagtagaggttgcaggattaacgcttaagttcaaaaaacctatagaaataattgatgatacaggtaaaatgattttagacaacattatatctgtgaaggattcatctggggaataccagtggaatgaattaagcgatagtaataaattgacagttatcgatgctatagatgttgaaaccttggaaaagattttatcgcagatgaagccgtttaactttgagctaaagacgtcatgctgtgataccacgacagtattaaaatatgataacattgttgatatctttaagctattgctacatcctgacgagattttcacattttaccaaattaaccatagattggtttctcaaggtaaatatgacttgaattctataatgaaaatgctgcctatcgaacgtggcataaccttatcgcttattgaaaaggaccttaaatcatgacagcacaaagattaggatatcctaatataagcataaaattatattctggatatgatgcgtggctagctaatagattcgttgaattagcagctacatttattacattaacaatgagagattcattacgcgggactaatgaaggtctgcttcagttttatgattcgaaaaatatgcacacgcgtatgaacggtgatgaactggttcaaatatctgttgcaaacagtaacacatcaagaacacaaactcgaatttacggaattaaacactttacagttggtgttgatgataaaggcgatagcattatcacccttcagcttggaacgctgcatgacataatgaatctcaagttcagtagagcgttttttagttctgcatatgaaactataaaagaaatgataggcgcgatgtatgttgaccaaccattgattgctcctcctatcaacggaattaacgcttacgtcccacgagttccatggactagtactctcaaagattacttacgatacgttagaaacgtaggcatttctactgataacgaccaatttatttttgcctgggaagatatcactgggattaacatgatggattatgaatcaatgatatcccaggacccaaatgtattcatgttcggggctcctcaaacaataggtcagtttgcagcaggattaaaatatccattagcatgggattttgaatggcttgttaagtcaaatagatataatagaaatcccatgaaaaacgcaacattttatgcacactcatttgttgacaaagatgttacccgaattattaatggagaaggccaaaacagcgtattcattaatagatcaggcggatattctgacatgatttttaggaatggctatgaagaagcactacgcatttctacgatggctcaatatgacgggtatgctcaaactaagtgttacggtaattttgaactaactccaggaatgaaaatcaactttgttgatttaaaggaccagttcagaactgacttttatatagatgaagttatccatgaaatatcaaataacacatctataactaacttatatatgttcacaaacggctctgcccttgaacctgtagatttgattaaggtgaaaaatgaacttaaacgtgattcttcctattaagaaaatagtaataaatgaaaagacgatatcaattccaaaactggggttaaagcaccataatctgatgaaagatgttaagggtccagatgaaaacatgaatcttcttttggattcaatttgtccaggattaacagcagccgaatctgatattgttgtattacatttattagcatttaacaacagaataaaagaaactgctgttaaagatgattttacctacgatttgaataaggtttacatttgccagcgattaactcaaaggttagatggtaaagaattcaaattcagagctcctcctcgttattccaaactaggttcagtagattcaattttgagcgaatttcttgaatcagtagatggaaaaccaatggatataaactttatgaagcttccagcttttgtgacaaagtgggctgatgacttagtaaacactatagccattgatggacctgaaggaccaatcaaaggcatgcttaacgtaatggaaatatttgaatgactaagaaatcagaaatgaattcaatgcgtagaagagttattgctgactcggctccacagaaaaaggctgagtctcaagctgatgctcagattaatacgctagaagatattggtcgtcgcttagacgaccaacaagcatctactgatttgatttcggatgtaatagaaactaaatcaaacgaaattatcaaatcggtagaagatgtttcagctggtgttgaattaactgctgaagcttcagaacgcacaacagatgctgtctctaaactaaatgataccgcatcgttaattaatgataagctcacgaaacttgccgacttgttatctaaaaagcatgatgttcagcaagatgtccaaaagactggtactggaacatcattagaaacgataacagaacaagtcccggatgctcctactcagcagccgctagaggaattactcgaaagacttattcctcctcaggatggcagacgtcctgacgcggatttctttcctagcacagaagagcaagaggaaaaagctgagcctaaaaaggaaactgaggacaagaataaaaagtttcttgacctaaaatttggagaattaattaaaagcgttaaatctggttttggaaaaactatttcattaacagataaaattagcagtatgctgtttagttatactgttagcgctttggcccaaatggcgaaaactgccgccatggttttgggtgtgataatgcttatagatttaattaaagttcattttaattattggactaaattattcgaaaagaactttgttgaatttaacaagcaagccaaagaatggggtccgctattaacagcaataagcgagatgtcgaatgaaatagtaaaatcattcgtcaagggagattggggcggattagctaaagccataggttctggcttggttgatgtaattgacaagctcggagaaactattatgctcggaatgagtaagcttcttgctggaatgttacgcgcattaggatttaacgattcggcagataacattgaaggcgctgctttagacagatttcaaactgttactggagcagaactcgatgaagaagatgctaaaatgagagcaaaatatgttgaccgtcaagaaagagaatatgacgaacaacctgaatggaaaagaaagctttctgctaagttccaaaaattcaccggtcagattgatgacgatgaatataacaaactgctgagcggagagaaaaagcagtcagcgtatgcagacttgccagaagaagaacgcctcaaaatcatcacagctcgtaataatgctgaagcagaaatgaagagaacaaaagcatatgttgaaaaaactgatgcatctgattccactcgattagactctgctaaggatgcagtacaaagcacaaccaccagatataaagaattggagaaattatctccagaagttgcaaaagatttaaaggttgaattagaccaattgcaaaagcttcttgattctaaaatatcagaacctgctccaactgccgaagctatacctgcagcagaacaacctgaggttaaacagtctgcttctattaaagccgccgcggatagtcgtgaagctgctcgtacacgtgaatctaatacacagtcgcaacctattcaggttaataccgctgtaaataagaatagcacatacgtttatagaacgcctccacagacttcgacagctgctcctggaatgcaaggcgctatgaaaacctcttaaggaaaaataatgatttttgaagaactggccgatggccttgaaaacatcaaaaaatcaggaactcgaatttcccaaggtaaatctaaactgacgaatgcgccaaccactaaggtggcgcagttcccagctgaacgttcagctgggaatgattccgcccaagatatgagagtacatgacttatatcgcaatgggttattattcacagcatatgattttaaaggaagaacaactcctgatttgcgttcatttagacgagatgtaatgttatcgtctgtattcgattcaccaatgtcagcattggctaattcatcaagctctaccactagtactgcaccagtagctaatattctattaccgcggtctaagtcagacgttgattcagttagccataaatttaatgatgttggggattctcttgttacgcgtggcggcggtactgctaccggtgtattaagcaacgtggcttctactgcggtgtttgggtcgatagagtctttaacgcagggattaatggccgataatggtgaacaaatttataacaccgctcgtagtatgtatgccggacctgacaatagaacgaaagtgtttacttgggatttaactcctaggtctgcagatgaccttatacaaattattcgcatctatgaaatttttaactactattcttacggtgtgacgggaaattcatcatacgcaaaagaagttaaagctgctattgatgaatggtataaaggaactcttaaatccgcagctccagatggggctaaagtagaaaacacagtgtttgagcaaataacatcgtttttaagcaatgttattgtagtttctaacccaacgatttggactgttcgtaattttggatattctacatcaatggatggtagagaggatatatttgggccatgccaaattcagagtatccgctttgataaaacgccgaacggacatttcaatggtttagcaattgctcctaaccttccaagcacgtttacgcttgaaattactatgcgtgaaatacttactcttaatagaggtaacgtttatatcggaggtattgaataatgtttactctcgaagaatttaagagtcaagctgctgatatcgatttccagagaactaatatgttctctgttgtattcgctactgtaccctctagtaaaacccaggctcttctaaacgactttggtggagagctgtataataatatgggtttagatggaaattggcttggattgacaccaggtgaattcaatcagggtataacaactatagtgacacaaggaactcggcaagttgttcgtaaatcaggtgtgaatacatttatgattggcgcaatgactcaacgtgtggtgcagtcattattaggagaatttacggtaggtacttatctgctcgatttctttaatatggcatttccaacagcaggattgatggtttattctgctaaaataccagagaacagattatcatatgaaatggataagttccataacgctcctaatataaaaatcacaggaagagatatggaaccgctggttctttcatttaggatggacccagaagcaagcaactaccgggcaatgcaagattgggtaaatgctgttgaagacccagtgactggtctgcgaggattgccacaagacgtagaatgtgatatccaagttaaccttcatgctagaaatggattacctcatactgtatgcttgttctcaggggctatgcctgtagcgtgtggagctcccgaatttacatatgatggagaaaacacgatagcagtgtttgatgtcacgtttgcatatcgtagcatgcaaacaggttcggttggaaaacaagctgctatggattggttggaagataaggctattcagaaaattgagacgattaatccaaatcagggcttgagtgcgtctgcttcaagattgtctcgtttaggcggggctggtggtggaatttctaatatcactactacaacaagtagaataatttaggggccgtaaggcccctttgttttatgcaatgcagccaataaaccctggctcagtgcgaagaagttccatttcgtctgtggtccaaactactttaacaggaatgataccttctgctttaccgtttagaaccgcttcgacaaacgatggttcagttggcttacggaagatatcttgaataagaaccgtcggagtaccttcgttaaacccttcaagcatgataagaacttcttcattgaacttctctgcatctttaacatcagcagaccattcaataccgttaaagcgaaatacgtgtttcatatcaatttcctcattggtttgtgtaagtctatagtatcacgtccttgtgataagtaaacaactttatgcaagtttttctgggataccatccaggttgatagcaccagccagtagctccatggtacgcgtgtagctaaccttatctgtagaacggtctggcgaaaagtaaatctcatttaaaaagcctttgaacttgctttcttcaagaggttccactttgccctgttccatcaagatgtcaccatcatagagatgaacggattcatcgatttgctctggaggaactaccgtcatttctaccatgaatgtcttgttattcgctacaccaactccatttctaaaaggagttccccataccttgttaactttcattgccaacccgcgaggaagaataacttcagcctcatcgctaaagcttgacaagacacccgggataactaccttaactttatcggccccatgaataacgaatccaaacttaaactcatcaccataggcaacttcctcgcctctatcaactctttccaagttgtctgttccaataacggaagatactgcatcaatagttgtttctttgttttctaaatcagaactaggtgcgtctggcattaatgaatcaccagcatttgaataagcaccaaagataattggacttaacgaagtagaaacatagttctggaaataaaacattttagactcaatgttatctttaaagtcttcatattttcctcgctgaccgcgatacaaaagagtgcctggttcaagacgcaaacctttttcaaaggcagaatcgagcggacgaattttcttgtcaataatcggatcgcctaagctttccataccaataagatagttattaacaaatgaataaccagaaccgcagtaatggtgtattgcatctctttcttcttcgcttaaacgagattgcatttcacggttatattcaattgctttggatatagaatcgccaacaattgacacataagcggatatcatataattgacaagattttggtattgacgtaaagctccgaaatcgtcagctggaggcatatcaaatccacgagtagctacttcaacgattttacgcattgtttccatagatgcaggatttttagcttgagcaataacgtcagcaacgtctgaaattcgttgttcagcgattttcattttgtctgaacccgaaggaatgaaaaccttccagtcgtcatgcattctagacatttggcctacaaataatctctcaactgcatcgccaaaattacttccatatccgccacgaacacgatagtgcttgatatcatcaacataaaaaggaattgatttttctaatccggctttgatatctttttggaggtctaccgtatcgccttctgcgtttagtactggagtgttagtagttaattcgtaccagcgttcacgtttattttctggccaatcttcatcaacatatgaaacaaatttgccgtactgtgctcggattaaatcttttcgagacactttcattttactcattacagcgagttcagatttcttgtcttctttttcgccaatggaattagccaatgcttcggctttggtaacgttttcgccggtttctttagacacataaacttcgcctactttggaatctactttggtgtaaagttcttctgaaatttcaggaattccttcaatctcttcaagtttcttacctttacgaaccataatagaataagcatacttacctttgtagtaagccatatctttcattagattgaaacgaccgccggtgcgagtagtaatcaaccgagcaagaatgcgttgaatagctttatcctgtccttgcattttcttcggattaaagcggaacattaccgcatcagctttaatttgcttaactactttgttgacggtctcaaaaatggtattgatagcaccaatcgggtcttggcctaaaccacctttaagcgcgccgatgttgcctttttccgacacagagaaaacatagacctggatgaatttatcacccatcttgatgttcttaactgcatcaccttgacctgacccttgtactaaccgaatcattaaattgttattacccggcaccttaatcaaaaagacctgtggtaccttaagttttggcttaacgttctcgacgggatagattttactattctcttcatcgaaaacttcatttaaaagttccatgacatatcctcgtttgtttattctatttatacgaaaaaaggcccgaaggccttaattaattattgttactgtacgccaaacttgtagtccatttacagactcatactcttcaatgttttctttgaagtttcttaatgtgttaatgttattaaactcaagaacttctgtgtgaacagaaataccaccacgtccgtcaagagatttagcaatcacttcgtataaaactttcattttattcctgttgcctcagtaaagttaacaccaaacgcggcttcgaatgtattagccacttctttatcatatctacgctgtttaatgataggtaagaataatcctactgtaccatcatcacgaccttcagcagttacccatccattgcattcaagttcccagatagttcccggaagagaatctctgagcttccataaatgagtacggtcaagttcatgtaattcttcgggcttatctttaagacctgacccagcgttaacacgaatacgaccacattctgatacgaacattaagccgcccattttaccaggttgttttctatgctcgtacgaaccgacacatttcaaatctacggtgataacctctttaaatttaacgaggttcttagaacgcttatcttcccaataagcaccgatattcttaaggataataccttcgagaccttggtctacgtatgtcttatagatagcccgagcttcatggatgttatgtacgacacggttttcaattagaataaccttgtcatagcctttgctcatcatttccaatgcacggaagcgtacatcataagcaaatccaggaactttaccttcggaatatactacatcaagcggaacataatcccaaacttggaatctcataccttccgcttcttcagcagagattgttcctttgattgctttattagccaatccgtttgattctgtacgagccgtctgttggaattccttagccttacttagctcaggaagctcaggctctttaaacatatcaaacaggtcgttttcttcttctttcacttcgacatgatataccaactcgccgtcaatcatcacaccattaggatggcgttctcgggcttctttggtcatctcgataagttgacgcttaagtttatctagacccaggtattcattaccggaacgagtaagaagagttacatcatctaaatcatctccgcggatttcagcgaagcaccgggctccatcggctttaagctgagcgaatgcaggaaatttaatatatgatagcgctttctcagaataagctgatgctaacatctgtggcatctcaggaattaatttcttccataccttgttagcaatagaacctgaagcgccgcaacgcatatccttaagaaggacacggaccagtacactagcatcaccctcgttcatcttagagagcaaatctactagcccctggattgccatattaccagtaagtactcgtgctgccagaatgtcttggaggtaatctagaccatcagaaaacgtctttgaaggaacatttggatatttaacgggagtatattctggaactttcttaataaagaatttaaatcgcccggaatacgccagcagataagctcgttttaaatcaacgttatctttattgtcaataagaatttgggttttagctttagaacccttagcatcttcaattgctttgatgatatcaaaaatcattattcacctaattcttctgaaagttcgcttacgctacgatgataagttaatccatcgatataaacaaacccgttattgatgcattcattccaaatcgggcacgcctttgcttcacgccaaattggattccaacgataaaactgattaacatgaccgtaatcacatgataaccaacgtttacccaccttagtatgaactacaaacattattcctccttgggtatggtcattataccatacccagattgttagcaattaatttggtggttatcacatgtaatacgaccgttattccaccagtcgtttccaggaggaacatgcggaccaggactaaacggaatgataggttgtttccaccaatctcctggaacttgtcgtggaggccaattaaaaggatgttgctctttacgaatttggtctttgatagcttcttcccacaatccagaaagagacttctgcggtttcttaacggatttcagagattccaggcaagttacaatttgatgccaatcttcaaccataattccaggagcagtcactgaaccttctcgctcaccacgaggcatataaaacacacgagtttcagtgtcttcaaatactttgctggccgcagcaatatgtttaggcaaatcatctacatagcagacgatgcgatcgccgtattttactttagccttttccagtaaagcatctttagattcatcataatcgcagaccatgatttctgtaaatgcatcagggaacaaagcatttagattgaaacgacgattaaggttagcatctactgagttaccaagagccgtgatagcgacaaaatcgtatttttctttgagcttattaactgtagctaaagcatcagcatacggagcaagataacgaataaaatcgctgttgttgtacttcagaagcagcttaacagccagttcttcttcacaatcaaacagctcagcgggtttaatgaatttttcagtagtcatcatatcaaggatatgctctaccggaagattatatttttgggcaaaataaggcagaccactttgccacttaacgatgattccatcaacatcggttgcgattactggctttgacattcggggaaattcctcaatgcttgtttaaatttggcaacgctatttgcggcaccggtgaaattgaaccagattaaccctggagcgtccgcgggttctatatcaattatttctatattataatactcagcagtctttagcatttccctggtgatacgtcgggcaaccatatgaccgaagtgaggattaatagacatcgtcgttagcagcccttaattgagtaattggataaagctcggattctgcatggattgaacgattgccatcaacccaattaacttcataccacggttcaactgagtaggctttaatggctggagccgtatcacatacaactccaggaattccatttgctaatcttactgtactgaagatatgatatttcatgcatcaagtctcactgcccattcaggcaattcaaagaaatccggagcatcaatttcatactcaacggtgtgttgtttaacgttagctgacatgatatcaaccattgggtggtttttcaaactgcaagaaaaaataccagctttaggtttaggcacggatacaatcatgttgatttcctcaaaatttagttatgaatttttctttcggcattttagcatttgagccatcactgtcagaatacccaattggcatagttgcattaatgaattcaattttagcatttataacattaatgctcagagaatctacaccgtcaatcatacgaaattcaggagggcaatacttatcaatgtatgctttcacaccatttttattagcaggtgtaccatcgcgggtatcgctgataatggtttcaacttttttctttcgtgaatcatagaaagctgatacaatcatttcaatttcctcttaaaacgggcgaatattaacgtgaaccacagggacagcaaaaggttgcatgattacaacttttgtgtctttagttgcattcaggcgttgtacttttgcaagattaacagcttcttcctttgtcaatccacctttgtaggtatcatttcctttatttgaggtccaaacaccccaatcattgcttccatcgtcggtcttcggttcaagttctttgtagatggtttcttcaaaataatgctgaaattcttgattagtaataatacaccacatgtgagaaaagcgaacttcatctacactaacgcgtttgcattctccatctggcttaatgatttcaaattcaactaatccggtattttccgcatatttaaaggttctggtaattttaattggattattaccgatttgctcaaaaacacccttgataagagcgcctggagacaagcttggagtctttttaagcttatagaatttacctttttccattatcatttcctcaatagtggggccgaagccccgagttagttaaaacttgatttcgtttgaaacgatatcccagattgcttcacgttgttcttcggttgttttacgaccgaggatgtggcgcagataaattttaacaagcagctgacgatttgtgttccaagacggatgtgaagataaatcacgtttacgaacttcatcatgaaatccaactttgatttcagaaccgttgaactgaatatccagagtaggaccattttcaaagctaaagaatacgtagttatcttcccagtacatatcgatttgagctactgtgccgttgttgtgttcccacagcaaagtagtagaaacgtcccaagcattgttctgtacgtatttgcggttgaagttagtgaagttcatttttattctccgtagtttgtttatctgtttgggtggtacaggtctatagtaacccagaccacccaagaagtaaacaacttttattcaaaaacttcagacatttttcacctctacagtttttacagtttttacttctgcaaatccgatgcttttaaacagttcatacttggtagtttctggaacgatatcggttagctcaaggatgatttcttttgcttcttccagagtaaagatgcttcttccgtccttaacgaccggtgctggtttaatagcagctgatacttcaaaaaccacgtagcggtcagtagtactttgattttcaaacgctcctatttgcacaacccgtccttcttctaactcgtgagaagaaaataagcatgacagagaccggtcatattcatctcctatggtttttgccgaaatgattttaccagtttcggttttaatcttaacaacccggcccagcgaatcaagttctaatggcgtccagccttgaactccaacaacggtggcaatgagatagttaattgtgttcttagcgtctttccatctacggtaagtttctggggaaatgcaatatactcggtttttgctgtaattcattttgatatcctcaaagatggggccgaagccccagtcaagattactgtttagtccaattatccatgtttaatttaccaacctttttcatttgttcaattaaagcatcggcacgattacgaccattttcataccaggttacatcttctgagtaaccgtcttcttcatctgtgtaggtttcagaacgaatacgaccaacaactggagtgttcagaacatatacagaacccgtgaaccagtttgttaaagtgatatgccagcagaaatcatctgatggaccgtccggtgtcatgcatggaacgatatcaccttgaactttagacaaaatccacattttctcatggacagtttgagctttgtaaccgtcatggtctttagtcttgatagttgcgttcaggttgatggtattcattttattctccgttgtccgtttgggtggtacaggtctatagtaaccttgttgaacttagaagtaaacaacttttttcattctgcggaaaataaaaaagggactcccgaaggagtccctgaacttatgctttcggcttaccaaaacgagaagcatcatcgcgaagaaccgcacgagcccgacgcatgattttctcaaccgtctgattgatacgcttgttcgacccacgcttgtagccagcgcgtttagaggtaccaacaacttcttttactgcagtttttgctttagcttgtttagccattttatcatcttccattttggagaaatacatgggagcacgttcttccgaggttcaacttctttcgacagttctttcggttgtagctcccgcaagccctcaagggggtacgtttaaactcttatctgttgcacaccgttagcttaaaggttccgggtccgatttatcggggataagatatacaccgatggatgtataggccttgaggcgtactcccgattggccatcgcctcggggtagcatgcacttgccgtttattttctagctgcactttggtagcaaatcaccgttggtttcgggtgttttacgtggggataaccaacaacgtccacatcatacgttacccatgcgtacacatggtgggcgtacaaattacttcagcgttaccacaaagtggcgaacagctttgcgagcagcagaaccaagatgcttagcatacttcagttcgtccatcgcttctaaagtatcacgaaattcagcttgtgctgggttcaggtgtttaaaccctttcagaacttccagtgcttctgcatagatatcgattgaagcaccgtagttttcgtgaccggaattccatgcattacgttggagttccagagctttagtaagttgtttgttcattgaatcgttcctcaaatgaggttaaaatttggtggacggtaaccgaggtttagctcgggcatccaccgcgtagaattgctcgggtaactaattgtccgacgcccaattcatattattatttatatacgcatgcaagggacttataatgacaagtcacaaacttctgccgaatttctttgggtttcttcacacctgctgctactaacggatgaggtacgtttctgatattaccaacaggcagtggagtcaaatcaccgacttcaacaaatcctttcggtacatcatcaccgatagaatagatttcacacatatccggcagttgtccttgttcttcttttccaagaataataccggaaggagaaacaatttcatcaccttgctgagcaggttcagatacgagaattacatactcgcctagagctttaattggaagttccatgtgttacctttattgtttgaccatgtagttatattaacatggtcagtttaaagcaaattacttaccgatcatctgcagcagatgctcaactttcataccatttaccgagataagtttatcaaaggtaaatgagcgccaaccttctttctcagtatcatataccggaagtgaagtagtgctttctgctcgggcagatttaatagtgctttctaccaaatcagatggaataatatctttatcacgagtacagcgcagagtacgaatagtgccatcagctttttcaaacacaatctgggattcgcccatgctcagcacagccttcagagtttcacgaatatggatgttttgttcagtagtcagtttcattttgatgtctctttaatagttttgataattacagatttgcgcttggataattcttttaataatcgaactgcttgatcttcaaatttaaatgttgctaatggtttccatttaaaccaataccggcgttctactgagtatgatataacaacatcaccacttaggttaagtttattaatttcaacaattctaagtttcattattcaattccacagaattctttaatgttataccaattcaacttatccaaattacgttttggaacattgaacacctcgattccagcagaacgaagaatatcgtcccaaccgggttcgttcttgtcgtatgtttcgcagtatactaattttttaataccagactgagcgatggcttttgcacaatctggacatggagacagtgtgacatacattgttgctccatcaatactactgccgttccgggcagcaaaaagaatagcattaagctcagcatggatttcattgactttagaccatgcagagtgggctgctcgatgttctttgagcaatccgacttttttgacttggaatccgtcttgacgcaatcctgtagatttgtaaggaatttcaccaatccaaccttgttctgctgcatggtcacaacagttcacaccaccagaaggtgaaccgttatagccagtagaaataattcgtccgttcttttcaattactgcgccgactttccacgagcagcattttgactcttgagatacgagatacgcaatttgtagtaccgtcgacgctttcatttaaatcaccagataagttgtgttatttgttttaaccaattttaactcgtcagtaggagaagcaaaactctctactcgagaagtacgaatgcctgtaccatctggaaacggatgattccctcgttcaagaacatcggaaaagacataaccataaagaggttggccttccttaacattaacgttactgtacaaaatagcatcatattcttcgcgtggaattgaccaaacaccttggtcagaaccaataacagcactgatcagccgaatgccatttgggctgatttctgctttaatgccacgagcatgttcaattaaaagagcttctaccgcttcacgtaaagtcattagatatgtcctaaaatgttagtcatttcaacttggcctgttccggttaaagccaattgagtgtgttgattgctctttccattattaactgtaatgatataagcatcaacatagttaaaggatgactctcgtcggagagtcactttacttccaggaacccggtttgctacttcctgtgcgaagattttaaccttcgaaataaattcatcatgcgaaaatttagcgtcagacaacataagtctcaacctgttgggtttcaaaattagcaataattccaacgataaaccagtcgtgttcaccttcgccgcaagaaattttaatttcagacgaaccgcctgaccggtcaatagaaaatttaataacttcgccgtttggaataagtgcattcattgcagataaaaactctgcatgcattttggctacttcagatggagtaaactcatctgttaaatgattagcaacaacttgcgtaaatgatacttttactacttcggaatactttggaaacattatactttcctctaaaaatcaccgtgggctacttgccagcattcaacaccgatacgacgccacatttcaactacctgcgccctgtcatctactgcaagtttgacattataacgatcagcaattcggtcccagaagatttcttcttttaccacatcgtctttgcgtgaatcgccttgcttacgttggaagtgttcgcctgtttcgccaacatggtccaacaaccatttcttcgtaatgcgttgataaacagtagggtcttctttagtaccagactctctgccggaaacagtaagaattttatatcctttgttacgaagcattttaagaaattcaattaccatttcctttggatggtctttaccacatttggccaagtcataaggagaacgatgattgttatctgctaacgtgccatcaaggtcaaagataactgcttttggcaatgattcatctggaatgtacaaatcatacggatgcatcttagagtagaagctacggagcacttcaataggaactgcattcgcgccacgatagaggttacgcttaactagttcagtccaaggaacgtcaaagcgtttaatttcccacttgacaccatcaatttcatatgccaactcttgccacttcttgatagtcgttggattaaggttagtatcagcaatgatgacacctttagtggtttccatctcgagtagagtcttcgccatagaaaactggcatacagatacagacttctcacgaagcttagaatatttgtaatcattacgtttatcaaggccaaagatgccttcacgcaaatcatcacgagacaaaacataccaaccgggattagctgctacgtattcgttagcccaggttgttttaccagagcctggagccccttgtgtcaaaaccaattttttcattatacatccttaagagtgtcaataaaatcatgaagagccttagacttttcaccccaatttgcacgatatttttctttaattgctcgcaatggcttattcattgacagtatatcatttttgtcataattttcagctgcgcgtccaaacacgatgcacgccaattcattttcagcaattaaccctttaagtgtttcatactgttctcggttcattataataccatcacttaacgcaacgaggttctttaaggtcagaacgataataacatatcattccgttagcatctttagtataacgtaaaatgtcattcatccagatgcgatactcttgagactcttcaaacggcataccaacccaggctttaccgtcaattacttttacttcccaatgtccttcccatttttgaattgggtctggccactcaggatgcaaaaccgggacatccggtgcactagaagaacatccaacaagtaggctgataatacccatggctaatagacttcgtttcatctggtagcctcctggatatcttctgcaaacttattgaagcttgcattaatctgtttttcaactaacccaggtttagctgcaactacgtttccacgcttagcatctttattcattttagcgttggaagtatcacgagctgctcggttttcctgatagcctttataggttgtctgcagattttttatagaaacaccgatattttctatttcttttgcttgtcgatcagattcatcttggacgactttgaggtcagctttaagattttctacccgccacgaaagatatttcaatccaccgacggataatgctaacacaccaatcatcaaccaagttgtgtttattttgagcatagtttaaggataacctctacgatatcatcacgggataatcccgaaatgaggatgtgacgatcagaactttccgaaggagaacacttgaagcaagcttctacatattctgccatctcagaataattcagctcgcgatgcataatgccaagacgatgtttgccataaatcgggtcaacgattacatagcatttgcatccgttggcatgaacgtttggttgagtgatgtttttaaacacctctgcaccatacttcgcgagatgattatctaggaaatcaatcatttcatctacggcttcaggcaaggcttcggcacgctgctcgttcacacgattagtgtactctttttgcttcttacgagcagcttccttgcgtgccatatgcgttcgtaggtcagtgacgaatcccactttcttggtgccattccacacaaaatcccgtcagaatgagtaccatatttgttaacaaccatatctaaagtaattgcttgcatatccatttcattatcctcatcagttggtgtaagtctatagtatcacaccttgatgaggatgtaaacaactattcttcagaaatttcaatttctttttcgtactcttttggaacatatccagcccagtacttcaagaacactttttcgaggtctttaagcagtttatcaacatctacagttccttcgtacatgttcatgataacaccaaaaagatgacgctgattaaccgtggctttctgcgcagcaatagcgtagtctttacgagcacgacctctgtattcatcatagaatgactgacatagctcaagtgactttccgaggtaatctagataagcttgctcaaacgcagaaattttcttaattgcgtattcatctccagcaaaaagagaacgcaaatcatcggaatttgcagatacgacagacgcaaacagtctttcatttgacgttattgagtctttagtgtgatgaagagccgagtaccattcggttttaaccttaaatctctgcccagtgtttagaactgcaatgtatccttctacgccttcaagtgcacgaacaccttcaacccaagtgtcggggtcagaaattccataagcattaattaaataaggacgaattttagcattagcgtacaaatcgtcatatttaacatactcgccggttgcgttatcacggacgtttaacacaaacagctgtggctcctggtatgcaagaacaacacgattatcaggtgaaacaaattccatgtttacagtatatccatctagtgctagttcaagaacaacttgatgaagcgaagagtattcttcactattaagcagggcagaagaccttctcgcctggtcactgtagagagatgtttttgacttaaggtatagatacccatcatcaacataagatgatactagagagccatcagccttatccataatgtattctacatcgctaatatcaattcccatcgttaatgggttttcattcaaattaaagaatttttccattggacgagaagcaattcgaattggagtatcaccatccatttcaaacatgatgccccggcactcaagagcatctggttttaaccactcgctgtagcttgcatagtgatatgaaaacactctgaacttaccatccataggaccggtaaaatctttataaaagaattttgcaacttctgagctttcacacagattcattaaatttttatatagctctaacatttctttaccttatgtttgcaattatcgtagtgccatctgatagcaatggcctttgaagttattataccacaatgcgggcatggactgtacaaaggctttttctttcctttttggctttctgaccgcttgagtttagtttcttcagattgtgttttaccggttaaagattttgatatcttttcgcgtgtttctttggcatgagtctttccttgagtgggacttactctgcctttcagtgctttagataaattctttctatgttcttccgttcgtttctttccggagaataagttagatgtataattagaatgctttattctagagctttcataaaatctggaatgaactttaaaattctttccagaagaattacacatcatccaaagagcataattcattttagaattattatgtatctttgataatagcaaatgggcaatgaaatgttcacgtccagtcaataaaactaaattagaaacatcgtcatttcctcctaatgattttggaatgatatgatgagcttcagtataatagtttaattttcctttatcattgcctcgtaatttaccctttgctattaggttatcatatactttaacatagttcatttagctttgttagtatgttgtgtgttccatggaggattgaacttcttaatcagaagaggttcttccaagtccatagtggatattgacatctcgccaagttcattattaatcgaaagattaaaacactgacgagcatagaactctacttttttgccagccattagtgcttcaaaaatcttggcagatttagctgaatcagaggtttggtctttccgattaatagcagttctataataatttatacgtttacgaagattttttgtcttaccaatgtaaaccagctcatcatcaactgcgatggcataaactacgttcaacttgtttgctatcagaattggtttgatggtaaaatctggttctaactcaagttgaacatattttataaaagaaaactcgttagcaatatcattcataataaagaggggccgaagcccctttccttataagtactttttaaatccaattagaacatcatcagtgacatcattgtcaatctgagctaccagataagaacttatctcaacttcctgaggagcagattggactgcatcagagttaagatattcacgaatccagggaataggatgtcgagttggtgcgtcagtgattgggcacggcagaccacagctacgcatgcgagatactgttaagtagtcaatgaagtcatgaagaattttaacgttcagacccggaagaccaccattacggaaaagatggatagcccaatctttttcttggcggttaacttccatgaagattttaattgcttcttgttcacactctttagcaatctcaacccattcttcgccatcagtgccagtttgaagttgacgcagaatgtactgtgtgcccttcagatgaagttgttcatcacgagcaatgaacttcatgattttagcattaccttccatgatttccatatttttatggaagttgaaggtacacgcaaaactaacatagaaacgaatagcttctaatgcgttaataacatgtaagcaaagataaagagatttcattaaatcgcgtttagcttctttaatttcgatattatcttgattaaagcagcgatttttggcattttcccatgcgcgagtcttcgctataacatcatcatagtaaacaccaattgactcagcgcgtttcatgattgcttcgtcaagaacgatttcatcaaagattttagctgggtctacataaaggttacgcatgatatgcgtgtacgaacggctgtgaatggtttcactgaacgtccaagtctggttccaagtatctaggcttgggtcagaaataagtgcagataaaactgctgctggagctcgtccttgaattgaatcaagaagagattggtacttcaagttatcagtgaagatattacgctgatgttctgggagtttttcaaactgaccacggtccatcataacgttaacttcttcaggacgccaaaagaaactcaattgcttctcaatgagttcctcgaatactttatgacgctgaatatcatagcgtgcaattcctagaccagaaccaaagaacatcggttcggtcatgatatctacttgcttggtattaaaaactgtactcattctatttcctattctgtggtgttaaccatccgtggtctaattataattcccttttattaaagcttacaggccgcgcagtcagcagagtcttgaatcatatcatcgttaccggaaccgtcacgggtgttatgatagtaaagagtcttaccgccaaagtaccagaaataaagcaagtcgtccatcattaccgacatttcaacttttcctttagggaaattcgccgggtcgtaataagtattagcagagatgctttggtctacaaatttctgcataatcagaacctggttcagataaggcttattaccctgtttcgcgagctgccaggcataatcataaagggaagcattgtgctcaacatttggaacgacttggttgaagcttccttcttttgattctttaactgacactggtccacgtggtggttcaataccgttggtagagtttgatacctggctagacgattcgcatggcataagcgcagataacgttgaatttcggataccgtatcgcttgagatcttctcgcaggagttcccagtcacagacatagtttggagctgcgagttggtcaattctttcgttgtaccagtcaataggcagttcaccacgtccgtatcgtgtttctttgtaaagcgtgcatggacctttttcgctagcaagtttaacagaggctttgatgagtgcatattgaatacgttccatcatttcgtgagtaatatcattagcatctgcgtatgaagcaaagttgcttgctaaccaagctgcatagttagtaatgccaacacctagtgctcgacggtctttagcttttaacgctttgtctacaggatagtcttggtaatccaaaaggttatccaaagcccttaccattacttctgcgatttcgttgacttcttcttggtcttgccagttgaagttgtcgagtacgaatgctgcgagtgtgcatagcgcgatttcgccatcttcttggccaacatccgaagttggtaacgcaatttcgaggcagaggtttgattgcttaaccgtagccacatcacgaataaaaggaccatattcaccaacgttatctaccatgtacgggtaaattcgagcagtaccagcacgttcagtaaggaacaactcaaacagttcacgagctttaatacgtttctttcttacgtctgggttcttttccagctcttcgtataaagtacggaacgcttgtgcatcacggaagtattctgtgtacagcgtgccaagacatacatcgggactgaacaatgtgatgtaatcattcttaatcaaacgttcaatcatcaggttattaatctgaacaccataatctaaatgacgaatacggttttcatctacacctttgttgttcttaagtacgaggaggttttcaacttccaagtgccagattggatagtacagtgtcgccgcgccaccacggactccaccttgggagcaggatttaactgctgtttggaagtgcttccagaaaggaataactccagtatgtttgacttcaccgaatccaatttttgaaccctctgcgcgaatcatgcctgcattaataccaatacctgcacgcttactgatgtatttcgtaattgatgcagcagcttcgttaattgaattaagactatcaccaccttcaataaccacgcatgaactaaactgacgtgtcggagtacgaacaccagacataattggcgttggcaatgaaatctttttagtagaaactgcatcatagaaacgaataacgtttgctaaacgattttcgccatcatcttggtgcaagcacataccgatcaacataaaggcaaactgtggagtttcatacaattcaccagtgtgacggtcttttacgagatacttctcgataagctgcattgttccagcataagtcatagtgaaatcacgctcatgcttaatataagaatcaagcaaagtaatttcttctgctgaccatttacttagaatttctttatcgtacttatttgcgttgacgcatcgggaaatgtggtcaataaatgcaggtggctcaaactgtccataaacacgcttacggatttcaaacatagctgcattagacgccacatattggtaatccggttcatcaatagaaatgctattcgccgctaccttaacgatagtcttttggatatctgcagtgctcatgccatcacgtagatgggatttaataatttcatataactcgtatgggtctactttggttccttcgcacgcccattcgaggactttaatgattttctgcatgtcaaattcttgactaacacctgagctcttaattacttgcataagtcctctaattcaaatgtatctttaaaaagtttattcactacaagagctattatatcaccatggcaagaaagcggtttgcaggtgcatcctaatctcattcctcttaaagtttctaagtgctctcgctttatttctccgttccgaatcttagcaataaaatcgtccttaaatgccgcaatagcatcaggacgattatcgcaatctttaccgacgtaatttccccacattgttccacgttggatatttacatcgaagtcggaatggtatttattaaccacccgacatatcttcatgttatatcaacttcaaaccagcagattaattgtgttttgccaatagaccattcatatgatttaatgacagataaaacgcgttgttcgatcccgtcaaaaactatcttgtcattaacttcaggcaaatcactagagaatgcatcacacatctcgcctaatattgtttgtcctttacgaacaaatcgaatattcatatagccattttccccttaattgttggatgggatttatatccttcaagaacaaagtcagatggtttcatcattcctgtaacccaagctaattgttcttctgttgctaattcatgaaattctttatcttttactggaggccaataattaatttcaagttcacacagctcttttggcctctcactgttcaatatggttcagataaatgtgagtgttaccaccagtgaataccaaatgcccaggtttaagattggtcattttagcaatgatatgaaccaatgctgcatatgacgcaatattgaaggggaggccaaggaatacatctacagaacgttgataccactggaggtccaaatatcctttacgaacgttgaactgataaagcagatggcacggtggtaatgccattttgtccaaatcaaccgggttccaagcggtcacaatctggcgacggtcagttggcaattgcttgatacggtcaatgaccaattttagttggtcaacgcccatgaaatcacgccactgctttccatacacgggtcctaactcaccaccagaataccccatgtcttttgcctggttttcataattgtcgtcccagacagttttaccttctagtaatgaaccatgctgaataagacgcaattcatgaacattagtagacccctgcaagaaccaaagaagctctgcaatacatgctttccatgcaagacgcttagtagttacagcaggaaaccctttttgtaaatcaaaacgtaactgagtaccaaacttcgcaatagtgccggtaccagttcggtcatccgtctcataaccgttttcaaaaatgtctttaattaattcttggtattcacgcattaaatttttcctgaagaggagtaaagaaaagctgatcaccacgcttttcaaatcgcccaataatagacactacatcatctttgaccatcacattgccatgtgacattccgatgaacatcttcttataatcacgttcaatttcaataggtatatttccatttcggttatatactgtagttgaaccgttataagtgctaagaccattataactgaaaactagaagatgaataccatgcttaaatggaaatcttttccacctcttttggactttgtcttctgatagctgagtgatatcatagtttgcgctcatagaccacctctgaaatgttagtcacttcatcaatatgataccagtgattttctttagtaatgaatcctgattctggccaagtaggagctgctacaaattcagcaggtagagtgacatcagaattcactctatgactttttctgatggttgtttggataaccctatctgcatatggatatgccttctggatgattccggcaccacctatgatagaataattaaggtctctattaaaagtgatagtactgttgtaagaagtatgagcggccataatgtcaccacccaagaaaccgataaattctaattcacttacataagcatctgcaaagaagccatttttagcagttgccaacgcacgactcatgtcttggacaacgattgtcttacgaccaggaagaggtttaggaaaactcataaaagtctttgctccgcaaatcaagatagtatctcgagtacgattagcaaagtttttcatgtcctgggaaatatgtttccatggaagaccatcgcctaaaccgaaagcattttcgtttttgccgtctacggtttttgtaggagcaaatgcataaactatttgaatcatttaaacctcagcaaaattcaactcgttcaacattaccatcttcccacttctgttgaagctcttggagacgtttgatagcgctatcgatattggacattgcacagatagttacccattcacggccatcccaccaaatcaaatcatcgtaatcatctactgcgaaattttccattaaccttgcctcattccacacttaaaacaccggccacctaattgccataggctaccgccgcagtacttacaatcccagtcagttaaaatccacatgacttgtacccactagctttaatcatgttctgaagagttttaaacccttctttaatggcttctgaaatttcctcaaatacttcctttttaagaatatacaacgaacccgcttgattgccagaaagagctgaaatcacaacttggtcattaattaaaaattcgccatatgctgaatcaattttacctgaaacctgattgcctcgggaatgagggtcaaatacgagctcaatatgagttactccaggaatttcatcaaattggcagcgaatgttaacacgcggatatcccgttacactaaatttagacatataaaaataatcctaatataatgccgctaataaaagcggcagtaacagaaattagcaaaactactaattcagcctcaatcatttcttggccttagcaagtttaaatgcttttttgaattcttcaacatcttcaacaggaatccaaaagcctgagccatacccatcttcatagcatgggcagttatcacagtaatcattccaatagacagtttcaccacccatagtgaatggagcttccatttggcacagtacttcttcaacacgctctaattcttctgggtttttatcgcaaatgcagaaattccatttaccacgatattcagaaccaagtttgatgctttgacgttgaagtttcatttttattctccagtagattatggagctatactatcacaagcatagctccttgtaaactactttttgaaaacttttttgatcaagtcaatcatttcttctgcattttctggggtaacgatcaagtccaagcgagtaggaccaggttggattgcactaccattttcatataccggttcgaagtatttgaattcataatcagagatttcaaagtatgcgtctccaaatccttcagcgtcagcagttgttccatctttaaattttacttctgtgatgaaactattatcttcgtcgagcattttagtaggaaagaacgaaccaccatgctcttcaatcatcaagcgcatccggcgatttccgctagatgaaaggtcccactcggcagcaagacttgggataatgcgatattctgtgttcagtttcataatttacccgctaaaagtcgttaatgtatcttcacggcattcatcatccatgccaggaaaatattcttgttcaagccataaccatagtgtaggagtatcaccttctaccgtgatttcgtttcctccccatggggcagatttgttactaacttcaatcaaaccgtatttttcaatggtttcaatgaagtgttcataatcatatatttctacagtaacctgtgccattatcatttcctcaaagtggggaccgaagtcccccaaaggtaattattcttgccagtcttccatcatccaatcgatatcgtcccattcgttggcttctaaccaagcacgaaccgcttctttagaaccacggaggtcaatatttggccaaccgccaccagggccttctttaataactaaatcaaaatcaataccatggtcagtgtcataaaaacgtgaaccatcttcaaaaatcaaatcagtacaaaatcctgatttattgatgtaaggttctgccacgatatcaatgtttaatttacccatgatgttttcctctactcgttttgtttcgatgtagatatagtatcactcatcaactggcttgtaaacaactttgtgaaaatatttttgtagggataaagaaaaagggacccgaaggtccctttatattagaggtcgttcaaaatatcattcagatcgtcatcgccaacactgtcaccagcatcgcccattatatcgtctgcggaacgagaagaggtcggtttggattcaaaatcagacaggtctttgtcaaaggaatccaggtcatcaccaattttatcggcttgagctgctgcttttgccgcggcaccaccaagagctgctgtacccataatctgtttaaatttggcttcgttaacttcaaacgatttaaactgagatggagcaacaatttcgctgaggtcagccatattttcggtcaggaatttctgagtttcttcatcattgatgtttgcaatctcggactgaccaaggaatttacattcatcatagttctggaaaccaccgactttcttaactttcatgacgaagtttgcaccttcatacacacaagttacatcaaccggagtttcacccatatcaacatcgacttcaaccatcgcgttgattttgtccataattttctgaccgaaacggaatttgaatactttaccttcgttttctgggttagccgggtctttaataaccaggatgttagaccagaaagaagttttacgtttcagaagcttatattcagctgggttgctgttataagaatcgtttttactcagatgagcacaaaccgggcaagaatcaaaatcgccgtgggtagaagtacaattttcaatgtaccatttaccgccgtgtttgaaaccgtgattgatcagttttacaaacggcagagagttttcatctttaccaggcaggaagcgaattactgcttgaccattaccagcattatcggtcttcagtttccattcgtttttatcttcattagagaaagaagaaccacctttcagaccggccagttgctgttgaagttgagcaggattttttcttttgaacatgatttattttaccttgattttatttagacagttatttgtgtgacgcgctattgcatttacagaaatacttttcccgcacactggacagttttttctgggcattgttttacctttcatgccgcaaggatgaggttgtgtttgatgtcgtttcttagcaccatcactccaagtttttagaacttgtttacctcttgtattatttattctatcaccattttcataatagcgatgcaatccatttgaaattaatttcttatgctcttctgtctttggaacatctgttaagagttctgatattcttttacaatgatgttcagaatttttctttccaaatctaggagcattttcaccagaaccaccaaatttaccggaagcagtagataaattataaaatagttctgatttagcaacatcataatgtttatgataaaattcttcttcgtcaagagcgttatcacatacatgtagtattttaacatcgggtttttgaagcgaaattgcgttcaaaaatctttcttgttcacatgacgaccaatactcaatatttctgttgtcaaaaataacaccattgacaaaggtgcaatcatgttttgacccaatataatagtaaggtggagttttattctttaccctatcagtaaaggtaaaccaatatacgatattcattggataattatatactaatttctttacaagatttgattatgctaataaagagtttcttagcttcagcaccgtcaacgtttaaaagttttttataagcttttaatttagtagagtaattactccaaactaagttatccgttgcagtatcatgtgtatttattatatctaaaaacgagtcaagcatgatgaatgtctcgaaagatataacgtttgactgcagaagtttgaacacataagatgttccgactttctcattatattcaaaaatatcatgaagcttatctacattaactttcttggcaaaatagtaaatgttctttacatcttccgagaacgttgttttaatctgcttcaacttacctatatattcacgataaaacacaagggcatcagcatcactgatatcgccaatccaagcatcttggttagctacgaggttactcatgaatatcagtgttaactcttttaatgtatatttctcagcgagtttctcaaagaaatatttgtctctacgcttttgataagctttatcagagacccgcataacccagttatacttaacaacgtcatatcgaccggcaaagtgttgtttgagcattaaatataaaagataaacgctcttaccgttaacgtatctgttattatttccaggcatgcggagacgaatcataataaaaagtccagactattcgttttgtgtgtttgactaaatgatggacgaagcatattttcttccaatgcttctgacataattttttctatgattgctggaggaatatatctattgaagtttccctcaggaatagaattttcttctaaccactgagttgttgcttcaagataccccattccaagttctgttaccatagactcaatagtaaatccgttagcttgcttatctaacagctgattaatggattcagagggggaggtatccccctcgtctttaagcgaaaatagagtcataagcttctaccacttcatctttttcagtttcaaaacgatcgcgtgtgcctttatggaacagagcaagcagttgattaaacagtttgccttctacgccaagttctttcttggcgcggtctttaatgtctttgttaagttcaagatagctttctgctttcaacttattacctgaggcttctttaatcatatctcgcagagcctgtccatgtaccgcttcatcaaatactacttgctctttttctttcttagccattatattcaccttaaaagttgttaatttctttcattaatttagacagaccggatttaacaaagtagctataaattttgccacgacccggtaattgatagttattataacaatctaaaatgttagcaacaatgtcttcgcggatgtaatcaaaatcgattaacacgcggttttccaagaaacgcttatactgttcttcagtaagcaaatctttaatgttttcgccagcatcaagacactcttcaacaaacgtcattttcgttgaaggagtacgctcaccatcaacatgagtgtaccaaaaatctgaacgaactttaatagaagcgacgttatctttcttgtcacctttaataattttaaccatacaatctaaagcaggagaaccggttttagattttaccagtttcttctgcattggtgaccattgcttaacattaggatacttatgcaattgagtaaagtcaccatccgaagaaacaatcatgactggatggccttcgagactgaactttttggttaataccgcaatgctgtcatcagcttcagctttatcaatatcaatgacataataaggcatatactgcttaaattcatcaattacagtacgaagaccttcaaagtatccatcccagtcccaattggattcttcacgggctttagcacggttctttttatagtaatatgctacgtcccgacgccaatacccattaactgcgttatcaacgcagatgacaattttagtgtatccatctttcttccacttaaaagcattaaattttaaagtagaaagaataagatgacgaaccataggagtggttagtttgtcaccttctttatacgtatgaagaattgtcgccattgcaatttgtgacaagtcaattaaaatgacgccctcttttacctggtcttcttcagcgaataagcaatttaaatcagacatttgaacctcgttcaattagttagtacagccattataaatacttctataatgaagcataaccccataggagactctatgagcgatttactgaaacaacatttccgtgcaacaaacggcttggacgcaggcggaaataaagttataaatgtggcactagctgaccgcaacgttaaaaccgacggcgtctccgtcgagtacgttattcaagaaaacactatccaaaaatatgacccgacacgtgggtatctcactgattttgctgtgacttatggacgtcgtatctggattgcaaataaagatattccaaagcctgctggagattttaaccaggcgaattggacttctttacgtgttgacccgaactggatttataccgtccgtaaaggagagtttgaaattcaatctggtcagttcatcaacgttgactctaacgctgcaggtaatgctacattactgcttccgttagcaccagatgaaggtgataccatcgtagttcgtgatattggcgggcgtcctggctataacggaatcttaattaaagcacaagatactggtgcgtctatcgtatttggtgaatcgcgtctgcgtgaggtaagacttacacgtccgtattcacaaattatgcttacgtttagtaatggtgcatggcgtgcaagtttaaccgattttggcgatactgccaagatggtagttccgaacgggattgttccgacgcaagttcaggcaggtgataacgtagttcgtcgttatacttccaactcagagattttcattactctgccgttgttcgctaattcaaacgatatcatcaattttactgaccttgacggtacatcgccaattaaccatatgactgtgcgtacgtttgacccaactatctcaattgggactcctggacaaacagaggttcaagtacgtacttcaggtaatgggtttttggtatatgactcgattgacaaaatctggcgtatttttgaaaatgatttacgcacccgagtaagaataattacttctgatgttactttaatgcctaatgagcatatttctgtatttggcgcagataacaatactgttaaaacaattaacgttactttgcctacagacgtagctgttggtgatactgtcacaatcgcaatgaattatatgcgtaaaggacagactgtagtaattaaagcttctgatggtgataccatcgctagtaatttgaatttactgcaatttccaaaacgctcagagtatccacctgatgcagcatgggtgcaatcaagctcaattacctttaacggaactacatcgtatgttcctgttcttgggcttgcatatattgaagataaagcatccggaaaaagctattggattgtaactgaatctgaccctaccgtagaacgagttgatgctaaagacaatacaactagagctcgattaggtgttattgctcttgctacgcaggctcaagctaatgcggagtcaaacccagaaaaagaattagcaattactccagaaaccttaaatggacgtcgttctactgaaacccaaactggtatagcaagaattgcaacttccagcgaagttaatcagtcaacaactgcttcttacttggataatgtaatcgttactcctaaaaagcttaacgaaaggtctgctactgaaacccgtagaggtttagcagagattgcgactaatgctaaaatggatgcaggaacagacgattttacaattgttactcctaagaagttgctttatcgtactacatcagattcacggttaggtgttattcaattagtaaaaactggtggtgctcctaacacaactgctgatcgttcttctgctggcaccggtatattcgatcattctgattacaaaaatgcagttactccaaaaactcttcgtgagtataaagctactgtaaatcagtcaggaatagtttggttagcaactgatagcgaagttagaaacggaactccggcttcttcaaatattcctacagtcgttacaccagaagctttgcataaaaaagttgctactgacggagcaattggattaatccaaatagctacacaaactgaagttaatgctggcggcgtgactaataaagcagttacacctaaaacattaaatgaccgtacagcaactaacgatcgtactggtattgctcgcttcgcgacacctggtgcccagggtgaatttgaagctggtacttcaagtacagtaatggtaaaccctaaattactgttcgataaatttgctaatactgatcgtatccaagttaatactagttctggcttaactattactgggaacctctgggaccattataccatcaacatacaggaagcaagtacttctcaaagaggtacaaccactcttgctactgctgctgaggttagaaccggcaccgacgccaagaaaatagttactgctgccacgctacatgctaaaacagcaactgaaggagctatcggtcttgctcagtatgctacacaggcacaagttgatgcaggcacattaagtgatagaattgttcctcctgcttacttgaaacagactattcaggtaacagagtcatggcaagctacagacagcgttagagggaccgtgaggctatctacaggcgatggaacgtggaaaggtaatgataccaatggctcaactcttccggataacgggtatgcctctaagggcgtcgcagtgtctccgtatgaattgaaccttacactgaaacattacttgcctcgtctcggtaaagcctatgacacaggaatgttaggtggtcaaaccccagacaaatatgctcgtcgcgatatcgcgcagactatttctggagcttggtcatttagtcaggacacttcatttagcaataatatttctgttcagaatattatatatgctaatggtggtgaagtgaagatttctccaacagctgatactggaaatgtgcatgttcgttttcaaaatagagacggaactgaacgcggtataatttatgctgagccacagactgcttcagctggaactttaaaaattcgtgtcaaaaacggaactggaactactgctacaagtcaaacttatgtatttggcggtaacggtacgttagaagttcctaatgaagtatcaactaaaactctgaggtcttctggaaatgcaatagttggcggaactgttatggttaaggacgttcagatgcttgctgtcgagggattgaattcaatattcggtgcccaatcacagtccgcatttattcgttcccgtgacgctgatacacaaatttttgcacaggattcaactggatcgtatccaattttaactaccaaaaactatgcaagactagctgatggccgttatgtcaagaaagctggtgatacaatgaccggcaatcttaacataagcggttctgctatcgtcattacaggttctgaatcatggtatgtgccaacgaatgaaaccgtaataagacaaggttcttggactgctgaaattaaagacgctactaagttaaaaggccttcgtggttatatggttccaatcagaacaccgattgacccgggtaacccaagcactttggtagtgaccggatatgaagaaaagactgctgctggcggtgttttaactcaggttggtgtaactacaaacaatacttatcagctttggacaccttatcctccgacaaccgaaactgctgataagcgtttcgcgcatactgtgtggatgaggatttataatccaaaccttaataagtttgatgattggatgcgagtgttcacgtctgctactcctccgactgcagctgatattggtgctccgagctcagtatcaactcaggttaaaacccttgaagtcctggaatggattaagcttggcccagttaaaatctggccagaccgtccaaaccaaactctcaaatttgaatgggtaggtgattaatggctgaaccaattttaatggcagcctttggcgaggatttcgtggaaacacgaatcctctctgaggcaaactctgtgaagtattggctaaaagcttatgctacgcattctaatgctgttcctaataagccagaattgaatattaatggtgcctttgatatgacctcctccttacggagggggattaatgttgttcaagttaatggtgacagttttattaactttaaaacatttgacgttaccactgatgataataacgctaataacaaagcgtttgtagaatatgcaaatggattaacgtcaggattgtatattataatgacacatgaacgatttcaatccagtccgttaatagacagatggtttaaaaacaagtggtctgcttcttggccaggttctgatttttccaaatcatttccaaactctgcctatgttggagtgctcggagcagcaaaaggacgcatattaattgagtcattttacggaaatgatggtgtagttaaagaagattccagagctaaagtagatactgtatatgataacgttggcgatgtaggatatacaggttgcccttatcgttccattgaagacactaatgagtactcggattctactggatatgaatataaacgttatccagtacaaaatgaatctataagcaaaatagctgattatggattatctcctggagattctgtatttttagtatgtgatatgtatgcatctaaaagccttcttgatgcgggttctacaactagagctagcttgcggtggttcaagggtacatctttattatcttcaaacgtatcattagaagttccaaaaaatggagctgatagatggttaagatttgaaagatttactgctgttcctacggacgctgatggatttactattgtggtatcacgatatccaaaaacgtctgtagttggtgattctaaaatcaaaaaccttgtatttgttcaaacctctcacagcgaaaaacttaacagtgttgttcaagagtttggtgtgaatggtataagaatgaataaaggcgttgaaggagaaaccacagtgattatggaacttccaaattcaaaagtcgatccgagcggtgttattccagttcaatcgttcagagaaacatcagactaaggaagccttcgggcttccttttttcgtataaatagaaaatatataagaggataaactatggccgatttaaaagcaggttcaacagttggtggaaatcctatttggcacgcgggtacttttcctcttgtgccggcaggaaactccctaacttatagaggtaaaaaggtttatactgagatagataaacctcaagcaaatgataacgattttgtatctaaagctaatggtggcacaggttctcaagggttccaaaaagaagttgaatttaaagctggcgttaagatttccgcaacgttttctggtggttcaaacttaaatggattgtattctggtaacggagatggagataccagagaaaaatctaacatggatttgcgttcatggtacggtatcggtatttggaactcatgtacaagtgatggggtccaggggcgtacaatctggttcagtgctaggcgtggtactatcggaacagttggtgatattgtttcaggttcccaagttattgctaatgcttctactccaacagccgctcagcatttaactcgtaaagattatgtcgatgggcgaataaatactgttagcaacgtagctaacgcagcagtcaagaaagctggtgatactatgaccggtgtacttagggctaacgctggcgtagttatagtaaataaagcaacatccggtgaatatgctcctagattagatcaggttatttcacgcggggtaacaatagattttggcacatactaagaggtagccatggccgatcaaaacttaaaacaaatacaatttaaaagaactagcacagagaataaagcaccaggtgcagatatcgtagcccgtggcgaaatagtgttgaatacacatgggcgtactctcgctatctacaccaaagatgaagccgataacgttgttcagcttgcaggtaaaggtgttcctttcttagatactgcaggtaatcttaatgttgatggaactactacgttaaaagacaacgttactatttctccgaataaagcgatcaattttgaagcttctgatttaagcggagcattagtacgtcatatcaccggtaagtgtgctaataatgatggctggtacattggagctggcggtgcatctgaccagggatttcttgaaatcggtacgtatgataacggaaatgaacctatctattttgttcaaagaaccggtggaacgactcaagctgaagttcgtcgtttagcattattagatgggtttggcgatacctctatacctggggaccttcgtttaactggtaaaacagtaaaaatttcaaacggcagcactcttactttggaaatgggtgtaggttctaatgacgcttatattaaaaaccaaagaggtactggcgttcttcaattaactaatgacagcaatttaacgttcagaaattcccaggtttattacgccatgaacggaagaggtcctggtaaatccggtactcttctgacgaatgtagaaaacaatcgtcaagcctggcaatacacaatttcagctgcaactgccacaaccccgcgctgggttaaagtagctacattgaaacacccaggaatggcttcttcacaactggatttaatgattacaggtggcattgattctggacacggaagacattatgttgattttatcacgttatcaggacgcaatttaacatcctggagcactagcaatttagataactgggttgaatggcgcaggatgggttctcctaataaaggaaacgttccagaatattacgttgttaaaaacgatgctgctacagattcagaggcttcatttgatttttacgctaaagttcctcgatacggcaatgggctttatgtcacagtgctgaacactgctggatacaacggccaggatagtggtaaagtaattatctatgaaaccaatcaggacactggtgatactggaccgtccggaagtattcttgtttcaatgaaacagatttttgatagtttagcaaaaccagatttcggtgataccacaggtactcttccggttaaccgtggtggtacaggtgctactaacgtaggagacgctcgaaataacctgggtcttagaactgcggctgttcgtgatgtcggtgaatccagtggaaacgtgatggaagttggtgccttcggtattggtggtcacggaaaatcacttgtagatattacttctgacgttgatttaatgactcgccttaaggctcttggcggtacaacgtttagagccaacgtagcgagtggttataccggggctccttattattcacatggcgcaggtttcttttctagaactggcgatacaatgtctgcgcttaatatagattacgcaactggtaatgtcagagtatttgctataaacgatagcggtttagcaagtggaagagtgaatgctaatatgctttacggtacagcaaacaaaccaactaaggctgacgtcggacttggtaatctgacaaacgatacccaggttaagaaagctggcgacaccatgaccggtgatttaactgctcctaacttgcatgcttctggatcaggaaccgcatcgctttatattaatgcgggaagcggaaatgctcatatatggtttagaacaaacaccaatgaacgtggtgtaatttgggcaactccaaatactgctgatttaggacaaattaatattcgtgcaaaaactactggtggtacttctgctggtgattttagcttccgttctgatggcagatttgatgttcctgtagcagttaaagttggtggagcagcaatgctaaccaaagacggaaacatcacctctggttcaatgtttggcggtaatcttaataactatttgaataccattaaaaacgacattgttgccggcgataataagcaagtaagtaagactggcgatactatgaccggtaacttgactattaacgctaacctaaaagtcgaaaatcctaatggaacatttgttgatttgggttcagagaactcagacaaatacagcagattgacccttgcacgtaaagttggtgatggcgcttccgtagcaatgcttaaaattactcctgaaggatacgtgcaatttggttatcaagatgcagttgctactccatctcctagcaagtacatccgagttaaatctgatggtcttgatgtagaaggggacttggtttttaatcagacatatcgtggtgctgaaaatgcagttgatatttctgataagactaatgaccttaacaacatggttattaaaggcagtgatttaggtactcgtctattatacaagtgtacttctaccggtggcgcttctaatatattgaacagacctacatctgatggtaactttgttcttgaagttctgtctttgcgtaaaatttctgatactgactggtcatgtaagcagacctttactacaaagaatggtaatgttgaaggcacatatgttcgatactgccaaaacggcacatggtccgcatggaaagaggttgtcgctggtgttcaaccgattaatttaggtggtactggagcaacttctgtagctgccgctcgtaataacctcggtgttggtgaatggcaatctgtggcatttggtgtattgaatgtcaacggcgttagtaatgcagacccggccatcacatttaaaaatggggctatggttcgtgaagcccaaggtggtagtctcggcgcgttaatcctgtcggcttctactgcatctccagacggcgcgaaatatattgcttttcgacccttcggtgattcgtctggtactgagattagagtaaaagccaacgggtcaagtgagtcactacttgaatggtcttatggcccaggtattcgttcaaattcatctggcgcttttgttatctacgcaaaaacaggtcaggcactccatttaagaccaaacggtgataattctaaccaagccacagttattgaccaaaatggtaaaatgactgtcggtggtgaatttgaggcccagaactcaaaaatcactggtaatttgaatgtatctgaagataatagaatgattgttcttggcaaaaactctgatattggtttagtcaagaaaagtggtatgccaggaaaaatggctatcggtaaatctaactcgtttactattatggtatcaacaaataccaacaaccaaattaatcctgctgatacgtttaatgacatattcaaagtagatgctgatggaaaccagactgtttacggaaatgcccaagtcaacagacagttaactgtttctagttcagctactgttaatggtattattaatgccaacggaggtattattgttcctactaccaagtatgtacaaattgccgatgctcctacgcagaataaccaagcaacaaataaacagtatgttgatgataaggttgcttctgctattagtaatgctggcgacacgtatcttccattagcgggtggtactgtaactggtaacttgattgttactggaagccagttaaaaagtacatcactctgggttaccggtgatgctgccgttaatggtgttttaactgttgacggaaaggctagatttaatcaagagttcagtgtatctacttcagttaacgtccagaacgatggtaatagccatgtgttcttccgtaaagcaaatggtacagaaaaaggacttctttgggctgacgaccctggtaacgttagtataagagcaggcggcgccattgggccggtgtggaatttctggagcagcggttcctgccaattcccaggagctatttctaactataacggaattagtaccactactaattatcctgcaggaaaacctaatggtacatataacaataccgcaggactagtaactagatttagtaatggtgcttatgcttcaatatacttccaagagtatgtaggaaactatcaccaggctattcttaatgttaacggatttggtcgagacgacaacttctttttccgatccggtggcgacttcttctgtactcgtaatggctcttttgataacgttgagattcgttctgaccgtagagccaaatcggatatcaaagttattgaaaatgctttggaaaaagtagaaaaactaaccggtaatacttatgagcttcacaacacatccggtggtactactcgttctgcgggtttaatcgcacaggaagttcaagaagttcttccggaagcagttactcaggatattgaagcagacgggggtttattgcgtctgaattacaactcagtaattgcacttctcgttgaatctgttaaagagctttctgctgaggttaaagagcttaaatctcaactgaaataatgtaaggggcttcggccccttttaggagaaataattatggcagtaacaggaccatgggtaggaagttcggcaaaggccgttactggtgaaacctggatggcccaggctggagcaaaattgagattggggacacccttttggatgtccaacatgattggaagaaacgtctggaatgctagaataactatttctggtaacaacccagctacaggacctaaggttcgtggcgcttggaaagataagaacagtgcttcatggaacgtgttactcgacgctcgtggggctttatcaggaatttgggaaactgggtttaatttggttgcctttggattatcagagccaagcaaaacgtttggttataatgacgcaattgttctagaaggcagtggaaactttaacgttaactggcgagttgatactgaagacggtaatcaattccattttaatagctcccgagattaccgaggaagacgctgttatagctgtacagacaacaatgctttttggaactggctttatgctaatgatggacgaacattccagctgtcgtttactgcatattaagcataagttagagcaataaatagctctgtaaggagagcaatatgtcaagcaaacaatcaataccattttttgatatgtttcttgggttgctcgagctattattcaaagatggagccacgggaagagttctcttttcccgtgtttttgttgtcatacttttagcattgttggcgtttgctggttataagtcagatagtcttattactgcttacgtcgatagtacatatgacaagtatgataaactggttcaaaaggatagggatacccgatttgataatacagcactcgaacaactccagatagtacatatctcaagtggtgcagatttttctgcggtctttacgttcagacctaaaaacttgaactacttcgtagacttaattgcttatgaggggactttacctagcacggtagattctaaaaacctaggaggatatccaatcgacaaaacgtctgctgaatacagtacgcatttatcgggtagatatttttggacggataaggaattcgttttcttaccgacaaaaagaaaaccacctgaaatatcgtacatgtttagctgtccgtatttcaatttagacaatgtttatgctggaactgttgaaatgtactggtacaattccaaacctgcattatctaacgaaagactaacatcgatatgtggtcaggcggttagagctcttggaagagctaagtgattacttattactatgcatagccatcgttcgatagatagactcaaatccctcgttgtattcttcaacgagaattctcttctcttcgtcagttaactcagaaaccattttacgaaagttgctctgatttaactgacgcccctgctcgttcttgattccaatttcattcaagaacgcaataaattcatctcgcttctccatgatatgttcagcattgaacttagtcagaatagaagcaacagtaacgatttcttggacaatttcaaacttagtcattatttttcctacaacataatggattatgtgattatagtatcatcttgataccgcgttgtaaaccagtttatgccaattcccaacgagaattcaaatcttccttggtagtgatatactcagcaccagaggacatccagagcccgtagcgaccatcttttactttagccgttaaataccattcctttccaattggacgaaccctacgattcatccagtgacatacgtcaattgcctcctgaaaagacaagtcaatcagacttccaagcgcgattttattcattaacgcttcgagatatctttgtgattcaacgacagattctaagttatgactcatgctaaaactacctctccacgattgtctaaaacacgttcaatgtattcaactgcatttataatgtcacctctatcctttgccttaatagtaataattccatacgtataaaagtcggctgacaaactgaatggcttagaagtgtcctggttaaacgtagacattactgcttgctctaagtgttttacttctaagtcattagcccaagagctaagaactttaagcctaacttgtaaagtgtattctactttaattgctgaaagcaattcaacacgtttatgatacgccttggcttcatcttctctgcgtaaagtttcagtattcatagataatctccaatatcataagcatcaacacatttctgaaattgttcaagaacttcttcaggttcaacgttagctataatagctacagtaaaggtaccattattccaatcatgtaccatccaatctccatatccaacattctgaaggtcttccattagttcagaatggatatctgctactaatccagaatggtcccctaatttcttgtggagagcttctaggtcatcacaaataatagttaaagtagtacatttggaattattcagaatgcgcattgtctttacctttgtgtttttgcttacgttttgattctttggcagcgcgctttttatctttatgcgcgcctcctttgttaaagtcattcttcgctactgggttgtacatgtgcaattacctcatttaagcagttgcgtgtaatatcaaaacgcttagcaataccacattcttggatatgtgcttttaaatctccggcatgcacataccccaattccaagataaaccgtttaatttgagccttttctgaacgatttaagctattgaagtaatctgccttggcgcttattgctctcacgctctatcttccttacattcaagttccttgatataatagtcaatatctttaatcatttcttctgtcattattttgtacatttcagcaagaaatggtttagcaccgccattaaatggatggctaaacgggcagatgtattccttatccatgagagttttcatgaatttgctatctgccattttaaacccggcttcattggtatatgtaccccaattatcgtccatcatttctaatgagcgctgaagcgatttacgttgaatttttaaaagcgtaatgttattctttaatgtactaatcattagtataaatcctctgagaataattcattggcgggtcccgatttaggacgaactgtattaacttggcctgcatgtgtagcgatgattaatgcttcttcacgcgtgaagtactcaccccattggtcaacaaatccttgattgtctccatggacatgatcagaaaccaatttatcgcgaaacatatctaaaacgttcgccatatcagcagaataatggcgagtgcctggaactacaattgttccaccagatttcaattcaaaacgatttgctgcacaaacgatacggcgttgaagtaatcgtccatcccaccaatcagctactttaaagcaaatttcaggaatactaacttcttctggttcattaattagagaaccgtgacgagaagcatcaacaaatttattcatttgttcggaaaacttgctcatttaaagaatcctttaattttctgccacaaacttttcttttcacgaataccgatttgccgaataacaggttcaccctgcattttctctaaccattccattgagttaacagcttccgccattggaacaaatttagcaagggccttttggtaattatctacatccatgatatgtttaccatctgcattgtagatagcatagcattttgtgaatttcttatcaatgtatccgataaagtgcccacggaaccatacatcccaacaatcagttgggatattagcattcaagttaactttttctacacaacgctgaagttcattcaatactttaaacttgttcattacagttccttaatagagcggatgatggtttcaatgttttcagcagtacgagcgatatctaagtaagtattgcctgttgcagctacacggcaagacattccgaggtcagtgaagtgtttctgatgctcttcagaaatcttgtaaccgaagatacggaaagtacctttgttgttaacttcaagactacgaataccgaatgtacgtttttccagaactgcgatatagttactacggtaaacagtaagttctttcagaggtaagatatcttccatctcaccgagaagtttcatcatcaggtctttgtgctcattcatgtcttcagtaagaggacgagctttacgagtattgcgtttcttcagaagttcaggcttgttctcttctgcatagataactgctgctttagagatgatgtcctgcgcttcaccagtgatgattaaaccgtcaccagatttctcgatgagacctttcttaatcagaacaccgatgtttgagtttacagaacttgcgttcatggtttcttcaaggatttcacgcagttcagaagaagtgatgaaatcctttttagctacctgaaccaggatagcagcagttttctcgttcagagcatcttcggaagctttgatgatgtaagttactttagacattgtgattctccatgatgttttattcaatttgtttggtatgatactataataacatctgctaaccagcttgtaaaccattttattctgctctctgaaaaattttcttcaaagagcagtaaaaatgctatacgttaaagatcaagaacttatcgccattctcaagtttaagcacccagaaatcatcatatacacaaagaacgacttggtactcttcaccgtcttcatagttacttgcttgaattacctgacgcataggatactcgcgattaacttcgaactcatcgagcaccacaatgttacctttgacatagtggctcagtcgagtgccatcagcttgagtagaaatataaagaatgtttttgatatcagattttaatgatgtaatcattttgtttactccgtgttgttttgatatggctataatacaacaaccgtgtaagcatgtaaacaactttatgaaaataatttagggcattctaaggagggattttggatggatatagatttatatggaaggacctggagatgacctccaggttccctagattaattgaggagcaataaaactagacctaatacggcaattacagaacctataactaaataaaattctatcatagttcttccaggtctttcagatactcagcttcaggagttgtcttttcccagtacttaacctcttgtgctaggcgttttgcttcctgagcaagtttcttggcttcatcatcagtgatgtgatagatgttcattgaaacgagtttttcagaatggtctttgaatagttcattctgttcaatttctttagtcaactgcttacgagttttaccttggataacgatgttacctgcaataacctctttaataaattgagcttttgcctgagcaagattaaacgcctgtttagtttcagctattttatgctcgattcgtttagcggtgaatgtcttacggacttctacaaaatgacgaatcagctcaccggaagttttgaacttgtcgttcagcttaccattctcatcgatgaccacaatgtattgactcattttctcaatgagtttaaaatccttcatgattttagcatgacgctgctcagggtcatcgctcaaagcatagtctttacggaatttcaccttaaagccaaacccggtcttagaacagtcatcatcatatgtgatgtatcctgcatcttccaacgggtcaagtactttttcaacgtaagaagctcgttcaaacttgtatggaatttcactgatatagattgagttccgtgaagtttctttatacacgccgtgcagctcaacagaaccgtcttcagtttgaacgatttttccgttaaatttagggaactgaacttcaggttccatcatttcgccacgaagtgctgctttagtgcattctaaaacagattcaaaactatgcggaagaatagaagttgaataacctgttgcaataccgcgaacaccattcagaagaacagttggaattaccggaagataataagcaggtggaacatgctctttatctttatgcaccggagcgatttctgtgtctttgtagattttacggaagttgtcagaaatccggcagaaaatataacgacttgccgcagcagattgaaccaaacgagaaccgaagttaccttgtccatctaatagaggatagttgttattccatgtgtttgccatcagtgcaccagcatcttgggcagacgtttcaccatgatgatatcctaaatcagctacaccaccggcgacagacgcaagtttgtggaatttttctttattaccacgagccaaatcaagggcacgagcaataacaaaacgctgtacaggtttaaacccatcaatcaagttcggaatagcgcggttttctacagtgtaaatcgcatactcttttgcttcattatcaatgatagatttcaaatcgcgatgacgaagatttgacgccttagccaaatcatcaatagaacctgcttgttttaatagagtgtcaaaaatatccattgtacctaccaaattagtgagccgatttgtactataacatcggaaatgaaaagcacaatataaatcattccgtaaatcattccatagtacaaaaccaaaagaatgatggaaataactgcggcagaaactaggagtttcttaatcatttgtaaactcctacaattttacaaatgcgctcaaacataataaatgctgcagtgaacgcaatgcttccaattactttagtggtaggcacaaggccataccacatgaatgttcctgagcaaatcattaaggccatcagaaacacatagcccatcacgaagaaggttctcattagtatttctgcaaagtaaagatgaagttatcattcagaatacgattcagctcagagtaggtctgcgcatcacttgaatgctgacgagtaaacgccaatgcaagctgacctttgccataaccagtggtgagtggtttcattttattagcaggaatccagaacacaccgtaagtcatgcaattcgagcgcagagtacgacccaactgagaacgtccagaacggatatgagaaagaacactttcaaatcctgcctttgaacgctgtttagctacaaagaaacgagcagatgcaccaatataccctgctttgccatcattgaacatcaaaaaataaaatccttcacgctcagtaatttcacgagatggagcacctgttgcccaatcaccgttacgaatagaaccgatcagttctgcgccagcgttatcgagatcagcaaaagtcataatattacgcatgttaatttcctcagttgattaaagtttattctccgataaggggccgaagccccttctactaccaaaaatatactactgccgttacaccaccaacccaaaacacaagaagacctaaagcaagcagacgatacacgatgtgtcgtttcatttttgaccttcccatacggtttctactaaggatttaaggccatcagtttgaataatatcaatcgcattaatggcaaaataaattccgaatccgaacacggtgacaatccccagtgctaccgcaacaataacagacagaacagctgttctcattaagttaaagcgacgatcaaaactattacgaaccattatattttcctcagataaatgcattaatccaaacgttaaccaaatcccatgcgaaaacaccaatgaaagtaacgataaggcagaatactacaaagatgttcttcagaatcgtaagtaactttttcattttgttctccagtttagctaacaagactatagtatcactggagaacaagaaagtaaactattaaatgcacaaattacgaattttttcttccagagctttgactttctctatgtgctcatcacgagcagcggcagctccattaggatacaacccgccatacgttgaatcaccgttatcacaagcaatgatagtataatgccaattcatagattcaagaatcttatactctttcaaaagctcagctttaatagaagcatttccgcgtttggctcgaagtgattttagctctaagtaactcatgttttactcccgttcagtttgtaaggccatagtatcatggccaatcccggaagtaaacaactttttaaaatttatgcatgatgtacccgccagcaccaactcgcgaaggttttacgacttccatgagctgttcgataccgccactgaacatcggtgtgtaccgtatgacattctgggacacttcttctgcaacgaatataattatacagtctgcgactttatgtttaaacatgggccctagatttattccacttccatctgggaatggaccgtctttaccagttgtaacattaatccatggcttatgatttgctcggtcatgaacaaagtgtgttttaacttcaactctaacaccttggtagtagggatgagctagtacgtcccaggcccattcatacggatcgttgttattatggtcaacaacttgatcgtttacgtatccatcaagaaaatccgctaccacatactctgccggtatagcaattctacatcttttaagaacatcaattctgtcttgagatggatcgatatctaaactatatcttgcagtatcaatgatttttacttttgcttcaccccttagcttattcaaatctagggtaaatgtccggagttggttcaatctctgcagggctttgttcatcaatgccataaattcctctgatatgtaattcaccaaaataaacacgatcgtcgtggttacaagtgtctggttccacaacaaaatcatcaccaagttctacaagttcatcacagtgcaaccaagcatagtgaacatcaccttcatgtttaactacatgatgacaaaacaccgtagcagcatgatgagtaccacgaagattaacaactttagaatgagatacgttaaatggattaatcatgtttcacccataataaaagaggagcccgaaggctccttataattagcgaagttctgaaccccaacgatcagttacatcttctaatactacataaccacatgtacgcattttagcgtcgttgtaatcaaccgggatagatactacatcacgcggatgaactttaactgaaacaatacggtcagaaccactaccgaagtgaccgatgtaagatttagagcagacatgcagacctgctgaacaagtacgctgatcgtcttcatctacctggttacgcggcattgtaacagttttaccgggagagttatcaaacgtgtttgaagcacagtccatataagtggaacgaactactttccaaccaatgaagtgaccatcatcagtgatgtcgatatcgtttgcattcaggaaatcaaacagacgataaactgcacgacgagatgggttcagcatcaggttttccaggaaaggcagataacgtttaaagtcttcgccatcttccatggctcgaacgatacgctcagtcagaccagatttcagctcgatatctttatagaataaagtaccatcttcaattcggacgttaccctgaacgaatttcttgatgccttgttccaggttaatgtggtcaatagcaccagcgatatcaccatctacaagtttctgcagtgcagatttaaacccaggatgttggctatcagcgttataagtagtacggccttcagtaattgaaatgaatttggaacttgctgcccatttaaattcacgctcaactggagcttctactttagcaggaacagctgccgcggcagctcgagcttcgcgttctttaaacacacgccgaatggtgtcacgggaaacaccataattctcggcgagctctttcttagtgtacagaccgtttttgaagtttttaacgattgcatctttttggatttcagacagacaggtaacagccatttattcacctttattttcagaattttgagtagaagctccatcaaggagctccatgatttttacgatatcatcgacgagtttgctgtcagtccgccaagtatccaagacacttgcgatgacaggataatcatctttaaactgttcaatctttttatagaagattgtctcagcatcaccagacagtttattataaattttattacataaagctaaatcatcgttttcatctttgattttactggtacggcaaaccttagcgattttgtttagttttgtcaggaacggatttttcattccagacgcagtaaacttactcgacaagaaattcaatttatcgtaatgcgcaatatttccacagatacggtttccagtagcatttgatggcatgtactggtcataatctaccttatcaatacacttgatgtattggtcgataataaatcggtcaaatgaaagcaatccatcagcttttgccgcggctttcatagcacccggacgaattgcatagaatttcttaattccacacgcttctgccagagaccgcatatctgtgatgctcatattccaccaccaaacattatctgggaaagtgtggatttcatcacgattgcgaccgattgcataaccttcaagctcagcaatttcagatgatactaaagtctgacggtcttcttcccagtacccgtctttatcaatccaatgcagagaaacattaggagattttggacgtttctcttttggaccagtatcataatcaggaagagcttttctctgggcttcaagttcagacacacggaatactacaacttcatcagtatccatgattttcttcagctcatcaatgacatgtaattcatcttcattgtctttgattacagtaatgtgtgcccagattggaactaacccagatttacacagagctcgaaccgtagcaatacgcttacccgctttatcgtcaataagaacgaacgctttagttctatcaaccccgcaaatatcagaaatgtttacttggttatgacgatgccaagaactgcttgacactttacgacgagcaggttcatcgcatgaaacataaactgatacttcgttgtctacataatatgaacgaattttatcgagattatacttcgcaactacttgtttaatatcgcggttcccaatggtaataccacggctctgaagaatagaacgttccttagaactcagcttattgaactcacgcaagaattcacggtcagattcatacgcttcaaacgctttaatatctgcggtaattacctcttcttcaagagcattcacacgcttctggatattagcaattgtttcttcgtcaagagaaagctcttcacgagatggagtaatgtctaattcgccaagagggaaatgaacataaaccttgccataacgattaagcagccaatctgccttaacatctacaccgctgatcggatatacgatttttccataaactgcatacagaccataactttcgtaagagctattaacgctgaaccagtcggtcttatctaccgggaaatattcaatttcacggcgaagagaatctacctttggaggtacagcaccaaaggtacgcaaaatatatgcgatttcataatgccaagtatcaatatcttctactttaaccggaacagtgatttcaagaccagtttcttcgtcttctttcatgtcatcaacgaacattggacgaatagtaggttcgccgcggtttttcatgacagtataacctgtagctttaccatcatgataagacactacgttaaatgtactcgtatagcttaatggtgatttagaaccaagaccaagagcaccgatgaaatcattactattattctttgtggattcaaagaacgttttgtacatcgtcatcatgtcattatgattaagacctggaccataatcacgaattacaaatcgtgggtcaagacgagtaggagccttgatataaaatggacgattttcattaccgttcagtttatgagcatcatcacagttagtagaaagttcacgaacaacagcacgaactttatacttatagagtttgtttgacaagatgtcaaaagctttacccgaggccttaatagtaaacgttgaatcatcagcgtcagaagaaccaatgattacttcatcatcacatttaattttcattttattcctatcaattatgtcgtttaatgatttctgctacttcaagtaactcttctgcagtagcggtattagttgtaaaaattttattatggatttctttgaagcgttctttgaattcctcagctgcttggatgtcaaagaaccgctggatgatacgatattcacgatatatagcatcgttgaataattcttctgatgggatgtaactacgtttcataatattttcctcagtgatttagggaaattatatcactataactttaagcaagaatcctagaatcatctccaagcacttcttgattaaagccatataaatccattcttataaagaaaaagggacccggaggtcccttagattaccacaccctactaactcgaccataaacctcatgtttagaaccatcaatgttttccacccagatagtaacccaggttccgggcagaggtttcttttcagcgaacagatatccatagtcgcctgagatcaaagtaatccaataacgttgcatgttaattccttctaagtaagggcaatagtacccttactatttattctttattcactcatccatgtcttacgtggtgcagcatcattacccataattaattcaaacagttctttccagttttcaggaagagtgactacatcataaaccgggtcttgaataacacgttcgtattcatcttcttcaagagagccaagacctttaatataacgaagtttccaacctttgaaatcatctttatggtcttcatattcaccaagagaatagaaccaacgttgttctttacctttggtgagaataataaccggagttttcacaaagcggattcgaccttgttcaaataattctggccaattactaaagaacgccaaaagacttgggaaaattgaaccaacaccatcaacgtctgcatcagtcatgatggcaatatttcgatagttagtattttcagcgggttcaccgatagtcaaaccagtgattgcacaaatgtcaaatacttccttgttcttcatagcatctgcagcagacattccccatgtattcatgaacttaccacgcaaaggatatccgccatgaagttcacggtcacgagttgtaagtagataaccgatcgcagaatcaccttcggttaagaataaagttgtgtcagcatctttaccatatttgttggctttgatgtgcttagctactttagctttctgcgctttcttggcagctttagtttctgcggctttctctgcagcaagtttacgagctaacatcgcctcaataatcggcatatgaatatcttcggatttcataatagcgttagcaagtttcttataatcaatatcaatatggctacgaatttctccccaaggagaagtcagacgctctttagtctgagaatcaaatcgcatgttagacatatcacgaataaacatgatgacagtcagacattctttaattcgcgctttattaacttctagtttgtacttacgctttaatgctggaataagttcattgctcagttcatcaagaactaggtcaacgtgagtaccaccgtttttggtgtgaatgttattaacatatgaaagttgacggaacccgtcatccgaacgaccgatggcaatagcacaagtatcagaatcctgcactacagcattttcgtcatacatgtgggcgtaagctttaaacttgccttgaacccgtttacccatgaatttaaattcaatatcaggataaactactgctaacgtcatcagacgatcgtgaatgattgattggtcaacatcagtcaatcctgtgctttcaaagtgactgaaatctggaatgaatgatactgcagtaccagtcttatctttgatgaattctttatcttttgctgggtgttcttcccaggagatattttctgagccgttagaacaacgaacgatgatttcatttttaccatcgcatgttgcaccagtaaaagatactgaaaagatgttggttaacgcagaaccgacaccgttcataccaccagttttacgctcagaatcatcaccaaagttaccacccgcacgaggacgagtccatgcggctactggtcctggaatagtttctccttcaggtgttactacaggagcctgcggaagaccacgaccgttatctgttacaataattttgttgcctttaatgtcaactgaaatcttattcgcgtgtttgaaattagtacgaatagcttcatcaacagagttatcaatgatttcatcaataagtttgataataccaggaacatactttactgattggaatttaccaaaaagaaaacggtcatgcgcttcaaacgcagaactaccaatgtacattccgctacgcttaatgatatgttctcggtcactcagaattttaatttcgttcttaatcattacatttcctcggttagtgaaggaattatatcaactattaattatagcaagtaattcttctttgatatacatcaatttaccaagaacctcatggcctcctttaaccgctttatactcgggatatcggggccgctgtcgttcaaacatagtccattgagcatcactaacgttagcgtatgcatatcgagttccgtagtactgttcaatccggtactcgttgttttcattaagtgaaatccactcttcacagacttcataatatttctgcatccaaatagtacgaccattcacgtcattaattggccaccaagcaaacctgtattttccaatagcccgctctactatttttaaatgtcgtttagcacgtctttgcgcagttgtcattccaataatcataatattctcctctggccaacaagactataataccaaaacatggtgtccatgtaaacaactaaatgacccgaaggtcatttattcataacgaattgtgctatttttgagaaaaagccctgagcacactgttccgttaacaggttttcctgttggcccaatagccgtaaagcctgtgtgctgaaaatcatcctctgagcaagaaaagaacttatatccggtgattttgatatcagtaaatcccgcgttatctaacacgcgagttgcgttatcagcgtcagtgcatccaatcatcatgaaggcaagcgctgtaattaaaatctttttcattttaatttaaccctataagttatattacctactttaataacccggatttctccgggtttcatggtaatgcgtgctttagttcccatcaataatcaccactctttaatccatcgtagtgaactgccggagcagaaaccacccgcttcatttgaccttcacacttagggttaaagcagttaacagtatagtcacgatgggaaattttacgcataatttctatcttttttccacagacttcacacttgtaatcatacgttggcattaacagcatccttccatttttgtgttttgactatgatttgctcattcagcgcacgagtaaccatcatggagatttcatcatctgatacatgagtatcatttttatgacgatttctgaaatgcagccaaagtgcatccactacacagttaataacatctgcgcactcgccttcaaattcttctttctgccgccatggacgattaatccaatcacacatttctccagtttctgaagaaagttgcagcatgacattcccaatgctacgattaggaataggataagacatttttgatgcttcaaaaataggagctaaatttaacattgatatgcactctgcagtgctgcaatagcagcgattgcttgaccacgattatgaatagaaagattcataaccaaatcggttggaattacattcgtggaagttccaacttcagtaaagtatttgaattcgctatcaaaaattacaaggtcttcaccgccgacttcatcgcattctgtgccattagcccacgtaattcctgatactctattattttggcggtcaactttagtaacagtaaaactcccgccattttcatagagttcatacacaaagtcttcattaacctcatagcgtgaagaaaattcttcttcagcttcatcattgacgaatttgtactgtacgccttctttaaaattcattacacaatctccatgtattctgggccatcaactgtgattacacgagcaaaggtacgaactgggacgatatcaccatggttcgcgaatacatacaaccaagtccagtgctcttctttaccgaaggttttctctttctgaacaacgattaagtccgggttgaacagaacatcttcaaaagcttcagcagtaatttttacggtattttcagttttcatgttattctcctcagtagttgataagataatagtaccacatccttgtggcaaagtaaacaactttttatactaaaccttgacgttgcgattctgtcggctctacatcggctttaggcagaactgcatagttgccttgaaacactacgtttactagggttttaccgtcttcttcccactcatcagtgacaagaacatttttatgcagcgacagattagtggctgaattagtagaactcaccgattgggtaataacattgtccagtgaattcacgtgtacccacttgcgcagatagctttcgttaaacatagaatcaagcaaatcacgcgattcgagagcaactacgaatttttgcagcgaatacactgctttgtcttcattttccagttgaagcaaatatgaagacattttgttagaacggttaaagattccaacaattacgccttctttaccgatatgcttaccaccaatcactttaacgttttcgcctacaatcaaatttttcatcgtgtttctctcagtttgttaatgtagagccattatataacggctctttcataaagtaaatagctatcggtgagaaatttcacatccaacatcgacgccgaacagatacccagcttcccaccctttagccatcatagccttggccaccagaaccatcgttggagagatttccgggaggatttcccggttgaaccactcttcgaagttttcatcgaactcaaactcttccattagccacgccccttaggtaaactcagtggatcggtatcttctggacttggtgcttcgcttaggcctagagcatagcgttgagcatatttaagcattagaatatctttggcacagtcatggatactatcatgcgcgataaatccgtcgagcgtaccctttggaagaggagtagttgtcaatccgcgtgtcagaagcagtgattcaatcgcggtacgaatatcacgctgattccagaacttacacggctcttctttaaatgtatcaatttcttcttcagaaatcccttgagctctctgcacatcgcgaagacaatctacaaaaatcggaaagtcaaaactctgtccacgacaccaaccaaaggaatcccatggatgaattccattatcaatcagatactgctgggcttctttaattccagcaattactgataaatcatctggcgttgaggcaaggttagcacgggcttcagctgactgcttcttccaccattcaagagtagacttaccaaacaatcggtgacctttctgagatttcaagtcaaacttaatacgatgaccacgcttgaccaattcatcgaagctttccagaacttcagggtcagaatcaaaggtgattagagcaaggtcaatcacagaagagcttgacacatttccgaatgtttcaaaatcaataataaagtctttagccattttgagcctctagcataaatttaatttcgcgtaactggcaaccaatatattcgctcagatacacctttgggtcatatcctgtgaaccaagtaatagcattagcattatctgctatatcacgaagctcattcagaactgtatcaattttaatgttaatagcacgcttaacattatccggtgcttcaaacttagattcttgtaagccaacaatcattgtttgaaggtcttctaatttcaattcaaacatattacc

SEQ ID NO: 13 - DNA, 151240 bp, synthetic construct; identical to SEQ ID NO: 8
  misc_feature 1..151240: note = Efs3_colM
  source 1..151240: mol_type = other DNA

SEQ ID NO: 14 - DNA, 56976 bp, synthetic construct
  misc_feature 1..56976: note = Efs7_colM
  source 1..56976: mol_type = other DNA
ctaaagaccacactcacaggcacacgacaggcattatagaggtgtgcgaatggtgtccgaaagctatccgaacagccctaacatggcgctagtttacataatacacattattcaaagtagaaagaccctgactcaatgcaatgttaacagcaaagagacagagtcgaagtgaagtcgcttgtgtgagcgtgtcggacggcgtgacgtgagagcgtcgtgaagcactcgcaacgcctctcgaagcgtgagggaaggcgcaggggcgcaggcgtggccacggctggcgggggtctttaggaagggcagggggtagcttttccgagggcgggcggggcgcgcgactgtccatctcacacagtttttgggaaaagcgacattataggccttccgatttattttttgctaaaaatcctctataaggcgtcccgacacacttcccgacaagctttccgaggccattccgacaatctatccgataagcattccatcaatagacgtccgaaagctttaaagctacctttcctgatacctcttccttagtatcctttaagaatagattccacaaatagagagggcgccgcttgtcggcagccctagaggcttcgcctctttctagtggagtattcacacaagcgtttattaagttgtaggaagcttattcaagccgttgcaaggccgttggaagaggcaatcttccgaagcatttccttaatgcgttctaacatactgttcaacacccctttcttatcgtttcttatagtataccataaaaaagaggccgtgtcaaggcctcctgaaggtttattttagccatagatggattctctaaccatctcgaaaaggtaaattaggacagtcactgccacagacactgctgcaacacctttccaaaagtttagggcagcatatgttggagccttcttatggactatcttaagtcttgttaccctgtgttgctcaaagcccctatagtatcttaggttaagctcctcagaaactatttccttagcttggtcaaaggcatcctcttcgtcttctgcaatgccttcccactcataaggcactccacaatacttcatcttaacaacgtaataaccatcttctaaaaatccattcatatcctttacctccgcttttaatataccttattatagcataaaaaagacgccttgtcaaggcgcctctaacattatttctctaagtcttgcttagctttattgtactcttaatgaagcatatcccagattagtttaaggagaattaagtttgttaaaatccgtccaatagcaattgtaacttctcctccaaatactgctgtaatggctacaataagcccaaatgcaatcaccaatgctaataaataagagaatgatactagtctaaaagctttccaattcatattaaagttcctccaatgtcttatgtttatccttgttatagcgactataggcgtacttagtagtttcccaaagtaggtctatcacgaatagaatcccaagatagaagaaaagctgttcccaaccagttattaatgatactagccaaagtataccgaagattattccaatagttatcagataagctatgataacggctgccaatataacgcgtttagtaagtttatcagacaatataatttccaactcctttaacaagctttctgcaaagcttaactttgactaatttactatagcgtgttgaatatatctccacaggtgtctctgaataagtttcaataatcacgtctttaggctttttacgtgtaaccatttcaataagaccttctgaaagtgttaaaatacctccataattaggtataaagtaggcgtagactctatttaatagttgttgaggtgactcgcatacttggcatctagtggaagaccatttttcttcaaaccaatactcatactcaggctcttctttaatgcgtggggaatactcttccttaatctcttgcaagtaattctcaagcatttcctgaatctctttagtatcaactttaatagtagctgttggttgaggctttctaggaattgcttcttgaagctttctatactctcttttaaggctgttgtaatcctcttgaaggcgtcccatttcctgttcccaacgcttgttttgctcctcttctactgaaagcttttgacaaacctcttcaaatttcttaccaagtctatcataagcctcttgtctaagcaatctctcttcagcggactcgttagccatttcaatagcctctacttccttatcagaagcatatttaagacgctctttgtagccagcttctttaagctttaaggcgtctacctctctttgaagctcttcgttagccatctctaacctatctaaggccagttggtagacagcttttctgccagtcaataattcaatctcttgtttaagctctttaataagcttgttttcgtccttcttaaataacatcttatcaatcctttcctaatactccactagtatagcataaaagaggcctgttgtcaagcctctcctaacactttttaaccatctaaccaaaaatcttccatacggcagaatccataaccgttctcatgagcgtaaatgccctcatgatagaggtcacaaagctcttggataacccctttaggtaccccatacttagtggaagctttctccattcgtgtaacctcttctaaaacctctccagtagcatcgtcaaagactaggatgcgcttattgttgtcgtagtagtgtttaaggttatcctcatgtgttaaccattccaagttatctaggttgttattaagcttattgccatccatatggtttacagtaagctcttcccaaccttctattggattgtaagtggaaagcaatacccgatggagtcttttcttattcccatcgcctagtccaatttccgcatatcccttatcatttataaaaggctttagaatcttaccagttaggttattaacgaccttaccagtctttgttatggagtagttaggaaacccattaacaaccttccactcaccctccaaatactttttgatgggctttttagaagctagtggagaacctttctcaaactctcttccagtataactccacacatgccctgcatacaccttatttttagcacaggcgttgcggacacttgttgaatccttccctaaatccttagcagctgcatgagcgcttctgtaaactgtctctaaacctgtctcaacgtctactgatttaacctcttttataagcttcactaaaaaccctcctaagtcctcttctataggcatattgtagcacctttcaggtgccttgtcaatatcctttatgttacatttgtgttacaaacattaaatttactttacagttataaaatattccatcaaatagtgagactaatttaaagcatgtgggaaatactgtcgtattagttaagagttagttagcgaagctactaacgagcggtctccagcgagttagtaattacttgacctttcctaaaagcttcctgaaacgttctcctaagccttcctaaagctttgagacgtctaggttacaggtcggggatggagtcagttgttaattactttaaggacgagtttgtagaaagcttattaaatcgtatggcctcacctaatgcaaagtgccagcagcgacctttagtaagcttcctagagactcgttttaatgtgtaataagaaaagccttcaggatagcttcccgaaggccttatttatgctttatttataggcttccataattccagcaacgaagtgccattcgtcccagccttcagtacgcttttgaatagcttctaaaaggcggaagaactcactttttggaatcatgtctgaaggattagccaaaggaatttcatcttctatgataatgtcttccacaaagtctctgatagaggagattccgtcaaggaaaccttcatcccaaccttttccgaatgctgaattatcagcgttatcggttgtatttaattcctcttcggtcttttcaatgtgatttaacactacttctgcatcgataagcttcataaaatcactccattaccttttggaatagcttggatagcgcctttcaacaaggcttgaatcgaagaggtatcaaagaagtcctcagaagcctctaggagagcttctaaaacgtctttggtataattgtgaggcaaggtgttaataggcgttacagagcttcctgtaaaggattctgctacaatgtttccatcaatagctaatttaataggctctggtgcagcctcttccttagctaccgataaagctgctttaatttcgtccatacaagtttctacagcgtcctgataaccctcatcgtaatcatcttctgggtattccaatttgtttttcatagtggttaataaagcttctccatcgattagtttcattaagcttcctccttaacagtttcaataaaggccttcaaacgaggtgggtggaatccactaatagctgtgtcgaagtcttcgtccaacatcaccactggaaagcttcggaaacccgctaatctaagcatctccacagtctctgtatcattgcggacgtccacaaacacttcatcaaagcttactccgccttctgtaagcactcgtttagccatcttgcaggcttggcacatgtctttagtatatactttaatacggttcattcccattcctccatgctttcaataatctcttcaagctcttctacacgttctgaaagcgtgtcaacttcttctgtaagctctgccacagtttcttcaaggctatatacttcgtcttgcaagtcagagttctccgattcaaggtcttctacgtcttgttcaaggctataaatctcctcgttcaagtcttcgttttcccatacaacactagtaaggcgctcttctgcatactctaattcctgttcagcaatcagcttatcccaattggaatccaccaaggcattttgaagctttcctacaagctcaattaaagctgtttcatgttgcgttaatgtaggctttgcacaagcctcttttaattctttctcaaaaggtaggttactcatactaaaactatccaatctcgttttgtttaaactcttcaacaggaattgctaatggtgcatagtgaggtgaagtcttcttaatttcatctagcgtcattgaacctttttcaattacttcatatggcgattgagtaactgctatactagctgtaagagtagtcaagtaagtatatccacaaggcgtaccacttccacgcccactaggaaggactagtacatactttttctctgcttcgttagccatgatttgtaaagagtccgcaaggtctcgtgccgctctaggggtaagggtcattgaagcacatatagtagaaagatatatctcaccatgctccttactgacaattaattcaatatctggttgaaaggctcgtttgactgtaagtgactgcattatactttctcctcccacttcttatcttccttagccaagtatcgcttagcatcggtaaacagttctgaaagtacatctaaagaattagtaaggttatcgatggcttcagtaacttcatctacagcagcctcgaactcagattcggtgacgtcagaaacctttgcaccaagcattcctgtcaggttgtagacagtcgtttcgacatttgcttggtctccttctaaatacccattctctaaaaagttatagtaataatctaattcaatgccttccactattccttacctccagactccaactcttcagtaatcttctgctgctttctaatggttcctaagtattccgtaagctgcttttcgtcttcctctgcttcgtcagaaacgatattctcaataagctcatggtactcttgaaccttttgggaaagcttttcaatatcttctgcatactggttagcgattaattcatgagccttctttgaaaagctattattaagctcgaagtctgcggccgcttttcgtactgtaccaagcttctctaaatactgctgataactcttgatggagtacatcttaattgccctcatctgtattcctccttaaatgcctgtgtaaggcgttctaatgtgttcagggataattaccctagaagctactcaaaagctctcagagagcttcctgtggcttttaaggtatgctttagcgcctgtttgtcttttacataaataactataacacggttgcattaaaatgtcaagcactttttcataataaattaaaaatgtgacaaaaagagctagataaggtctaatctaagaggctcttaaatgagcttgaataaatactccagaaaggaggaagcacttatggtaagaattggaaacagagagttggaagaacgtcaacgcaagtatttaactacttctaaggagccagacgaatacgagggagttgacttaactacattaaaacctaaaatgaaacgctttgcgagacattatatgcaaactatgaatatcgctgaaagctgccgttccgtaggctataatgaaagctcaggttatcgtgtgttaaaacgtgaggatgtgaaagcttatttacaatggcttgtttcagagaatgctgacgcagctattatgagtccaacacaggtattagaagagctaactaatatcgctttacgaaacagctctgattacacggttactgtaaaaggagatgtcgtagagaaacctattgatacaagcgttcaattaagcgcactaaatagcttggctaaattccatgacttattagcccctgatgtcaaggtagaacagtctcttaatatcgtggtagacattgctgacgacgttccaaatgaagctgaagaggttgaggaagaagagtttgtagaaggagactttaccgaagttgaagaagaggatagtgacgtaagttatgacttcctttctggattttaaggaaggagataccaatgccatttgaagagggtaacttagaggttatcgtcaacgaccttattaaagacgttaacactcatgccaaccagattgcttctattcagtcagacttaaacagaatgacaacagacatttcaagcgttcgtgacttgcttatcaaaaacactgagcgttcggacgttctaatcggccacatcaaaggccagtctgacgaaatgcttaaactacttactgaggagcgccgtagacaaacggaaagctacctagctgacgaagcttcagaccgcaagaataaagagtttagtcaaaagcagatgtgggctgtggccactgctcttgtcacaggagtagggtcagctttagtgaccattgttaagctaatcatgagctaattgaaaggaggtgcattaatggacgtagtaatttctatcgcagttgttttaggtggcgttaccacaggcttagttaacttagttaagtctatggatgtagtctctcctaaatacttaccactagtttctctagctatcggaatggtgtttgggttagctatgtcaccacttcttggaatcacattatacgtaggtgctattagcggacttgtagcagggctttccgcaatgggattctacgagttgacaaagactccagcagaataaccttcacatggccttgagggagtttccttgaggcctttacataattttaaggaggacacacaatggctgaaccaataaaattaaccataaccaaaagaacatttaacgaagcctatttaccttacatgtacgaccagcctgaaggacagcatcggacaatggtattctatggaggcgctgggtcaggtaagtctaagttcgtagtacagaacgctattctaaaaggcttatcagaacgccgtaagttccttgttcttcggaaggttgacaacactatccgtgactccatcttccaagagttcttagtctgcttagaggaatggaaccttctcgacttctgtgaggttaaggcttcgtatatgacaatcaagctgcctaataaaacagagttcatcttcaaaggattagaagaccccgagcgaatcaagtctatccaaggtcttacagacatcattatggaggaagcaactgagtttacccgagaggattacgaccaacttcaaacacgtttacggcatcctacagcacggcatcaacaagtgtttgtaatgtataaccctgcctctaaagacaactgggtttaccaatacttccacaaccctgccactaagcgtcctaaaggctctaaggtaatctgtacaacatacaaggataatagattccttcctaaagcttacctagaccatttacaagacttgaagaacactaacccagtctattacgaaatctatgccttaggtaagttcgcaagcttaggtaaacgcatttacacaaactggaagatagactctgagttcaagcctaaccaactagttaaacaaggctatgagcctcgctttggactcgactttgggtttactaacgaccctaccgtaatcctttccacattagtatctgaagcagaccatgtaatttatatatttgatgagtttgttaaaactggtatgatagctcctgagatattcgatgtgattaaacgtaagaagcttaccaaccagcttatctatgctgactctgctaaccttgaaaccatcgagcagattaaacgcttaggggcacgcaagattaagcctgttaagaaaggccgtaacacagtccttcatggaatccaatatctacaaggctatacaatctacgttcatcctcgctgtgttcacacgattaaagagcttgagaactatgagtggaaacctgctaaaggctctgacgactacgagaacaagcctaagcaaaacggctttgaccactgtatggatgccttacgatatgctgtcaacgacctcattccacgtaacagaataagaaccattaacaagtcagtactaggcctataagacgtctagtatctgtcttgggtacaagtatcagcgaaaaatataaggaggattctatatggcaatcccaaacggacaaattaacgctggtgatataatcactactaacatccgacgtaaacatttcattagacgcaactacgatattcgagaattagtaacccttgctgaaatgcactctcgttcttcaagcgcctatggagtattgtacgactattacaaaggcaatcacattgctatccaatcacgtactttcgacgacactaacaaacctaactctaaaatcgttcataacttccctaaactattggtagacacttccacagcttacttggctggtgaaccaattacggaatcaggcgatgagaaaactatcaaagccatgcaaccagttatgaaagagaactatgtaacagacgttaactcagaggaaattaagctctcaggaatcttcggacactgtttcgaaatccattggattgaccgtaacaacaagcatcgcttcaaagctgtttctccaatgaactgtttaattgcttactcagcagaccttgacgaagagccattagcagccatctattacaatactgttatcagtgatattacaggacacgtaattagaacttatgagatttacactgaggataagattcttaaattctctaccgacgacgagagagacgtctacaaagagattccagaagtgttggacattagaggttatgaagaacatcctaacctacttaaaaagttccctgtattagaaatcattgctaacgaagaacgcttaggtgactttgaagctcaactatctttaatcgatgcttacaacctagctgtttctgacagcgttaatgatattgcttattggaatgacgcttacttgtggctacaaggatttgaccttagcgcagacagcgattcaattagcaacatgaagaatgacagagtaattgtaacagacgatactggtaatgtcaagttcattacgaaagatgttaacgacaagcatatcgagaacattaagaaccgtgctaagctagacatcttcagcctatcacaaacacctgacttggtttctaaagacttcaccgcagcttcaggacaagctttgaaagcagctacacaaccgcttgagaataaatcagctgttaaagaatctaagttccgcaaagtattagctaagcgttatgaacttatctgtagctaccttgagttaatgagtaaagagaaagacttgaaaccaaatgaagtaacacctgtctttgtacgcaacttaccacaatcttatgcagagttagctgacatggctgttaaacttcgtgacatgcttcctgacgaaactatcattaatcagttcccatggattactgacgctcgactagaagtagagaaagcggatgaacaacgtcagaaacgagctgacatcgccttgcagaacttcaaacagactagtgctgtacagggagcctcaacggcagctgctaataagctagataagaaccctgctaacacatctactatcacaactactgacccagtggctgcgaaggaacaagagaaagctatccaaaagaaacctaagactgactaggaggaataacaatggcacgcaagaaggataaagagaaacgtcaacaggaaattgaagacgccttagttgctctcatgatcgctcagaaccacaagtaccatagattcactgaccgcttcactgtccttcttgatggctttgttaatgagcttatagtaaacctagctgaccctaagttggatgcttttgcaatccttcaggtgagtcagtatgaggctatcagaaagcttcaagcagcattgatagactatcaagaagagttcagggagatgcttttagagagcatgtcagacaccttagaagagaccttgggacagctttttacaaataaggctataccttcagcgacagataatgcctacatcgaacaagttattgcagaggcttacgactactttgaagaaatcttcttgcaattattagtagagattgaggccatcgctgttggaactattccatcaacagaggacatcgtaaccactatccaaaagcttcgagatagattgtcctatacactacgtcgacacattgaagctcaaatgtcggcagtaattaacctcgctgttatcgaagcttctaaacagcatgagattgaattatggaaatggtgcatccgtccagagcttactgaaagcggtacttgtgcagattgccgagagcttgctgaaggaggtattggtaatgagggtctatataccctagccaccatgcctttgctacctagacatccacactgtgtttgcatcctaattccatacgtcttatagagcggtaatgttaaagggcgctcaagaggaaaagaactttacacaaactaatctaaacgcacgcacagggcttaattgaactgtggagggcagaaggagaatcttatattatgaatccagaagaacaaggacaaggacaacaagttgatttgacaccagaggttatcgttggagctattgaatctaatccagaattagcacaagctatccaacctcacgtcttaacgaaagacgcagtatctagtttcttaaagacagacgaaggtcttggcgtagtagcccctatgattgaccaaagcgtttctaaaggcattaacgcttggaaagaaaagaacttagagaatatcgttcaagagcgattggctgagttaaaccctgctgaaacacctgagcaaaagcaattaaaacaaatgcaagctcaaatggcagctattcaaaaagataagcaaatgttggaaatgcgtggagtagctcaagaagctttagcaaaagctggtttgcctgcctcattagctgggtacgttttatcagacaatcccgaagccgttaagcacaaggtttcagaattagatattgaaatccagaatatcgtttcaggactagttgaccagaaggttgctggaatcgcagctaaagcagctccaacaaactcagacgacatgtcaaacattggcggttctaaaactgtagaacggttaacagatttaactgttgaagaagcgacagaacttgctcgaactaaccctgctaaatatcgccagttggttcaacgtggataacaacagataatcatataaactataaactattagaggagactattaaatatggcacacgaagtaactaaaatttcagacttaattaatcccgaggtaattggtgcgttccttcaccagaaaatgttagacaacttagtattggctccatttgcagaaattgaccgtacattacaaggacgtccgggtgacactttaacagtaccacaatggaacttcattggattagcggaagacttagctgaaggtgcagaattacaatcagttaaattaactgctgctgaacgtacagcgactgttaaaaaagttgctaaatcagttacattaactgatgaagctgttttaaatgcttatgttcgtcctgttgatgaaacagttcgtcaattagcaatggctatcgcaggtaaaattgacaacgacttgtttgcagctatgcgtgcattaactccgtcagatgttgaaatgactgatagctacgagtgggttattgatgctcaagtagcatttggcgaagagtttgatgaagaaacttacttattcatctcacctaaacgccgtgcaacaattttgaaatctaaagacttcattcacattcaacaaggcgtgtctgtaatcaaaggccacttaggtgaaatctacggaatgaacattgtagtttctaacaaggttggtgaagacgaagcgttcgtattaaaacgtggagctttatcattaattatgaaacgtgactacatggttgaagaagtgcgtgaaggtatgaaacgtcaaactaacatcactgctgaccaacactacgtagcattcgttaaagatgctaaacgtgcaatcttcatcaacaaggtagctgcgggaaagtaggaggaggtaaatatatatggaaacattaacagttcacgctccatcaccatcaacaaacttaccatcatacggtaacggtgctttctcattatcagctccacacgttccaggtgctggtccattattagttcaagttgtttactcattcttccaatcaccaaacatgtgtttacaagctttaacacaattagaagattacatcaaaaaacacggtgcttcaaacccattaacattacaaatcatctcaacaaacatcggttacttctgtaacgctgatcgtaacttagttttacacccaggtatctcagtttacgatgcttaccacttcgctaaaccagctccatcacaatacgattaccgttcaatgaacatgaaacaaatgtcaggtaacgttacaacaccaatcgttgctttagctcactacttatggggtaacggtgctgaacgttcagttaacatcgctaacatcggtttaaaaatctcaccaatgaaaatcaaccaaatcaaagatatcatcaaatcaggtgttgttggtacattcccagtttcaacaaaattcacacacgctacaggtgattacaacgttatcacaggtgcttacttaggtaacatcacattaaaaacagaaggtacattaacaatctcagctaacggttcatggacatacaacggtgttgttcgttcatacgatgataaatacgatttcaacgcttcaacacaccgtggtatcatcggtgaatcattaacacgtttaggtgctatgttctcaggtaaagaataccaaatcttattaccaggtgaaatccacatcaaagaatcaggtaaacgttaacagcccccaagaatcttcaatctagcggggttactgaggactcagttactctgacttgggaagacggaggggcaagcctctagtaagctaaacgagaggttgcggaaacgttccgtgacctcttttactttatcataaatcaggaggaaaagcaatggcaaagacttataatatttaccaagatggagcgaaggttcaggaaggcattgcagagttaactaaaaccattacaggccttacgccaaacacttcatacaagtttgaggtaacagctgttgaggacggcgtggagagtgctaagtccacagcggtaacagccaaaacaaacccgcgtaaagtagctacagtaacagcttctcaaaagactatgtctctagcttctgacggaagcaaagcattgactttcacagtggctccagaagatgctactaacaaagaattagaaatcactaacagcaaccctgagtttgctacttatgcagacggtacagtaacagctgttgcagaaggcactacaactatcacagcaactgctaaagatggttcaggcgctactgcaaactgtgttgtaactgttcaggcaccagcttaataaactatcccaaggaggctgaggcgaatcgccttggtcttcttttaaggaggaagctaaatggaactaattgagaacacggagttgttcaagtcgtttgaagacgttaccctaccacctgaaacagaagctattgacatcaccgacttaaagcttatgcttggctatggtaacagcactatccgagacaacgttctgaaggttttgaagaagcgtgctagacaacatatatgcttattcattaacaaggaagttacagcctttccgatggagttggattacattgctgacgagcttaccgcagggcgtatgtcacagcttaactcagaaggccttaaaacagagtctactgacatcactcgttacgactataaagatgacatctacgcaaactggtatgccattcttaaccgctggctaaaacagcaaggagagtatcgcaacaaggcattattcatgctttaagaaaggagcttacaaatgcgttataacgacattgtggatttaatccaatttaatgattgggacgaccctgacgacgactacggaacaatctcttataagactcgtggaacaatcgttgttaaagaccttcctgtaagtgtaggctccctacgagttcaaggaaagctattgcaaaaccaagaccaacagtgggagaaacgctacttgatacagcataaagtattcgagttaaagaaccttcgggtagacgctgtccgacgccactccacaggagagattctaaatgtctattgggataacactactggaacagaccagacagtttcttataaggttgagtacagagacatccgaagagacaaggaggacggagttatatggcagggttcttagaaataactaaacgaatcgatttcgcaggcttagagagagagtttgttaatgaggtgaaaggcgttgttgaaaagaactccgcacagatggctacagctgttagatttaatatcgttcgtagaggcaacgtagacacaggaacttactacgatggaataaagtctaagacggaagtagaagggaagggtaaaagcgttacaggaattgtagagtcagacgtttcaggaaacccttatggacacagaggttacgctgtttacctagaggaaggaacttaccgacatcaagcattccctaactttacagacgctttagaagagtattctgatattcttgtcgagcagcttagcagaatcaaagtgtaggaggaattatcaatgagcaatagaccacctttccgtgcaagaagttcctctgtagctttgcaaagggctatcgtaaaggaaattagagcgcaaggaatcaatgtctgggacggtactaataagtttccagaatatccattcattaagattggtgaggagctaacttcaggtagaacaatctctaaggatgctatcgggaagatgcacaacctaacccttcacatatggagtgactacgacagctcttttgaagttaagagtctaaccgactttcttgtagacttacttaccaactctcctcttaacttagaggacggcttctgtattggagagaaatccctcgaccacgttcgttacacagaagctgcaaacggaacttataaaaacgagcgtgcatatctattcttagacttcgaggtaatcgactctacgatagagccataataacacacataaaggagactgacaaatggaagcatgtaaatctagctacattcgtggtacagcagtattaattgaggttcagaatgaccttggcgaatggattaaagtagcagcacaacgaggaggtacattaaaccgtacagcagcaaccttagacgtatctaacaaagaaggattcggatgggacgatgcagaagcaggtaacaagtcttggtcaattgactgtgacggattgttcgtagaggataacgctggtttccaagcattgaacgcagcttgggttaacggagattgtgtacgtgttcgtgttaaattccctagtggattaacttatgtaggacaagcaatcttaactgacttcccttacgagtttggttacgaagatgccgtgacttactcattaacattccaaggtaaaggcgctttagaagagcaacaagtagctcctacaatcttacctaagaaagttgagttcacgaacgaaactaaggaagttaaagttggagaaactcttcaagctacaattaaattcactcctgaaaatgtttctgacaaatcagtaacttacactgccttgactccagctttagcaacaattgatgaatctggtttaatcacaggcgttaaagaaggtactgcatcattcaacgttcgctcaaatgtcaacacagctgtttcagcattgattgatattgaggtaaagcccgcggggtagtagaagccccgaccgagctttcggcaagtagcgttagcgaagactcagtaacattaacttggaaatagactgcacagagggggcttgggataaattcccttgccctctttttacataacaaatataaaggagattacaacatgattataagattccaaggcaaagaccttaacctacgcttaacatacaagtctattcactttctggagttagcctttgaccaagactacgcttctttcatcgctgagcaaacgcctttcaaccagtccttatatatcttctgggcaatgcttcagaacgagtctgattacgaaggagtatccgtactagatgtagcagagcttctacaagactctctggatagctatgagtttaccttagaagaatacttcgagaaagttaacagctcgtatgcttcaagtattttagttaaacagctattcaaaaacaacacaagctcattacccagaggaggcggaagacgaggacgagcttccgaagctagacgtaagatactttatggtattgtgtacagacttaggaataccttccagcgacttttggacaagtacaccatatgagtttaatggaatgttacgaggagcttaccaaagacaatcaagagaagcttcgttattcctttctctagtgcaatctaagaagcctgtcaaattagagaagtaccaaggctttgaattagttaacgaaaccaacaaacctaagactactagagacatggcggaaacaatggatgaacttgatagagcagcctttaaagaggaagagctatctaacctgttcgactactttgactaggaggaaatttaaatggcagataaggaaatgcgaattaaggttagggtagacaactctgactacacaagtaaaatgaaagatatggagggcactcaatcacgcttagggaaaagcactgagcagactacaggaatcttcggtaagttcttcaacaagttaactggtggtgcgagcttagctaacagctctatgctaggacttggtaaaagctttctatcaaccagtgttggattcggtactctgacagctgctgctacacctatggccgctgctgttatgggagccgctgaagctactaaagttgcaggacgctttgcgatggattccatcaaggactatgctaactttgaaggaacacttaaacaagtacagattattgcaggtggtactcaagccgacatggacatgctcggtgacacagctatcgaaattggtggtaagacttctaaaggtgctcaagaagttgctgaggccatggtggactttgctaagctaggttttacagctaaggaaacttcagaggccatgaaaggtatcgtatacgctgccgaagcttctggctcaggtgtacaagagactgctggaatcgtagcaacagcgcttaacgtatggaatctggaagcctctaaggcagaacacgttgccgacgttttagctaagaccgctaacgaaacggctgctgacatgcaggacatgggatacgttctacaatacgctggttcatcagcttccctagcaggagcttctctggaagacctttcagctatggcaggtatcatggccgacaatggtattaaaggttctaaagctggtacatcacttcgtacagcattcacaaaccttatcaatccaacagacggtgcggccgctgcgatggaaagcttaggggtacagtttaaagatgctgaaggtaaggctcgtcctacaatggatgttatctatgacttacaagatgctgttaaaggtatggatgatattcaaatccaagagctttcaacaatcctgttcggaaagcccggggcggctggtatgtcgttcgtccttaaatctactaaagagcaagtacaagacttatcaaaagcattagtagactctacaggtacagctgctaaacaggctgctgctatgcgtgagactatggcaggtcaattagaccaactaggagactctgtggacgccatcaaattaaaaattggtagagcgtttaccgacatgtttgcactagacgctgttaaaggattcaacaaggctcttgatggagttgatgaaggcttatcaaactttggtaaaggcttcaagcgtacaagcgatttactagaaacttctaatggattaatctctggtactaaggatgccaacaagtttgttgaagctgttcgagatgcaggtactaatcttacaaacattcctttccaagagtctttagcacagtctcaagtatggggaatcggaatctctaaaagagcttatgaaactaacgaggttatgtatcagcttaacaaaagcattcaagagttcagcttcctaccagatgactgggaaggcaagtggggacaggcttcaacaatccttaaagactcagtaggtcaaatggagttgaaacttgcttcagcagcggctaaaggtaagcatggtggagaagccgatatttcaggtattatgaaccagactatccaagagaatctacctgccttgcaagaagctttaaatgagcaagtagcagttttcgggacagctaaccaaagccgtttagatgccttgcagacattcttcactaacgagaagactttaactgacgagcagaaatctattatgatgcaaggtgaactaactcacggccaacagctttccgataccattcaaacaaataacaacaagattttagaattgtatcaaagcatgggtcaacaggattatgcacagcgtcaagagactggtgccgctataaatgcattgcaacaacagaactctgaaatcctgcaaaacatcgctacaactgagtcaagtagtattattgaaacactgaaagcacaggctagtagcactggaacaatcactcaacaaatggccaatgattctattacagccgctaatcaacaatattctgaaactgtagcagcagcctctaaacagtatgttgaaactgttagttcaattaaccatatgtcagatgaatctatagctgccgctggaacaactagggacgagcttatcgaaaaagcacgccaacaaatggttggaacagtagaccatgctaagactcagaaagagcagacagtagaagaaatcgagaagattgctaaaaagtctgaggaagttgatgggacacacattcaaataaacgctgacgcagatacttctaacgcaatggaagagctcggacaattagctgctagaattaacgacgtgtttagagcctttggagaaactgcgggtaagattcaaggcggtattgatggctttgaaagcaagcttagacaagcggataaatgggttgcaggaaaggttggcggaatcttcaaggctcgtggaggacttacttcaggcgttggttacggaattggtggaggcaatgcacaatactctccaatggctaccgcagtaggtgtcggaacccagctaggacagggcggtattaatcagggcgtaatccataacgaacgaggaagagaagttacaatgcctattcaaaacgctacttacatgagacctttcgcagcagctgtggcaaacgagctgcaagcaatgggtgaaggacttggtggaggaagcattcctgaagttatcgtgccattgtacatcaacgataaagagtttgcgagagctactaacaaagctatgacagaggaacagcaacgtgttaaacggattgctaaccgagctgtcggtaaaaagtaaaggagacgtttaaatgacctgttctaataaacctaattatacaccttttaaattacaaggtctagcccccactaagcagtggggattaggccgttctgcaagttatgaacgatttaacccaagcgagttccatgcgctagaggacgaagttaagattacatttccagtagactttagaggaaaggttaaaggaagcaatacacctaacccttcacgaggatttagccacgctagtcaaatctatcgtgagaacgtgttaagaggtagccaattcctttctaagccttctttgctttttaatggagctgtatacaatgagaagacagtctacaatggagctatggttgcttctactcaagaagttaatcaaggcttgatgttctattgggaagactttatcaatcctgacccaagaattaaagaaggggatatggtaaccttctcagttgatgtacgaagcactggggaagatattccgacaggggctgtggccttcaaagggacttctaactttgaggaatactataaagtccttgaacagcctatcacaaaagagtttacaagagtatcttttactacacgattcttgtctaaggactgggaatgggacgaggcttttggaatgttctggggagtagagaatgttcctgttacagactatccaatgttccaatatgacaaggataagttagttggttttattcaggctcaagaaagtgttcaactagagttctcacggcctatggtttcaactatcggaaagactgcttacattgagtctggggacgacatgttctctaacaacaaatgggactggtctaaagccgtatctaaaggccgtttaaatgaatttgatggtaagtataacacaaacggaatcaaacaagactgggcaatgcctgagttcattcctattttcaaaggctctgagagaatccacttctacaaaaagactaccttaacggaaacaactgacgctggacatggctatggtaaaatcctattctacagcgctgctaacgaggattcttacatgaacgtatataagaagttccctcacgaggctggtgtatatggtggatacgcagctgaagtagaagtgcctatcggagctactcactaccgtgttcatataacttcagaaagaggaaaggccactacagaagcctatgtacaatcttctgctaacgactggtcagagtttagtcaagagtggtacgacggactgtcaggaaagctagatggaaagactgccagagctgagacattctatcgtaaagaaatggttgagatggagtttgagctacactttgcagaagctgtacagaaagctttaccagacatctttaaaggccttactactgacgctgagaagcagcaaagacttcgtgacattgcttatcaattcgattcaacaatgattgcacgaggccgtggccaaggcaataacttagctgattggattttctatagatgggctcctgacggctctattgaagagcagacaatgaaacagtttagaggtgagggattaacttcagttacccatccatcaagctatcaagagtggattaatccacaaggtaggattgtaacatctcttcgctctaaccgaatcattcctaactcaatgtacatgggaactgatacgctaagcggtaagtatgaccctaaattaacaacgcttcagctagaagttaatggggagcttgttgataagaaggctaccttagataagacctcagaggtatttacatttacaggtcttaaaggattcttaaagcctgaagataaagttaggattgctggatggattaatcgtaacaaccaatggtcaatcacctactctaatgttcttatgggaaacactcccgaaaacgttgctgagtttaacgaacgagctttcgtcgaagctgattacctagttacaaacatgtctattatcgtaactcaatcacagatggatgaatggggatttaaccctaatctaccagactaccgaattgaatcattagaacgtccagcaagtcgtactgaggagtatatgattaactcaatggtacaggtaacacatgcttatgacatctacggttttgttgaaagtaactaccctgagtttttcggtgactgttacacgttcgatgatagaataagaaagattaatgaacgcatcaagcagtttaacttagtggctactacttattcagaagagccttgggaagcaggtaatcctacaatcttcattagtgcggaagctaataatcccgacagagactacgatgttaaagcagagataaaccaaacagttgaactacaaattaacaattctaagggacactttatccatcctaatggttatatatacgtgggatttgcaagaatgcctagaagcgaccgtgagactggaatatccgttgactctgagttaagctttgagttcacgatggatagacagtacgacagccttccaagagtattccgctacaactaccagaaacagccttggttcttgtttgtaagaaacattaacagaagtgttcttgcgcctaaagtaaacactctaactcctattaacggaggcactagacgttataactttggagctacagaagacgctcggtatatctcaatggactgcttcatcaaagctcctgcggaagaggttatgcctaagttgatggaagagcttgctgacttcctagacgttggggaaacggtaatccaattctctgataacaaagaccgttattacaaggttatgttagatggctcgacagacctttctcaaacgcttcatgtaggaacgttgacgctgactttcgtactgcttgagaatacagccatcggtgaagaggttgtagaaagctttgacatagacagtacaactggttcagttccattcatcgagcttgagaacatgggtacggcggacgcttaccctacctaccaactgacctttgaagagcctgtaggatatgttgacctaatcggtacagatacctcagccaacgtgtcaattggaagacgtcctaaagatactgaagacgaggttaaggtagaccttcgtccacgtaagttttacagtaagtttacgtctacagatggagctggttggactgccatgaatgacacacagcttcctcaaatcgaaggataccaaactaagcttcagggaactgttcaaagagttaacggaatggccaatcaaaacaagtggaattacggagacactagccacagaggatggcacggagctggtatcgtagctaaccttcaaaagaaccttgacgacttctatatggaagcctctatcgtagctacaggaaagccagttaaaacttctgctaatgctattttcttgatattctatgacgaaaacaacaacccatatgcttacactaaggttggtacacggcctcaagagggtaacttagacagctacgtagcttacgcaggtgactggggtaaacgtaaagtagttaacaatggagctaagtggaaagacttctggggtaaggtttctgtacagcgcagagataaccgatggagacttattgtaggtaaatacaaagaccgtagatacagtccttcacctgaagcttcattcaactttggtcagaacatgttgaaagacacaagagacacaggatggttcgacttgcctcctgaaacttggggtaagaagtttgcaagggttgggatattcttcggacagtattcacatagacctaagctaggccacttatcagtacgtagactaattgtgtgggaaaaccttgaggagtatggagaaactcctttagaaggaactccaatcatgttccatgaaggtgacacagttgtaattgactcaagcaaagctcaaacataccttaacggagagcttactccatcacttgtagaccctatgaccgactggttcccaattaccaaaggtgataactacattggagtaaacaacttcaaaggcaagattgacatagtatataacgaacgatttaaataaggaggaaaaagtatgattacagtattaaacgcaaacggacaaacagtagcacactttgtcaacaacgttagcgaaggagtaccatactttgagcctactttgacggagaacatagagacgttggtatcaacgttctctttctctgttcctttagactgtgacgaaagccagtatttaaaaggcttgaataaagtattagtaaaggataaggacggagatttaagacagtttaacatcatccacactgaagaagttttccaagaggttaactcacgtatcttagtggaatgtgaagacttctcaattagtgagatgaacgatactgtaatctatcctttcaatgggcataatttaggagacaccttaacaaaagccgtaaagggtactggatggggagttgagtattcggcagacacttggcaagaaggagaagagcctttcatactagctgagtatacgaacatgcgagaagtgtttggaaacattcagaagacgtatgacgtagactttaaatttacagctgagagaacagccttcaaccaaactaaacggattgtcaaagtgtataaaaacagaggtcttcaaacaggccgttacttcacctatgacagagacgttctaggaatcactcgtgacgtgcagtatgatacaatcaaaacagccatcctcccttactacacaggagtcgatggaaaagtatggacgcttaaaggaatggttccagttaaccctatcgaaggcattaccaaagataaggaaagccctttggtagtccacaatcaagctcatgcagactatgacgaacctttcttcttcaaagcaatgcctttcaaagctgcatcaacaaaccctgagcaagtatatcgacaaggtgtagaagagcttttaaaacacattgcaccaatctatacttacactgttaatgtaatccttctaaatcgtgtccaaggatgggaaggggaaaccttagcacttggcgataccgtttggatgaaagagcgtgtaggctctcgtgaaattggattggaagcacgtgttattgaatacatttatcacgaagacgacccaagccttgatgaagtaacctttacaaacttccgtgaaatagacacttacgacacctctgacattgcaggtatccgagacgctttgaacgaccttaaagaccaagtaggctctaacacagttattattgaaagcactagagaacaaatcagtaagcttgaagaaggtcaggcaggaatcataacagaccttaaaggaaagaactccataagcattggagacacacctaagccaaatcctattgacggcgatacatggttctctacacgtgttaacgaagctggtcaaacaatccatgagattaaagtttgggatggtgttgagaaagtatggaagctttcaatggatactgagaaagcattccaagcagaggaagctgctcaagctgctaagaaagacgctgaggaatctcttgataaggctaaccaagctgtagctgatgctgacactgctaagacggctgctcaagaagctttagatagatacaataagcttatgataagcggacgtaaccttgcgctaaactctcaaaagattactattccagacacagatggagctactagcataaaccgtcgcaaaagcattccgttatcaattaaattaaagcctaatacacaatacttgctaaggtttaaatacgaactagaatcaggaactcttcctgaggatattacagtggtcttgtggcacggctctggatttgcctctaacatagtccatgttccaactaaagcaaataatgttggggaaggttcagcaacctttactacaaactctagcgaagctaatatattgtttatgtaccaaggtaaacgacttgaagttaagcaaggagataactttgattttacagaagtctaccttgtagaaggtgataagataggcgactggcaaccagctccagaagacgctattgcaagcattacaaacatcaatggtgaaatcacttccctagtaactaagacagatggattggaaacaagctatagccaaatctcacaaacggttgatgaaatccaattaacggttggtgacaaagccgataagagtcaaatcacacagcttcaagaccagattaacttacgtgttgagaaagacgatgtaatcaaccagattaacgtttctacagaaggcattatcattgatggtgcaaaggttcagataacaggtaagacttacattgaggacgctgttatcacagacgctatggtagctgacctttcagcaagtaagcttacagcaggagttatcgacgcctctaaaataaatgtaacgaatatcgatgccagcaacattaaagctggtactatccaaggtattgacataatcggttctaagattactaaccctttctcaattggttctgaaggctatacgctagtcggtcagacagtaatggaaagagctcaggttaaaatcgattataccgtatctgaaactggtcaaaaaggttggtcaatacttcatgcaagaggtattcaaaatcagctgcttaaccaagacggtaccattaactcattttcatctcttgcttcagacggattatctattcaagattctttaggaaatagaggttacttatcagccgagttgctaatgcagttctctaacactggcaagaagatttaccccggaaattcatgggtaactaacactgatagaattgtaccatcattgacaatgaacaaatgcgctattggatggctgttcttatggcaaccttacgatactactggcggtaagccttatacatgggactatacttactatttagttcctaaagctcatgctaactttaacaatggtaaaggtattaatatgcggctacaaggcgcaggtaaaggtggaggagcagatgatactgtgtataaatatgtatacgtatctaatgactctataacaggaacggccaataatggtactgggaatggagctagatgggttcttaccagtgtattttcagtttaaaggagggattattgtgagagtttggattgaggataagataggattcttaacaggctacactacagagcctatggaaggttacaagtgtgtggagattgacccttcagagtctttagaaatgcttggtggaatgcttgatttccacaactactactatgatggtgagaaagtatacagagacactaacaatgacttccagaagttcttagaagaggaagctaacaagcctcctgaaccttctaaggaagagatggcagaaagacttgctaagttagaagcacttttagcagacttgctataaagctttgggtgggttgtgggaataatattagaaaggagattcatacatggttaaagtaaacgatgtagtaagctatgtcaacggacttgtcggcaaaggtgtagacgctgacggatggtatggtactcaatgtatggacttgacagtagacgttatgcaacgcttcttcggatggcgtccgtatggtaatgcgattgccttggttgaccagcctattccagcaggcttccaaagaatccgtaccacaagctctacacaaatcaaagctggtgacgttatgatatggggcttaggatactatgctcaatatggtcacacagctatcgcaacggaggatggaagagctgacggaacctttgtcagtgtcgaccagaactggaataacccaagccttgaagtaggcagtccagcagctcctattcatcacaatatggatggtgtatggggctgcatcagacctccttacgaagctgaatcaaagcctaaaccacctgcaccaaaacctgataaaccaaatctaggacaatacaaaggagacgatgatattatgttcatctattacaagaagactaaatctaatactaccgaacagtggttcgtaatcggaggtaaacgtatctacttaccaacaatgacgtatgttaaagaggcgcaagatttaatcaagcgctatggtggaaacactaatgtaacaacctataactatgataactttggattggcaatgatggagaaagcttacccacaagttaagttataagcctataagaaaagccccttggaaggttactccaaagggctttttatattacaactcaaagcattctttaagcttttctaaagctactctataagctatcctcatgcctttacccatatctgactcctcgtcagcaaggtaatttaatctcctatccaagtctaagacaacctcggccaccttctccttgttaatggagtctacagcttgcttatgggaagcttctttaatagcatccacaatgatattgaaagggtctttcggtaagctgcttccaagggttatcttagaacagtcgtcagtatctcttagataaacttttggtacatctagctttatgaagttatcattacggtagtttaaaataggtcaacaacctcctctaaggtatattcagtctgtggagtggcttcgtcagcagccttctgttcagctttctctaaagctacactcatgaagcgttccatgtaaagtagtcgagcctgactgtaagaaagcgttgggtacctcatattgcttcggtagtctgcaacagccatctctaagaatatgcgcaaagcggtgtttccaaatctttccatatccttcttcataatagctcttagagtctgtagtgaagcattaataggagccttaccaaacttctgcttattaaggtgttctacataggctaggaatgtagttgtattccaaagactttcatcaactttccaccaatcctttgtatcaaccttgttcccctcggcgtctttataaagcttgttctctttggttctaatccatgccatcttaaatgccctcctcgtgctcgtctaaatacttccaaacgaatcccttatgcttacctcttcctttagtacagcatctactaatatgtgattgctggaatccatctgcacatgcgtctgaagccttattgtatactaccatttccccagttatctcattaaatcctacaacagctcttccctgtcgtttatacaaagttttcataataacctctcccttaactatttgatgaaccaatcatatcacgtattagatggaatgtcaatacctttttaacaactctcacgaaaaagtttcaaaggcgactgaaaggagtctttaggctgtgagggaactttccgaacgcctttatattatatgctatagctatccttaaaccataagaccttacggtctttaagttcaagagcagcttcgttaacactcagctacaacctcctaaagtcggttgtgaaactatttaataagcttctctttctctctctctaaagacaagtataacatattcctaaaaatgtgtcaagtgattttgcacaagaacttttgtggagttgttaattgtaaggttgttgaaacaattgtaacaaaactgtaataataaactttaacaaatgttcaaaaaggcttgacttatactttataatatgctatactaatgaagtagtaaagatgaataaagaacttattaggaggaaattaattatggctaaaggtttagaagcaattgcacaggcagcacaaacgcaatcaaaaggttctggtgagcaatccaaaaagacttaccttaaaaaaggacaaagcattcgtgcgcgcattccagaagacatcttagaaaacttacacgtaaaccaagtcgtttcagtttttgaaccgcaagtgttaccaacattatcataccatgcagaaggacgtacagacgttcgtgacttgtatcatgaagctactgaaatcatgttagcagaccaccgtgctaaagttgaatcaggggaaattgaacgtggttctcaagctgacaaagactcatataaagcagctcgtatcttaactccaaaaccacttatcttattcggtgtaattcctttggcagacttcacacaaggcactaagaaaactaatacttacccagctggtgagccaatcttattggaaactaacttaggccgtgacaacgctaatatcgacgccttaacgaacttcttatcaaaagaaactaacgctaagaaattccctaagaaagccttcgagattacttgtgaggcggctaatcgatacactttcacaccgttagatgatgaagacttaacgcctgaagaattagaagtattcaaagctacagaaggcgctacagtccctgaagaagatttcgagaacgcaatctttgaaagcactattgaacgccaaattgaagacttgaagaaaattggtttcgatacaactcgtttaccaaacttaccaacagctgctccagccgctaacaaaggcgctgacgaagttggtactgtagacccttcaggaatcgatttctaaaaactatacgaggggcttcggcctctctcctattatagggaggacataaagcatgaagaaagacacaccaaaagtgaatccaattaagtttaccgaagaggattacttccgcctgttacagacagtcgttatgacaaacacattcatcggctctctatcagctggcttccaaggtaaagaacgcttagagaagattactaaaatcgctgagaacatgtttgttcttaaccgcttgatggaatctgccgaaagcaacggcgaagactggggcgacgaaatgttgttagactcattatacacggattcagaagtgcttgtaactaagtataaacacttgctgtcagaagaccagttggagtctatcaataactctatcaaaaactttgcagaatcagccgagaaagctcgcaaagaagcctacgaagaaaaggttgcacaagccgaagtaattgactttgaaaaggccaagaagaaacgaggcaagtagccatggatagattagagttcttcacgaaagtaattgcaatgccttttgatatgcaagaggttcccatacatcctttagcaattaccttttcagacacattttaccaagacgactttccattaagtcagctttacgacgaggcaattgcagaaactttgtggaacgcttcttacaaaataatccataatgaaatggccaaggctaagtcggtaaaagtattaattacaatcttcaatccgaacaccttgatggaaggaacgcttgtatatgaagctattccagaagacttgcaagtagctattgacacaggagtcgtagaagacgttgagtgggaatctagtgagtcggtattccaacacgaccttcattacttctttaaaggatactaatggattactcaaagtttaagttaggcgatacagtaatgtatcagggacagctttgtggagcaggtactgttatcaacggcaatacctacactgttgtacagcttaccacaaagcctcgacacgcctttatcatagatgaacatggcaacaagaagcttatccaaatggggttcaacttcgctaaaataaaagaagcttaaaaagtgttcaaaaacgcttgacaaaagcttttaaatatgatatagtattatatgtaaggcggcactactacggtttgtcgtaacatagttcgggatgcttctcggctatagcggtctagggctacagattgctcccgcctgtgggctgctgtaaaaggcagtaaaaataatagcaggagtacccacccttgaggggatgagagggcgtagcagaggcggtgacgactgcctcgttcatgcgttgtaagtgtaatggctgcacaatggtctccaaaaccattagagagggttcgactccttcacaacgtgttcaaataagtcttatggaggtttgtggaatgactactgaaagtatgaaaagtgagaaagcttggaaccgtgccattgtgaaagctgagcaagaagctgctaagaagaagatggagcgccttgctaaaatgcgtgccaaaagtaaacgtaaataactccattaagtaggtaagatggatttcttatctgctattacataagggactaaccaactgcggaggagagttagctactttccaaggccttgccgaaatccctaaccagtcagttagcatagtttaggttaatgcgcaacagtcttcctatagcgcttgtcggaggctgattgagaaaggggttcgaatcccctactggcgccttacatattcccaataagcacttcggatagatgccagaagtgttccatggagggttggctaggggaacgctcaataatcccttgctgtaaagcttattccgtagcgtgctaaaacgactaggagcggagctacatgtgatttataggagggcagtagcagtcctcagctaaaactagctacactcgtgatggaaggcgaggtaagcgccttggccaaaacattacccatggtggagtaatccacttaggagagcgtcgtacgacaaggtgtccagccaccttataaaagggttgaacattaatgcacgctgttaaccaaggcctgtagggaggtcaccaacagcgcattagccaagaagtccagagtagctccctagtgaagtcttctgaagctggagttggctaccagcggccttatattcgggatacagaatgttgtcccctttggataagttctgtgaggcggttcgattccgtccataaggcattggctgtttatcagctcattccaaaaacctctttcataaagaatcacctcctttcgattagagcagcttaacggctgttctttttttgttaaaaaggccttgacaaagttttaaagctatgttatgattaattcatcaaagagatagaggagaggttttatgaacagtttaggaatatctaaggtaaactatgtgtgtagacactatggaggaacggttcttgaagacgaagttgtagagattgtcggagagtggactagcgctctaggagaccatattatggaagtattgccaatggattcagaatccagagatgaaacggttgttatcaaagcttataatatccatcgtatgaatccagaagaagtattgggttatcatttgaacaatcttgaatgtgacttattcgccaatgtagactatggaggagagcttttacagagtagtattcaaagctaatcaatatacttatggagaagatttaccagtatctcatttcacatcagtccgaatgcttagtaaggaggaatattaatggaaaccatgtacacagttatttataagaacgctgtagaaagtgagccagcgcttgagggaggaagcttcttaacggacactcctaaaacagatggattaaagcttatgattttcgggacaagagtatttgaagtggagtttattgaccatgcggagaagaaaatctacgcaactagaattagataaggagtggtaatatgtggaaccagtggacactttactggacggatagtgaaacatcagaggaaggtaacttcaagattcctcggccaaacgctttgtttattggaatgcctattgacattgatgagtacagatacactgtgacagctgtatcaacacctactaaagaggtttggacagaacgtattccattcgattttggccctaaaccaccttgggaacacaacaattaacttttaactggaggtttttaaatgcttgatgagacatggaagccaataaaatattatgaaggattgtatgaggttagtaatttaggtaatgtgagaagcttagatcgagctgttcctcattccaatggaatgtatttaagggcagttaaaggaacaactttgagtttatttgattcaggtagagggtatctaagcgtaagattaagcaaaaatggtaaaaagaggaataagttagtccataggttggttgcagaagcttttatagataatcctctaaacaaacctcaagttaatcacattaacgaagtgaggtgggataacaacgtgaataatttagaatggactacctctaaagaaaataacaaccatggttcaaggactttaaaagcctctaattccacaaaaaagaaaataaaagcaacctcaattgacggattagatgtaagagtatataatggagcaatagaggctgagcagctagatgggttttcttataagcaaatttcgctatgttgtacaggaagacataaaactcataaaggctttaggtgggaatttatataaaggggattttttaaatgcttgatttaatacatttatcaaaggatattaaaatacatgtagacatacaaagctttctaatggagtttgaatgggagcgggctaaatggacggaagaccgtttaatagcagcttcacctttcagggacgacaatcaccctagcttctttgttaattttaataatgactttgcaggaacttggggagactcagggagtggagagtcaggaaatttcatagagttagtttcaagattatatgaaacagattacgaaacagcttttgaaatgctaaaagaacggtactggactagaccttacgaagctcctgcaatatctgttaagctaggcgttaagaaagagaagtcaatctttgacatacctgtccataatccatctccatacctattaggaagaggaatctcagaggagacacagaagctttacagaacctctgaggacgagtataaagtatgtcttccatacattaacggaatgggattagcaacagctttaaaataccgtcggacagactctaaagacttcttctatgaggcaggtaacaatcatttgaaaagcatgttgtttggctatcacgcaatctatgaaaagcttcctaagactgttgttatatgcgaggctgagatagacgctatgacagcttatgatatgggattcgtgggtatttcactaggagctgctaaccttattgaaaaccaagtggaactcattaagaaagttggtctcgacaacatcatcataggcactgataatgacactaaaggaaacttagcggcagaagagattgaccaagccttttggaagactcataaactattccgatacgatatgcctgatggatacgacttaaatcagtattggcaagagtttaaaaaggctcctccaatccgtaagataagcgaacctaaactgcttagaagaaaactctggtgggtacagtaaaataaactttagaaagaggcttgacaaggcctcttttttatgctatcttaaaggagtagtaaggagatgttaaaatgaaattgaagaactataaaaaaccttggacacaagaggacatagattatttagaatggttctaccagaaccctgaagaaggctccatcaaaagcgttgcagagtttttaggaaggactcctgaaagtgttaaaactaagtattatgaattacgtaggcaaggcctgttagaatacccatcaagtattaataagaaatggactgaagaagagcgccaatacgtattagacaactatgggaaaatccctaacaaggaaatggcaagaaagcttggcgtaagcactgccagaatagttcagttaaattggtaccacacccataaaaataaaggcaatgaaggccttgacaaatagttacaagtgtgttacaatagtgaggtagaaatttttaggaggattccaatgagaaaacagacccttttggaaaagcttaaactagttacaggaaagacagataaagagctaaatccaactctttcacatatacatattcaactatgtggaggctctgggacaggtggtaagttcggcgccgctaaagttccatatgactattcagacaacttcttatttaactctcctgcaagagttacccaagagcaaatctacaagcagttagaagtctatgtaggaagcttcaagagagacttcatcaaagatggtaacgtaaaccaagatgaacggccaatcaagaacctatacttatggagtgagaacaaaggcaatgggaaaacttctacagcagctgccctcctaaatgagtatatgttcatgtcttggcaagcttcggtaatccgtaaaacaaacatgaaacaaccgcctgcctacttccttgacgtaaacagtttccaaacgctttacaataagtttactagaaatggaatcgcaaaagacattgcagaaaagacttcacgagagtattacgaaatgatggaactagctgagtcagctcctttagtagtatttgacgaaattggtaatcgaagcgctactgaagctttccgagcagaccttcacgacatcattaacaaacgaatggtaaacaagcttccatcaatctttacaagtaaccatccaattgactacttggaacaggtgtttgatgaacgcttagcagaccgtgtacgtgaacgaactatcgtgtatcatttcgagggcgattcacatagaggaatataggagggattaggatggcttcagtttcagctgagatgttattatcaaaggttataattgaaaacgatgtacaggctttaaatagatatggagtaagcgaggatttattccagtcgcctatccacaaagaagcttacaactacattattaattacagtagggaaaacgatggaaatgctcctgcttaccaaacacttttaagaaaggttcctgagttcgacttccaaagctctgcggaagagtcttatgcaagccttactaagagcttaaagaactctcgattacaagtagctacagctgcttttatcaatgctgatttaggagagttctgggaaaactcagtcaaaaaggacgacccaacagacttcattaatcagactatccatgccttggaaacaatcaaagcagagaacttagttaatggagctaatggacaccgccttgagaaggcctctgaatggtacctacaagagttctacgaccgtaaggaaggtaagtctgtcaagttctggaatagccacttcaagtctctaacagagcttattggtggaggctatcaatcaggaaacctttacacgatattcggtagaagtggtcgaggaaagtctactgtaatgctagttgaagcattagaagcagctatgaatggggctaatgttctttattactgtttagaaatgcctaaatacgagttcacttcaagagcagtaagcttcttatcagctcgtaaagaggttaagaaaagccgtatcaatggctcagattatctagcaggatttaatatttcagacattacaaaggcttcatttgaggacttaaacgaagaacaagatttcgttgactttgttaccaacttaaatgatttcatagaaggttcattcactttaagagcagtagacgacgacgactttgttaaccgctctgttgcccagcttgaacgagatatagtagaaacaggagcagactttgttgtagtagacccaatgtattatatgcactatgagaagaacacttctaaaacagcaggcggagacgcggcagaaacttctaaagcattgagaagacttgcaggccgtacaaagtctgttattatcgctgtaacacaggcggaggaagactccaatgaaaaaggtggagacgaacgcgaactaaacattccaaaacgttccaatgttaagaagacaatggcgttacttgaagacgcttctgtagtattggcttttgatagctgtgatggaagatttgctttggagattgttaaaggccgttcggggcatgaaggagaaagtgtcgaaggtatcttcctaccagtaattggatatgtagaagaatcattattagaagaagtaggaagtgtgtttgatggaatcgaattttagggaggaatttacatgattatttggtctttatttgatagtggtaacggatgttactcccaagtttttagtaaaaaggaaggagtggaaaattatagtataggaatggataaggagaaaggtactagcaagaaccaccttaatttagatttgtcggatttgagtggatactttggtgaatccaagatgataaaaagtcttgagaatttacccaagcctgacgttataatagctagtccaccttgtgaatcatggtcagtagcgagcgcaatggctggaggtaatgcttgttggaatcaccttaaaggagacccattcactatacgaacagccaaggaatatgaaagtgttcaattcaaacatgagaactcgttttataatagaatgaacggcgaacttacagtatttaatctcattaaaattattaaacatttccaacctaaaatttatataattgagaatcccgcttatggaaagatatgggaatacattgataaggtattaggatttgagttggagtatgaaaatttaacatattacaataactacggatttgaaataaagaaacctactaaatttaaatcaaatattaatttgaacctaaaatcagaaaatgttaaagctgacaccaaatttagagaagcttctaggataggtggctcgtacaatgtacggtctaatatacctttatccttagttgaggaaatatacaaacgaatcaaggaggaagccaatgagttattacctatctcaaatgaacaaccttaaagaaaagattcgctacgagaagacttctgttaagcttatccgagaaagcattgagcgtatcggaaagcctacaggagaatattctctaggctacaccgacgcattgaagatggaattactaatccaccagaagatgttagaagacgctcaggaagagttattgaagcttgagaaagagcgtaataaataacaatagtgttcaaaggggcttgacaaaagcccttttttgtgttatactagtcaggtaggaaggagctaaacaatgaccgtaactaatgaactttggaaacctttgatattcaagggaatccactcagacatttacgaggttagttcagaaggtttagtaaaaaacaagttgactaataggttattaaagccccaagactctggctatttacatgttagaatacctcttgacggcaagtattataacgctagaatccatcgaattgtcgcagagaccttttgcgaaaggcctgtgggatgtaatgtggtaaatcacatcaacggcaataagaaggataatcgagcagccaatcttgaatggattactcaaagagataatgttatccactctataaggttacgtgaagaggaatctaaaaccctctctatgattgagaaaatggacaagcttctgggaaaactattatcgccagaggctaaaaaagagtttatggaggaatttgtaaatggctaaaggactaaaggcaattaacgaggcggctggaaagactctagtagacactatcgcagaggactttgaacgccaattaaataaatggggagcaactggttatacatacgatagcgacgtacatcaccaacttatgcgagactatcttaaaatagttgaccgaaacccttttgaagacttcccagaaaacgttccagtattccgttcaagtggaactggtaaatgcttacgtgaacagactttgttcgctattgataagcttgaaggaagcgaccgaaaagaccctcctaaaatgcagtctcaccaaagccgttgggtacagattggaaccaaggtaggggacatgattcaggaacaagtcttaatgatggagaaacattaccaacgctttactggagaggagtgccacttccgtttcgaacgtactgaagaaggcttcccacacttcgaggagttctcaacaaccttcaagaagtataagtcaggccgtatggagttcattacaggaggctctatggatggcattatgatttggactgacccagccactggagaagagtatcgggtaggccttgaggtcaagtctaaacaaactactccagcagctactagcaagttctctatgagacagcctaactcaaaacacgtgtggcaggttaagaactatgctatgttaaaagacttagacatgtatttaattgtctatgtaaactgcgctcacaagtcttgggaaatgactgaagaagactatgcgaagaatccagacttacaagtattcggtgtagatattaccgaacaagataagaaagacgtccgcaatcgtttcttcacagcgattgaacatgctcatgcaggaacgcttcctccattagagcttagtggatttactttcagcgactataaatatgccttggcaaacagccttacttataaggaattagaagagcttgagaagaaagctgtatctaagtttgaccagaaggccttagaagaaattaagaagattagaggagatgttaagtaatgaacgaaagcatttatgatggcattccagagttcgacctaaagcctgagatatatggagttgtaattaacttctattgtaacaaatgtcagaaacctatagtaatgcgtttggacgaaccatctttagtagctttggatggaatttaccaagagcgtttagcagatgattccaacgtaatcctagaagactgcgtgtcaggctatcgggtagcacttgacttacaggatgttgtgacatatgcctctaaaaagcttgacagagcggatatggacttctcttggagtacctttattgattgggtagacgttttcacagagactgaaggaggagattaatgtgcgctttattagtttcgatgtaagtagtgtttccacaggcgttgcggtgattgaccgtgagccttctggataccttaccttagtccatacagacatcattagcacaaaccctaaacacaacgtagggcgacgcttaaaagacttcgcagaagctgttcaaatccttcttgaaacattccgcccagactatgttgttaaggagcagacaatcgctcggatggccactcaacacatcttgctgaagtttgctggagtgcttgagatgatagcctctaacgaaggcttcccaaagatttacgaatactctcctacgactgtcaagaaggttgtgggaggccatgggcgctccacgaaagaagcagtgctgatgggcactacagaatacattaattggaacgagccaattgaccttgtaattgacgacattagcgacgctgtagcaatctgtctaactcacattggaaaagaatttgtattggttccgttaggtgaagttgagaaagctaaagaagaagctatgattgtagaggcggaggcttctaaatatcttgaggaggctaccgaatgaaacagcagttgagaattgccataacaggaacttctaggagcgggaaggatacctttgctcaagctatccagaaaaagttagttgaaatgggttttgcagaagctatgccgatagcctttgcagaccctttgaaacagctgtataaaagatacttcttctatatggaggacaaagagaagccaagagatgcctatgttaccattggaaatgctatgagagaggttgacgaaaacgtttggattaataaccttttaatacaggctgccaaagactgggacgaaggcttctccacactagttacggacgttcgtttcgagaacgaggccaaaacacttataaacgaatatggatttatcttggttaaggtggatgccgaccctcttattagattaggccgtgctgaagctttaggtgaaacacttgatttaaacaataagggagacattgaggtaggaatgattgagcctcacttaaccttcctaaataatggggagagcgacttaatgcaaatggacaaatacgctgaaataattattaatatggctcaggaggttgctaatggctaatctattaatctctgagaaatcatactacgaaaagttagtagaagcggaaacagcaaatgagttccgtatggttttaataagattgattaatagagttgttatgaaagttaaagtaccacttgaggttagagagcttttttgtgaagaggttttagagatgtattacgaacgctttggcgacgtagcattgccagatagcctagcaaacatcctctcaacatattatatgcaagacgatactagaggcgacttggaaggcactaacaagttcgctcgctgttctaaaatggagtatagctttgcttctgataaaaaggagaagcgaatccgtactgaggacttatataaagaatctccaatcaacttagaagtgttggaaggaaatggttattcacgaaataatattgcctcatcattggatatggagcgagcatctcttagaactgacttgttaaaggcaatggcaaaagccgatttaactgagatggagaagaaagtccttgagctaaatcttatctacgattacactatgcgtgagattgaagtgcttccagatatgccttcaagaagcaccttgagtagacaccttacctccgctcgcaaaaagattatgcaacaaatttaaaatactttcaaaaaggggcttgacgaagcctcttttttgtgctatattatattcatagacaaagataactaataaaactacttggaggaatatataaatgcctagaacaaataataaaatcagccgtaagaaagcgttagaagtgtatttagaagggagtaatccattagcggctatctcagagctaattgaagagcatacttggacagttggtttcgacatggagtcagcaaccttttataaagagcgtacaagcaatccatatgacacctgtaagaatcctcggtgcaagctttgtaaacagattagagaacacgctgaacgaatccctgcttactctttaggtaagactttagctaagcctttcgaggaactttctttagggcactttggtaagctagctgcgaatgatgttgctaaagctgatatgcctaagctattaaaagtaactatgaaagatgttaataaacacattgacatgcaggtagaaaagattggattagacaattccatcaaccttctaaaagactatgagttatctgaacaagttatccaacagcttttaggaattggtgtttatgatatgcgacaatttaagaaacgcatgtacgaaggcaagaagcaacgtattgccgaagctaagaaaggtgagtgggcttaatgaagaaatatataaagctaggagcagccgttttgattttgcttattggagtagctgtgtggttaattgaatttatactgccttttgttttactaaaatgggcattgtagaaaggattgtggaacatggataattcactaagcgtatatgaggtgcaaatcctcaacactaacacaggctgctttgacgttttcttagtcacagcaataagcatcacttttgcatatattaacttttcggagacttttgaagaggatttccacgatgatgggaatgttaaagtaatcaaattggaggagttttagaatgaatatgattttaattttgttaggcgttgtttttttggatgcttcttacttgccttagaaaggagaggttttaatatggaacttttagaaagaatcacatacagcttatttatagctttggtagtagttttagcagtaggagcattttttgtaggtgtttattggctatccgtttggactagtggattaggagaccttggaaccttcgttgcagtaggtattgtaatgttcgtttttacagctttagcggtgtttcttggatttgattaaggaggaattttaaatgaaattgaaagacttattaaaggtagtagacccaatgcaggacatctctttggagattgctgaattaacggctccagaaggtatttatgctaaagacattccagaaatgcgtccaatggccttggaaatggatattgtagatgttcacacagcttggtataatacagaagatagcattgaaacaactttgggagtcgttgtaaaaggaggtaaaaagtaatgcgtaaactatttgaagagaactttacaattgacgaaatgtcagatatgtggtatggttgggataatgaaggccttttatatggctgggaaaatggcgaagcaggagaagtttatgcaatacttgaggaaaatggatataacgtggactccattaaaattatgtatggagcgttcataacacttggggaattgattggagcgatttagacatgcttattagattaaatgaagcagacaattatgaagaatacaaggaatatattgagctttctgaaacatataatggaaaagttcacctagagctttatatagaagaatctgaaacagataattatattagtgtaaaagaagcttacttagacgaagaatctattgacaagcttatcaaagcattacagagctttaagaaaggggaaatctaaatgtctttaggaatgtttgacaaagagcttttagcagctctagcagctttacgatgggttgtagaagaccctgaaatcaaagagcgtcacgatgaaattttaaacactgcgtacatggaaaacgcctacgagaaaggcgaatcattccccaatgaaaagtttgtggagtggcatttcattaatgccttaacaacgcttgagatagaggcggctgcacgagaccttattattgatgatgaatcctacgatgaagaagacgatatggactgggcaagcgacacctattcatgtggctgttgcacatgctgtggatgcacctgtgactactatatgtgggaagatgatggaagctttgacgaagacgatttggaggactaattgatggctaattactatgtgttagaaagacttgacgacggctctggcaaactccatcaagtaaagcagtataaaagcttagataatgctattaaatatgctaaagaaatgagcacctttaaaaagacttaccaagtggctggccaattcgatatgaacaggcttgctaacactgggatactagtttagaaagttgtacgagaggccttgacaaaggtctctttttatgttatcataaggtatcgaataaacaaggaggaagtttatatgaagatttcagttaacttacctgatgataaaaaagctaaggaagcaattaagaaggttaaggggaagaaacctctattaactatggaagaggcgtgggcaaagattctatctatgaagaactccgcaaaggatttagaacgccttaagcaagttaaggaatacctcgaagaaggtaaggtaagccgtgaggaagacaagttaaacaagaacttctcaaaggccgaggctctacgtatttatcaaaaggttcaagaaatggaacgagaagctaagtttgacgaaatccgtaagaaagagtgggagaaattccctatcataaacaatattgtagagcttgctagttggattgacaacgctcttgaatgtgataatgaatacttggcgatggactttgaaacagtcggtgacaacggcggtactgacatatatagggaagagatttcaggattctctttaacttaccgttacaaaggcgaaatcattaatggttatgtgcctatgcgacaccgagaagaagacggctctcctagtcctttaaatatcgctaatgttaagtgggctgaggaaggtattaagagagtctttgagtcagataaggcaactgtatggcataatgcaaccttcgatatggggcttgctaaagcttctttaggaatcgctcccagaacgcttgtccacgataccttaatcttaatgcacctacttgacgaagaccttccaagttatcagttgaaagttttagcaacacgcttcttgaatattccgtcagatacctttgaagaaatgttcggaaagaatgcaaagttcgctgacattgctgttgagattgctcgttattatgccggtaaggatacgtatgtgggatttcttttatttgaatggcagttgaacatccttaataagccttctttcgctaagattaaaaaggtatatgagcggattgagcgaccttgtatcatggccacttttgaaatggagtcggaaggcttccacattaacatggaagaggttgaggtacaacgtaaggaaagcgaggcagagttagaagagatttctgcacgccttcaagcacgctttggcgacgttaacttcagctctccatcacagctgttaaaactgctttacgtagacaatgattggagtaagtatgttacagctgaccataaatccattctaagaggtcacgtaggttatgatgaacatggtataagcaataacaaattgtttgcattaatgcctaatggaagtgttatcctagaccctatggtaaatgctgaaggaaaggtcgttccaaagaatgacagaaacaagttacaagctaatgctaaggctatgaaaaagattgccaaagctgttgacgaggttcaagacatccttgactacaaggacttgacaaagcatttgacagctttcgtaaacaagattgacaccttcattgcgcctgacggaaagcttcatggacagtttaatcaattcggtactgttacaggccgtttcagcgcctctaatccaaacttacaacaacaacctaagaaagctcgtaagatgttcgaggctccagaaggctcattaatccttggagcagatttttcgcaacaggagcctaggctactagctcattcaagtggatgtcaagaacttattaacatctataacgaaggccgtgacttgtattctgaaatggcttcagcaatctttaacaagcctatcgaagagtgtttggatggctcaatttaccgtaagaacactaaaatgattgtccttgctatcatgtatggaatgggtgcctacagccttgctgacatccttcgtatcgacgctcaggaagctcagaaaatgatcgacgacttcttcgtagtataccctgaagtagaaacttggattgaaggcaataagaaaacagttgttaagcaacgctatgttgaaacgctgtttggaatgcgtcgcagattcaagcatgaaaactttgacatccttaaaaagaattggaactccttagatgaaaatgataagaagctccgctcagcagcagcaagagccttgcgacaagctactaacgctttaatccaaggcggagcggcctctcagactaagcttgtaatgaatgcagctagaatccgtttgaaagagttgtcagaggctcgtggagaacctaactcatttggattccttgctcaagtgcacgacgagctgttatttaaagttcctgaagacgtaacagaagctgaggtagacgctattgaagacgttatgattaacactgtgaaactagtagttccaagtaagactgatattgagattggtaaaaactggggtaaaatgactgctagaaaagattggtttaaataaatttcagaaaggggcttgacaagcctctttttgtatgctattattagtccataaagaagagggaggaatcaacatggtattgcgagtaggggataaagttactattaaagaggatttaaaatcttacgaaagttttggtaaaggagttacttttgttccagaaatgagtaagtacctaggcaaggaggctaaagtagtcacggttgcttcacatgatggattagaggttagcctagacattgacaacgagtgctttttgtggcatgaggaaatgcttattaaggatgaggttaagccttcagaactaactttaggaatgcttttgagtaagctaactgaagacattagtgtaaacattgatttaagttttgaagacgcatctaccagaatcgtgtcggaaaactattattcatggcagctagagccttattacagtcgagttgttaaatggtttgcaccagactttgataatggagagttagcaatacttttggaaggagagttttaatatgaagcttaaagtaggagataaagtaactgttaggaaagacttgaaaacaggtcggtatggcaatgatttagtttttccagaaatgcttgattgtaaaggagttacaactagtattaaaaaaatccattctaatggtgccatagaaataatcggaagctcatggtattggactcctgaaatgtttgaggaaactccttctgaaatcactttagaaattggctatcgacactctttagacactattgttcagacatcctctcagacagttatcgatgatgattacgcttatgagaatgcctgtgaacagtttttagaagagtatatgaaggattacaatagtgtagaaaatatccacatctgctttgtgagggaggccgtcgaaaatgcctaagaaatattacctgaaggccatttcaatgtatatattatatactttcatagcagccgtggttatcggcggaaccttcctgttagtaaatgcttttgtatgggtaggtacattcatctacggaagatttggggacactgttggaacaattcttttactctccacagctggactgatagctttatgtacagccctttactatgaagctagaaaagagtttcgagaagacgctttgagagtccgtatccaagaccctgaagatggtattgatacacagcgctttgatattgtttacatgcttccagaagacgctatccgacaagcctcgacaattgttggaattattccagaagacatacaacacattgagtccaaagagcttcggaaaaaggttatccacgccatcatgaagcattcaccagtagagtatggatttacgcttatcactaagtatgacccagaccttgactatatgcttcgtgaaatctgggacttaaactacactttcaagactagaagaaagcttatggaaaagcttagagattgtggagtaggccttgaaggagaatttttgaagtatcttgttgactaattaattaaagtgtgttatagtagttttgtagaagacattaaggaggagattttaaatgaaatacactaagaaagaccttaaagaaggcatgaaattacgtgttattgacggagctgactttgatttttgggaagaaggctcagtacacgaagtaattaagctttttggaaagcttgttattgatggtgacgacgaacttggaagaggaattagaaacagtgatgacatcctaaattacctaaatttagaatatcctgtaaaaatggaagtagtggaggaaggcattatgaaaagctctggggaacgcttaactaaatccaatattaaagaaggcttgaaagtagtgtgtgttaaaaacgcttatgagccgtatcgatactttactgttggaaaagaatatgaagttgtaatggataactgtggtgacttaggcattgaggatgatgatggtgaaggatttatttgggataatgcaatctttaatgaagaccagtttgtcttcgagcttttggaagaaccttcgaaaaaagctgctttagaagctttagatagcaaaattagagagcttaacaatcatcagcaagagcttttccaaaagcgtgacagaatcaatgagcaagctatccaactaggcagcaaagcacgccgtttagaagaggctaaagcactcattgagaaatacatttaggaggcagtcttatgaaagattttctagtagtcgttatgattggcaataagatgcttaactttgctacttctacagaagccatgacaatggagtttgtggaaagccttaaaaaagagctttcagaacagcttagcgaagacttaacacctgctgatattacagttttaaatatcattccaatggataagaaacaaagtagccttattacaggcatttaggaggagtttacacatgttaacgacagattttattgaggcggtagagaagattgggctagaggtagataatagctactcttcggtgctttacgtagaaagtcacgatggcgttgttgtaagtattaacaaaggctgttctgaagcttttacatggtgtgaaggaagagacattcatgtgggaggccttttaaatcttatcccgcttgtggaagagtacgccaacacgcctatcgaagagcgtgagaaaaaggtttccgagaagctagattatgagactattaaagagtatattttcgaaaacatgtctgaaaatgatttagcaagacttttgtcagaggcgcttaaacacagcggcgaaacaaatacctcatatataattactgacagaggtgttgcggttagtcctaagttcacatttttagattaaatactttcaaaaaggggcttgacaaggcctctttttcatgttatagtaagactatagaaaagacataggaggacattatggaagacttattcaaatttgcgtgcacgcttgtgttaatgactgttctaatctctgggtatgtggccattcaattagttattatagcagtggcaggaacctttttgccaacatgggcgtttgtaattgttttaggatggcttgtatacactaattacagagtattgttgaaaggtggagaatactaatggatacagtttaccaagacactcaagacatctatttgaaagctttttggatttgcattgatagagctagaaatagggcaggagtcacttggtcttatttacagcacggagataccactagagcaattaatgggacagctaatccatctatcaaaaagactttgcagcttatggacaagcttgacttagatattgtagactttcaattggacgttgcagaaacttatgaaagacttttggaaggaggactttattaatggaatttaacgaggaagaattattctatttactagctcttttaaaaggcgatataaatgaacttaaggaagcatttgacatgatcaaggcatttggagcaggtggaaatacccttcaccatattaatgaatacatccttttaaaccttaaaataagagcaagcctattattaaagttagaaaagattcaggaggactttgcgaatgctaattaaaaaggaaaagaaggcctacctattcaccatttatgaattgcattcctacccctttgtgataggcgtcgatgcttactccgattcagtggctatagaacgtttctacaagatttggagaaagcattatcctaagcattataaaaagcataaggggttctccgttaaaaagtttgatatttagtattgacaaatccaccgaaaggtgttaagatagacttatcaaaggttaaggaggtaattactatcatacccgaaggaagttatttaaaagattcgtcaggcctcaaccattactttatcgaaggccatatcataggcgttaggacaggagtaagaggctatcagacagttgtttgggataaggaattggacaaaatgtatgaacaaaactttcacgaacagtctctcatgaacgatgttaaaatgtctaagaaagaaattgaagaatttaacaaaaagtattatgaatggagttggggacaagatgtctaaacatttctatgcaaacactagcccagacatggctgtaaactatccaaaaggatggacaagctttttccataatattgtaggctatgacgagcctttgtcagaagatgtcttaacggcttatcagcttaaagaaatcactgatttaggagagcttccagaacaccataagaaagtatttgaaacgctttcagcaatggagtatagcaccgtggagcaggctctaaaaacatttaaaacaaactatgtggagggaatttaatatgaattttgaagaactaattacacaggtagaagaatggtcagctaacaaaggattagacaaaactgctcctgagaaacaattcttaaaagttattgaagaggtgggagaagtagcggcggctatggctcgtaacgaccgagaagaacttgtagatggccttggagatacttttgtaacattaattatcctttgtcaacagcttggagtagagcctcacgaagctttggatactgcttatggtgttatttctaagcgtacaggaaagatgattgacggagtattcgttaaaagcgaagacttgtagaacagttaaataaactactatcaacagcctttccgaagagattcacggaggggctgttttatagttttcaaaaaggcaggggcgaaatttttaaaaaattttttctaaactgagaatttttaaaaagatttttccaaaaatttaaaaaaatttttcttaaaagtttttcctaaaagcgctactggattccattattagcgcttattttacatatttattgaaatagcgtgtcgcacaggcgcattctgagcgcatttcgcactgctttctgcacaactatccacatatttgttgtgtggcgccttatatatgctgctatacatgcctttccactgcttttgataaacattattggattaggctgctatatacacactatcatgtgcctttactatagcctatcccctatgctttatagttagttttcctataggctactttaggttatactactataccttactctactatactccccccccccagtttccacgagaagtgccctataaggggctttttaagcatttttacgcctttttaaaggcttttcttgctctttttacaagcctttttgcacattctttcttaaaatccatcaaaacacctttataatagctttttcagattgtttttaaaagtttctactatataatacgccgtttttatgtaaaagctgccaaaaagaatttaaaaaaagttgtattttattgttgacaggcatttttgaaagtgatatattaagagtgtagcaacgatctactaaaataaattataagaaagaggttttataaaatgatgaaattaatcgaattagacaatgggcggaagcaagttttttacaacaatgttttaatgcaatacgaaagacgtggcagcgatatatatggcaatcccttatatcgagcatatccaattaacttttcttttaaacgtttaaaaagcgtatatagaaattacgaaaaaagttacggagaggaatcctactaccttatccaaagctataacattttagcagatattcaaaacattgctaacgaggtaaacgcaaaaaacacttttccagactttgaccaaactttattgaaagactatcgggaggttttggcgtatgtctaataaaactattgaaaaattatataatagttacatgagtacttgtaaagagttccgagaaacggtaacatttactcaatatgtgaaaggggaatattagaaaatggcgttaacaatgtttgaaaaagagagtttgcaaaaagaaaatgcacgacttaaaagagagctagccactttaaaggctagccaaaaactaggcggaggacttgacgaaaaagaattacaaaaggcattaaatagttgccaaaggattttcaaaactttaaataggggcaaaagaagccttgttctaagtaaatccgccatggaggctagtgtggaatattcgggaagtggtcgctcaaaaacttataaagattgttccaggacagcaataagagaagcagaaaaaagcgcatgggagattatgagcctagaaaatgactttagaaatattcaccacttcttaaaacatggtacaatgaaagcggaggaaaaagacaatgcttaatattattgtaacagtaatttcaacggtggttattttaaaggcattggaatgggcatataaaaagctttcgaaaagacttgacaagtctattaagttttcaagaaagaaatctaaaaagcgctttattattgcacgagtgacggaggaacaagcttatactttgcgattattaaaagccatttctaaagatgatgaagctgtttgcgaagctacaaacaaagctttgctggaatacggttacgaggaggcgggcgggcattcttatgagaaagctcgggaaaagttttcatcattacctgacgtaaaaaacggcataccgttggacgatctagaaagtgatgaagaagcggacgtgcaacctttttagaaaagtttattaaaatgcttgcaatccacttggtgatttgctattataaatgtagttagaaaggaggtaacaagaaaatgagtaaagctttttacatggcactaggcggaatgttgacaagctttttcctagggcatggcacagtagcgtattttatggcaggcgctgcagcgttaacaatagccgtccaaacaatttacaaaaaagattagtcaaaagtgttgacaatggttttcgcaaatgctataataaagaaaattaagaaaggaagtaatgaaatgacacaaaaaatctacgttgacaccattctttacaatccatcaattattgtttatgaatggaataagaaaaacatggaagtatctttctataataagcttaaggagagagaagaaaccaaagaaattaaggcagaccgtgatggcgatttatatttttatgcaaacggtcaaacattctacaaaaggcatttacatgtaattgaatataaagaaataaacttgtaaaaagttattgacaagcggttaaaaaagtagtaaaatatatttataagataacaagtaataaatactcattcgataaggttagggcaatcctttaaaaaagcctaaaataaaataacagaaaaggcggtttttaacatgacaaaaattacaaaagaaattactttagaagaaattaataatgcagagtatacaggttatcttgtgttagataatgatagcattattgtaagggtggaacgtaacaaggtaacaaaagaaacatactgctatgtttatgcagacagcgacagcgacgactttacagcaaaatttaaaatagagtagttaaaaaagtttacaaaaagctattgacaaaaaacaaaacatagtgtattatagacttataagataaagagaggaagttatagacatgacaaaagaaagcaatgtatttttagacgaaaaaggattttttgaggaaattatagaaactttggaaaatggctacaccggttattattgcgacctgcacagtgaaatttttaactggggcgtaaatgctgacattaaagaattagaagaatacggcgtttttaacgcaatcggagaaattcaggaatatgaagaggaacacttctgcgcaattctaacagaccttgggaacgcttcggcagttgctgatatgctttactatattaaaggtaacgagtttttatttgatagaatagattttaatgatgttttagcagacgttgcagaggggctaaaattagataaagacttatggggcgaggaagccaccgaggaagtgaacaaggctattattaaatgcttatcggaggaatttaagaatgtttattgttaaaatttataaagaaaaatcagatcgtcagttaaagcttttccacaactccaaagaagctgaaaactatgttttgagaaagctcaagggaactgacaagaaaactattgaagtttttgaatgggataacatagcgttagaattaagctactggaatcacttcacacggcagcaagaaagttatttactagaatattgaaaaagtttatgaaaaggggttgtaaaaagcccctttctatgatattattaaaccatcaagaaaagagaggaggtaacaacaaaatgacaacagcattaacaatcgctttaattagtttggtagcaactttggcagtaagtattcacgaaattaatcgttaaaaagttttagaaaagtattgacaaaagcagttacaaatgctataataaaggtatagtaaaacacaaataaaaaattatatgaaagaggttttcaaccatgacaaaaacatttaaaaacattatcgcaactttaacaatcctagtaatcgctttggcagcagctacaggaatcgcaacatttaaggcagtagaaaacgcaaatgataaagctatccttgccgaacgtgtggaagctttggaaaaactttccgacaggcaagaatatgatattgcagtaaagtctaatgtaatcggcgcttacctaatcaatcatgaggaagaagcacaaaaggaatataccgaagcttataaagcacacaagccaacgcttcttaaaaactatagagaggcacacaaataatttaaaacatttttttcaaacttaataaacaggaataaggaaagcttttgggataacttctcgagagcttttcttttttgtgttttcaaaaagtctgatcagaaaaggcgccaccttaatttatggaatgcttttctaatccatctaacctaggcatttcttacaacgtatataaagctttctaatggttaactacccaacttctttcttgaaacgttacgagaagccctctctcacacacataataaagcagtaggcaaaggaatatgcaaagagtattcttaaatgctgttattaatccaccaaaaaggcaaggaaagaagcggaaatgtgagaaagaaatggtaaaagcctattaatcctagggtatttttaaaggaaatgagagggcgcctaacaatattattttaaagctttttctagggcgttgttatgggggtttttctgaagggtatctagagggcgtgaaggggcgtaatctcaaggcgaatctaagaagcctaatcgaaagctttgcggtggatttgtttttattaaaggaaataagaaggctttgcggaatgctggtgtggtgggctttggggagaggtggctcgagagggtgtccgatagctttcaccacaggttaaca

SEQ ID NO: 15 - DNA, 168119 bp, synthetic construct
  misc_feature 1..168119: note = E2_colE7
  source 1..168119: mol_type = other DNA
aattttccttattaggccgcaagggccttcatagttttagcgatttgggaaacttcatcatcacttaaagagttgcgatatccgatgaagtcggaaacaatacggaatttcttggtaaactcagcaaccattttatcactgttttttgaagcattatttgataatacatcaaaaagattagttactgtccagatatcatgaccgatggtatcttttccaccattaaaatatacaccgcgcaatgaactaactatattagcgagtcgtgtatattcttcagaaacttcatctgtactgaagtacttcatcataaaatctagttcaggatacttgataattttatcaatatatcgttgagctgaacttgaataacctacgtacttatcataatctacatcatcaaaagcatctacatataaatcacgcagagtttcaaaaatacattggcactgaccgagttcttttacctttttctgcaaaagcggacgaataacataaaactcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagcaaatcaatctgcgattctacttctggattaataaacagaagacgctcattatgatgaatattcaaagtgttattaaattcactatcatctaacgctcgtgctaatccacgaacaatattaacacgatttttaatattatcaataacgatattaatttttgttgtattaataccaaacagacgataacttgatgcaacggctgaagtttcatgactttgcttaatgcgcttcagtcgaggatcaagatttacttcatacacaactcctgcattacataacttattgtcaggttcaaacatgctctgcatctttttatatgacagatttttagtcgtgaatttgactgaattactaatcatataatctcgagcagaatatcccatcttcatcaattcacgatatgtgtgacgaggagatgtagattctttaaatcgttttacatcttcattaaatgctttctcactgagttctttaactcgttcaataatatttttacgagtacgatcatctagtgaaagagcttcgcgtgatggagcaatatcaagcgaacccattggaaacttaatgtaattcacttcattacgaatgcttagccagttacggtctttaataacaccatcgataggataaacaataccgccatagatagcatataatccaccacgatcaggccagtatctttctggatttatgccgtaataatcatcaaaatccggaaaataatcaatttcgcggtcaagaccattaatgatagccaaatctttgaatggtcgcatgatataagaaacttcataagcaaagtttctaaagtctttttcttcaactggaactacgatttcaataccagttttatcatctggacccatttcttttacgaatgtaggtttaatctgtgggccatcaccatccatgtaagctacataaccacgaatttcacctttatgatacgaagtaatactaaacgtatcagtataactaaacggagatttagaacctaaaccaaatccgccaataaagtcattagattcagctttagatgaactgaagtatgaattatacaacccaggagaattatcatcaccctgaatatcaaaatcactcatacccggaccaaaatctcgacaaacaaatcgtgggtctaaacgtccaggaacttgaatgataaatttttcaggatttccattgagagcatgggcatcaatcatgttggtaatcaattcacggactactgcgcgaatcttgtttgtgtacaaatcagatgatagaattttaaatactttaggagatgctgtgatgctaaatgcttttgatttagaaccattaccaagaattgtttctttttcagtggtgataatcataatttcctcattaattcatattgcgtttaataacttcagcaacttctagtagttcatctttagttgcggtgtcggattgaattttatctctaatatccttaaagcggtttttaaactcttcagcttctcctatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactgggttttgaatcatctcacgatattcagatttttccaaagagccaagtcctttaatataacggatgctatgtttaggtagagcatctttggcactctcatattcagcgactgtataaaaccattcttgttttttaccgacctgagcgatgattacaggagttttgacgaagcgaattcttccttgctcaaacagttctggccaattactaaaaaatccaagcagagaaggataaatgcttcctagaccatcatggtcagcatcagtcataatagcaatattatgataattcaagttttcagctttttcaccgagaactaatccagtgattgcgcaaatatcaaacagttctttgtttttaagcatgtcagcatatgacataccccaactgttgagaactttaccacgtaatggataaccaccatgaagttctttattacgaacatcaataagatatccgatagcagaatcaccctcagtcaagaacaatgtagtatcagcatctttaccacaaagattcgctttgatatgtttatgaaccttagctttagatgcctttttagctgctttagtttctgctgctttttctgccgccaatttacgagccaaagcagcttcaataattggcatcagaattgcttcattattcaaaatagcacgtgaaatctttttagcatcaagctgaatatgactacggatttcaccaaatggagaagtcaaacgctctttagtttgagaatcaaatcgcatgtttttcatatcacgaacaaacataacgattgtcaaacattctttaacgcgtgctttagtcacatcaattttgaacttacgtttgatttgtggaataaggtcttcacaaatatcatccataacacagtcaatgtgatggccaccattcttagtatgaatgttattaacgtatgttaattgacgaaaaccatccggtgaacgaccaactgcaatagaacagttttcttgttcttgaacgatagcatgctcatcatattggcgtgcatatttcttaaaattgccctgaacctttttaccattaaaggtaaattgaatatcaggataaacaacagcaagtgtctggagacgatctaatgtaatgtcaagataaacttgagataattcattagtttcaaatgacataaaatctggaatgaaagtaacacgagttcctttccattttccaggaatagtttcccatgatttattttccatgccatttgaacaacgaactacaatattattttgaccatcgccagtttcaccgacaaacatcacagaaaaaatgttagttaaactagaaccaacaccattcataccaccggtgacgcgttctttatcatcaccaaagttaccacctgcttttggaatagtccacgcagcaactggaccaggaatttcttcaccagtaggtgttttaaccatcgcttgtggaataccgcgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacgaatagttgaatccttaaagaacagcccagaacatactgttccttctactttctgcccagtaggtccaatagcacgaaatccagtatgttggaaatcattttcagaacaaccgaaccagttatatccagtgatttcaatattagtaaaaccgcttgaagacaaaactttggttgcattatcagcatcagtacatcctactaaagacactgctaatactaatgccgcgatagaacgattaatatatttcataattttcacttaaatttaatggcttgaagaagactaataattctcaagcgacttccttcatctttaactgtaaaagaaagagggtcaccagatttcatagtgatagtgcattcaaaagcaaaaccttcgggaacttcttcgaagaagtcaaattcttcatcataaattagaacattactctgaaaactgtgaagaatttttccgtcatttccagatgctgtactaatcattgtaacattattacctttcatatcttcaacgataaattcgcttgtagatattacagcattaatagaaccattcctataaatagcagaaaatagatatttcttttcttcaccttcgcgaatgcgatatttcttaccgattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccatgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtaccatcttcagtgatttcacgaaatacaccgtaaattggttgtttatccccaaccttttcatacacataaaccgaagtcaagtgagtaaacttgatagtgtgttccttttgaactactaccaaatctggatcgaataatacatcttcaaattcatcattagtgcaattctgaacaattttacgtttcatcataatttcctcattaattattagaagagtatcagcgcacctttaacgaattatccattttattctccaagttgttttctgtatcagtagttgatattgatatagtaccataatcaactactgatgtatatagttttatgaaaaaattttaaactttatgcatagagagcattgctgtagtgtttaatccaactttcaggaatgactttatatgttcctaaaaataccacgttgtacaacttaacgccatcttctacccattgatcggtaatgtatccacacatagcgcgagtataaacagcctttccatcatctttgataaatttaaattcacaaggagcaatgaacttgatagcttgaccgagtttccacttaaagtctacacctacatgcgaagtatcaatcgtttcaattcctttagcaggaacagctttcaaaaacgcaggctcaagaaatttccatcgaacataaccaaactggggcttagacattccatctttagcaatgatacgtacttttacttcagaatcttcatctttaacaccgtgtttaagctgaatgcttacaacttcgaccaattttcctgctgctttagaacgggatttatcagatacacgagcaatttcaccaatattaataatcatagttatctctcacttgttaaaaagattttatactccacaggaccattatactctggtcccaagagtttgtaaactattaattcaaaatagctaccaccgcactacgaggtactacactaaaatctcctgcatggacaacgttcagaagctcaacaccatcttcaatccactggtctgttacccaaccacagataggattatcaaaaggacgacggatagacacagcagcacacaacaggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcatagtaggttccttaatttccagtggtttaacagggcatacataagtacttacaacgtcaaaatcaatcagtttagctgccggattcggtgtgtattcaggattataattaaatttcataattatctcatttcaataaaatctacaagttcagcatgggatttacggaacattacttgatgcccgccaacgataacttggtcatctggtacttcgtatacagcaagataaaatcctttcgaagctaattcttcacgctcttctcgtgtgaaccatctcatcatatcatattcgctagcgaaagcaaaatgataaagagctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacgtgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgatggagcatcttcaagacccatagcatatcgcaaagcgtacttcatcatcaggatgtctttcgcgcagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatgtgtcaagttcattctcagaaacaccattaagacgttgaatatcacgaatgagatcgactaaaattggaaaatcaaacgacattccacggcaccagccttgagatttccaaggatcgatattatgtgcattgatgtaatcattaaatttcgcaataccgtcgatagtgcttacatcttcatcggacggtgcaatattttttcgagcttcaggagactgatttttccaccattcgatagtgcttttagtaaaaagacgatgtcctttttggctttttaaatcaaatttgattttaatgccgcgtgaaactaattcatcaaatgtttcaactacttctgggttagggtcaaaagcaattacagctaaatcaataacagctgctttttcaccacttcccattgtttcaaaatctataataaaatcaaacattaaattttcctcgctaaatcgcgaatttggcctacagtatagtcttgaatataaactttattaataggttcatcaataaattttgccatagattcaatatctttttgcatctcttcaagactgtatattatctttaaagctttttcgcgaatagtaatattttcaggaccagaatttttctcaatgacagctttaacatttgtcataagagatttaaactgacaccaacttaattcaatcattaataatcgccttataaagatagctaatttcacctaaaacataatcactgattgtgacagttttcacttcaccacaaaagaattctaacgcaattaaatctcgttcaatttcttctaattgaagcatcaacttactagattcaatttttacagtttcacgatttttactataagctatttcataaatttcgctcactttatcttgaagcagataaaactggtctttagttatttccacgaatagcttcctcaaatttaattagtaatttacagacactttcatctagtgtaattaccgtatctgtattactgtgatatgattgtttttcaattcgtttaattgctaatatagtatcacttataagataaagcttatgaaggagctcagctcctgttaccataacatcgagattatcttgcttattagtatgcttccttatacaatctattagacgatttaaatattttgaattgatgttaatcatatatcctcacacataaaatacgtcataacgaccacgggtaacaccaacataaagaagttgttgagccaattcagcatctgcataatgaatacaaggtgtatagatgaaagcacggtctacagacataccctgcgctttatggaatgttgatgcaggaagtgctttcactttactaaactgtgatttagcatcccaaaaatcactccatggagcttttccacccttattccagtttttataagtttctgctgttttacctaaaaataggttaaacttatatagctcttcatcagatgaaattattttaatcttttcacgataatattcatcatcgccgtaagtttctactgttaaatcccaatgacgaattaagtattctccagaaacaccacgagctttaacaaatgttgatgtatactctgcttctataatacgaactaattgtccgttattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagagatttgacgattgaaaaataatttaccataaaatcgcgtaaagcggtatcaccagtaaatccacgtactccatgcccgtcaacaactttatcataaatccacttaccgttacgaacgtcagtagctacatcaataataggagcattactgcgtttaacttcagtgagttcacactgataaaaatctttatgtgtaaagaatggactgatataagcagtattttctcctggatcaacaggtctaatttgcttattatcacctattccaattatagtacaccaaggtggaatagttgaaagcagaattttaaatagctttctatcatacattgacgcttcgtcgcagattaataccctgcatttagctaaatctggtacttccttctgttcaaaaagaacgttttcttcatacgtaactgggttaattttaagaatactgtgaatagtactcgcttctttccccgacagttttgaaagaatctttttagctgcatgtgtaggagctgctaaaataataccagtttcacccgtagatattaaagcttcaatgatgaacttagtaagagtagtcttaccagtaccagcaggtccattaatagttacatgatgtttcttttctttaatagccctcataacgatgttaaaggcatttttctggccttctgtcaaatcatcaaatgtcatcggaaagtccctgcaattggaatactaacaatacgcccagtatctagaattcgttgatataatctttgtgtatctacatcaggcttaacatgtttaacttctattttattaaaccaaaacttgcgtggagtctcaactagtcttggaattcccatacctaaagctagtttatattggtctttgagagtagtaaaaactctatcagcaatctctctttcaaaaaacacagcaggacgatgttcatcaagtggaactggcgccgtaaatccgtctttgtctcggtaaactatcgcatatacataaaccatattatcctcggataagtttaaaaattgaacaatttagcgggtatcctcttttcagtttaagtttatcaataaaagacaagttttgataccgctctacaccttgaataattttatcacacatatcatattgcatttctgcttctgacaactttttcacaattttccaatccgagcctttaagaagaacgttcagtttaacaacttcagcgccttctgctatgcgagaaccatcaatacgagctttaagtgctataattcttagcttaatgtcagaggtctgttttgatttagaaagctgagaaatgtgttcaattcgattttcacgctttttctgtatagctttaatttgattataagtctttttgattttagcccatttcttttcatctaaatttagtttatgaacttttttcgcagatgaacgaccaattcgcaaagcaaataaatcccgtttttcaatcaactcttctaaagtataatcagaacgaaatgtattatactttttctttactgcaataacattccctttaatgtatccaatgttattatcaaaacgttctaatgataatttctctccttcaatacgattatcaaaaggttctcctgaataggcacaaactttttgatctaaaatattcttaatgtaattgaagtctaagttaaaatctttagaacgtctttttgcagatgcctgagtgtgctctaaacgacgtttaattttacgaatttgattattagacagtttcatatttttctcacatcttacggacgattgactactatactataacatttttaccttggcttgtaaacaattttatgaaaaatgcttcaaaaatttcatggtataatgaatctaagtccttccattatagattaaatccttcaaaatcaagagtatagatagtgtatgttgaatactttttatactcatatctatctgcaattctaaatacacttccagctggtatcattacttcttgttcatctgaaactaattccatattacgataacgatggctatccggaaacttaaagtttggattgtattctttacagcgcagagcttttatagcatactcctggaaattgaataccataggagctttgaattcaaaaataacttgtgtgttatactctaaaccggaagcaaaatgtagagctatatttttatcatatgaagctgatacgactttatcaaatgtaataatatcaattccttgatttaatacttgtttagtctcagctggaacacctctccaaagaggtttatcgtttggttccaaacgagatttgattatttcatttaaccaagtatggtcatctggtttattagtaatacaatgaattaaaagttcaatttcagataaattaaatccttcagaaagtaattcttcacgaatagaagcacgcaccgatgcatccattgatttgattttaaaatcttttaattgcattgctgaatatttcattcaactacctcaatatcatacactttaaatgttccaaatgaatcgtgtaatttttcttttgaaatagaagttattttatactttccaattggaatcatccattcttgttcacgtacaatcatcattaagttatcagtacgctctgaatctaatccatcagtatcttcatacgtgtacttaaactcagtattaggagaagaaagtataatatcgctgatatggtcagaataattaaaagctttattagtttttaagcgaagtattattttagtaaaatattcagcgtaagaaaaagaacatgctgtgaacaaactagtagtaaatgaatctactctattcgttgaaaacacttctccaacttgtaaatctttaataagttcttctgttgattttgatataccacgatataactgataaggagatttagttaaatgctttttaatgattttattcaactgcctatgaagagcttcattctttttggcttccatacattgccaaagaactgactgctcaaagtcagtaaatttttcacagacctttttatacatatcatattgaaaatcaacgctttcagcttttatagataactgttcaacatctgcaagattaataatcatgatagcctccgtatacttcagaagctatcatatcatcgttagaaaggaaagtaaacaactttttgaattattttgcccaaggagcccaaggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatactaattcctagcgataaaaaccaaattgacgattagcttcaataatctttctttcttcttcggacattctccagcgtagtccaacatcaaaatgagcccagaccatcttaacaaatgcatttatatctttaatatcttcaataatgaatgttttacttttagaaggttgacctgctaaattaagtgctaatttaactttatcgtcttcaaacagggcaaaaagaccatattcatgagctcttttatagcctttaatagttaaagcttcagaagaagaaaacggtgaatcagtattctgtaaaatatcttcagtatgctttataattagaataacattttctggatattttctttcttttatatctttaattaaaagatccggattttctgctaaaggaataattaatgagcattttttatcaagtgcatttactgatttaccttctttagacataaattctattgaataatgttttgctacttcaatcatgcgatttcctcttgcctactaatggaccgtcaggaattttgttttcctggatatatttctcattttcttccatcattttactgccaattttaagaagcaaatccattgcttcatttgctttagctttagcctcttctaatatcatatctctgttcacgatttatccccatagatgtctctcattaatttaagcgctgagcgttctaatttcttttctttctcagcactaatcattgatttcatccattcttctgattcgttctgcatttctttatttgcttgttcaacccaaccatcatcaatatacatcgagtttggtctattgaaccattcaagcatcttcttcagagctttcatttgttttacctaaaacaacagtaggagcatcatcaaattcatgaatttttagcaaatttggatgtaaactattccatacagaagaaataaagtatgataacgcatcttcacttgcaattataaatttatttcctttatctattttccaactatatagtgaatcgtacgaataaaaagataaaggcttatcattatattgttctgcgctaacattaatgtattcggatttagtaaatgcttcaattgctctaaatggaatatttggtacagtttcaataataccaatctttttaagttttatttcagcatcttctggaactggcattgaaacgaaattttctacgagatacattgggtcacaataacccttatcaatcattactgctacggtaattggaacgtctttagcaaacgacatactattactgctaatatacatttcaaacaaaatcgcttccataattttcctcaatcacaagatgtagatgaacaactagaatcacaagaacttccacatgaatcgcccgtccatacatgaacaggaacattagtgtcatatgaatcagaactagactgtgtattctgcgtattagatgatgtaggtgttgaccaacgccaaggatttttataatattcctgggcttcttcataagtcatagtaaccgcttctactgttccatctcccatataaacatattcaactacagttaaaggaaggtagtcatttgaaataggaactacaccttctccgggagttgtagagaaaaaatccgtaaagaaacttttaaaccaattaaagataaacattacaaaaagcctcttttgaattcaacttgcttctcgccataatcatatcgaatctctgcattaaattcaacagaaccatctgcgtacatcataaatgaatgcacaacaacttctgtagaccatggctgtagttcatatttcttcattacatgccgtgaaatgataatatctaaatcttcatttggtttaatccagcgatttaacatagtgctctcctctataagataattctattataccatactcattttggaaagtaaaccggtaaaatgaaaaaaggactcccgaaggagtccttgaattattaaccacctatttctgtaggcgtaaacattgcagcattcttagttttccaagttgttgcatcggaaactacatcagaataagctgctttttctgacggaaagatttgataatgagaatctgcaatacggtgttcatttgaatatacatcaaatgctacagaaacttccatacctttaacttctttgccttcacctgctggatgagtaaaggtcttgatgttaacgaaaccacccataataaactcctttattgtttaattacaggtgtatttatatcagtcttcaatgaaaacttgtgccaggaattcgtgttcatcttgaatttgtttatataaagccattacagcatttatattagagctatctactttaagttgataggcataccactcgtataaattaattaaagctttttgtcgtctaataaattcttctttggatattttcattttgaatgctctataattagttttaaggcttctttactgacaaaaatttcatcaagaccttcttctacaccccaatcaactacacgaagctgattagataagagctcgtatgtgagctccttgtcataatttttaaatagctggtcaatacgtttcttgtgggctttcttaagctggcgtttatttaaacgagccattaataacctcggtcttgacgagcgaagttttcagcatttttcagataataaagtttaaagatttcttcagccgtaagaccgaggccttggaacatgttcagaacgaaatgaagaatatcaatcatttcgaatttaatttccaactggtcttgtggagacaaatcagtaatcagagtttcacgtcgttcaccatgttgagctttccaaggcttccatacagcagatgcatctttttcaccattgctcataccaccaagagaagtcaatagttcgcggaattcatcatcaatataatctttctgattacgcagccaatcaacaacttcacccgcagtagccaaatcatcaggatgacggttatattcaggtttatctttagctaaacgaacctgcagagatttctgcatatcaagcataacttgcaacgggtctttttcatcaccgagaatatcccagtattcattttgagctttatcagcgccttcaatcagttgtgaacattcattaaagtatgccattatttttcctttcaattcatgggttagtagattaattatacaataaatatataaagcaataaggaggacatatggtacaaaaattaatggcacttgttaatgccatcaaaggtaataaaaagcgtatagcttttactatttctgctatggtaggaattttactctggaactttattttatcacctgttgcaattgcacatggtattaatattccagtagttactcttgatacattcgtagatttagcattcgctttagttgggttaatttaaatcttagcatatttagataaccgcattttagccatcaacccctgagcaatattatttttcatatattccataatttgttcagtggttgcaccttcctttctaatcatatcattaacatcttttgatttccagggagatttatcccaaaacataaccctttctcctgcatcaactaatttagtcattcgcttaatagtgtcaggatgacgaggttcattatctaaaacccacacacgtctatctttaaatggaacaacttctaggtctaattgaccacctgtaatagctataccattttcaataaaaagcgaatctataggtccttctagaacatatacatcaccatctttgactcgttcgactccatagatttttgttgcctcaggataagctttgatggtgatatatttttgaggagcatctttctttaatgcacgtccttgaaaagactcagcttttccgttagcattataaattggaataacaagacgaggctcaggtgtttcctttttatatgttcctggagctatactattaactaatttaggccattcagttgtaaaccaaagatatttccatttatcctttggaatacaacgagcttttacatattttataattggatggtcttccgccaatttatctaatctgatgcatgacggaagagatttaattattttcttctcaggttgtttaggaagttctttaggtttttctactggacgacttttacctttttcttttcttatttcaaagatatactcacgatataaatcaggttcaaactcctttaaatatattccgattggtgcatgatagttacagttataacaatgaatatttccttcattattatcgccataataccatccacgggctttattttgatcggtttttgaatctccacaaacgggacatctaaaccgtaatttaaaagttgaactattatttacttgtgcgaatttaggtaaatgagccaatgcacggtatgcaaactcattatcaatccaaggtattgatgacatttttactcttctttttctttagattcctcttttttctttttaggaatctgttcaggacctttatttactacagcacctgacgttgttccagtggagatattttcaggattaccacctgaatctccagctaccatatcttctttaataaattctttatatgttttcatattaacctctattcataaaagcattaaaaatttggtcatcaatagaaacatctactttagactgtttttctgatggtaattcatatccacatattacaattttgtgatcaatatcaaaatacacagaagcaatatgattaatgatgttttcagtaaagtctaaatcaacatcaatatctttttgaccacagcccaaaggataaataatgcgagtaattcgattatctttaacaaagattccaccgacatactctgtgctgcgtttaaagtctacacgccaacgaaatgaaaaatattcaggctctttatgagctctgctcataggacacaacgagtaactagaataagagatgtcaaatcctacgccttcaatatgagccaaagtatcatgattaaaccaattataatcgtacgccaaatccattagattataatatgtaaaaggcaccggattaacgtcattaatcacaagcatgtaattagcaactgctataatttcattgtttttaacgaatacaaaccgtgattgatgcgaatgacctggacccgcgttttcacgattaatgatataacactgggcacctttatatttgtatgtatctttgcacttgtgcatttgatagagcattattcacctaccacttcagcgatgatatttttattattaaagtttttatcgcaatacagaacataattatactgcattacaccaccagacttaagctgtttttgcacttcagctttcatttcggggcgatcgcgctcaacgatattcataatatctgcttcaatttgagtttcaacctcagtctgatccgcagtcatagaccattcgcacaaatctttatcatagcctgccatggcaggttgagcagcgcaagaagctaaagcaaaaattgcagcaaagataaattttttcatgataatctcctcggtagtttatgtttatataatatctcaatttccaacaaaagtaaatagttattttaaaacttctgcgtaatcacatgttacaaactgtttctctagcttaacgattttacgaaagtatcttttgcattggcgaatctgcctcttcgtaggacgtacagcaaacttaataaattccactcgaccaaatggaggactttcttctgctggaatatctaacaccaattcccacgtatctgcaacaagtgctttgaattgcgtatttttcctgacattatacggagtaggtttaaataaaacaatatgcatattatcctcggcaatctacttcacatactttcttgtcatcaatgaaagctttaactaatgctttattaacttcagcatactgagtagtaacccattgaacatcatctttcatcattgtggtttctttagtaaacatgctttcattcttaaaccaccccataaaaactacctttaccaattccataacaatctcctcatttaaccaacaagactactataccatagtcttgtcagcttgtaaactaaaattttaattcattcgccaaagcatctaactgagctcgagtggattcatttctttgatagcgattctgctcagcctgaatctgttgtgaacctgctacttcattcacttcagttggagtagaatcttgatcaatttctacccatttttgatttcctttttgaacacccatcaaaaacttattccatttattcttatcaccatatcgtgatttgatttgcttaatgagttgttgttcagcagctgctagctcctcggtttcaatgaccgcaagcataaaatcggctgttgctggaagaccagcagattctgcgatatcgctcatgttaacatcggaagagtcccaagcttgtttgccgacctgcgctgcagtccaaagaacagtttcggtttcaacagcaagagcacgtaattcctcagcaatggctttaacagttgtgtaactattttctgagtaaactctaatgcggcaagatttacaaatacccagatagtcgacaataatgattgttggaacaaaattcttcttgagcttcaattcgtttaaaagtgatcgaaatgtattagcgtctgctccaccagtaggatactgtttaacgattaaacgaccaagagtagatttctcacgccatttttccatttttcctttatactcagcgtaagaaatatgcccatcatcaatgtcatcaagagaaacatcaagcatattagcatcaatacgcttagcacagacttcttctgccatttccatggaaatgtaaagaacattatgtccgagctgcaaataatctgctgccaatgaacacaatcctaatgacttaccaacgttaacgccagccattaaaacgttcagtgttccagtctcagctccgcctttagtaattttgttcagaattctgagtttaaatggaaccttacgagctttattcatataagatagccaacgtgcttcatagtcatccatccaatcatggccaacgtagctatcaaatgaaattgataatgcttggcgcatgatgtcaggaatagcacctacatctggcattttcttatttcgtttttctggaggaagctcagcattagtttgaatttcgattattttagacgtagcattaaacatcgccctttgctgaacatatttttctgtttcttttattaaccaactgtggtcttccggagaatcagctagttttgaaataagtgtttttacaccagaatattctgtttcagtaaatgaactattttctaatgcaacatttaacgcattaatagatggaacgctatgatactcattgacatgagatttaattaatttgaatgtatttttagctggaccactttcaaaatattctgaatccatatatggccaaacttttgaaaaataagcttgatcaaatatgagatgagaaagaataatttctaccacacttactccttaaaagaatttaaattttttctttgaccttttattaaatgcatcttgcagttgcattgtaatacatttttctacatgaggagctaactcagcttttctttcttggtcaagaacagcaaagtccattacaacctttccattaacccaatccagttttgttacatatactatatgcgtagaaccatcttctagtttaatgacaatctcctggataacattttccatagcggatttaattatcttaagagattcattaaaaagacgttcttttctttcttcttccccctccgaagagggggattcatcgataatttctagatctaagtctaaatcatctttattcattaaattcttccatatcacttaactgctcgaggtcagtttctaaatcagcagctgatttacttttactttccggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttggtatcttttgcgcgccaagatttttcttcgcgaatcatctcgccagtttcttcatcaagaaattcacgagcataccagccatttttaggttttactacaaatcctaattctagagccatatctaacaatccagaataaggatcgataccaccatcaaatttaacatcaataaagaatttacttttttctttaacggtacgagatttttctacatttagaacaaattgatacccctgaagatcagaaccatctttaatctgacgcttaccgataatgaatacggtatcagccgaatacattacgcctgtaccacctgtcatcacggttttactaaacatttcaattgtttcaattgtatggttaaccgcaacacatggaatatttttaatgctaaaataaggagtaacaatacggaataatgacttcagtgatttagcacgagtcatatctgccacagatttttcattcaaggcatcttcagtttctttcttagaagccatattaccgattgagtcgatgaatacaataactttttcaccgcgctcaatagcttcaagctgattcaccatatcaattttcagctgttcaactgactggattggcgtatgaattactcgttccgggtcaactcccatggatcgcaaataagctggagtaataccaaattcactatcatagaatagacaaaccgcgtcaggatatttgtttaaatatgccgcaaccatagtcaaagacatatttgatttaaagtgtttagaaggccctgcgaaaatagttaaaccagactgcatgccgccatcaatcgcaccagaaatagcaatattaagcattggaatttttgtacgaattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctatcggatgaatagcattaaacttatgaaatgcttctgatttttctttgcgcgaaacacacatgcgaagaacctttaatggctcgtcttcttcacccaacgattttcgtttttcgatattagaagttttccaacgagcttgctctggaaactctctattgatttgctcaagcgctctattatgtttagaattactacgaattgaactacacccgccaggagcttgtgcttttccagatacaaccagatatttgaacaaggccaaatgcggataaccttgattaattaaattgagaaatgcatacatatcttcgcataaatcaatttttccatacccaatttgttctgtcgtaagttttccgaggtcataccatgtattcgtaaatccatatgaattttcacgataattaccccaagatgaagtaattttaaaaattggtagacgagcatggccatgataatacccgcaatccatggcatcctcaacatattgaatcaattcatagaactgttcacgagtcaattgattgactttatctacacaacgacggtcatctctttttcgcattgaactcatacgaatagtagtatcatcgtcaatcatccagattcgttgacctgcatacatatcagtaattgctttacgagtaccggcaattccgtttacatcatcaggaatagttataattttagctctagacccataggcatcataataagctttttcttcatgttcacgtactacgatatgaggttcataatcagtcggaaacatatcaagggcagaaactgcccctacacgttgatagctcggaattacgaattgaatcatttccactcaccgttataatcttttttcacaatatgagtttcgccagtattccaccaatgatcaaccaagtaaaaatgacgagaatatacatgaagacttccaacattccatataatagaacctgctttatactgacgagttgaatcgccggcattcaaatcagatactaatttatctaatacgtatttttgccatgcataatcattacggaatccgaagaccacgtcatttgagcgcatgcttactactgcattgactttcttatcacgaatcaggtactgtactgtattagtacacatgaaatctgacataccatctttattgtagtcaaattgcatggatggacgagtataaatcatgataccacgtcgagaatcaggattttgaccaagttcagctaaacacatatcatactgggcatagttatcttctgaccagatagcccaaccataattcgagttaatttcgcctttagaagatgctacctgctgccaaatctttggtgtttcacctggaatatctttaacaaacaagctcttagatttataccattcaagttcacgctgaatgtattcatcattaagagcgccaaaaataaacggttcatctgctacaaatgatgcgccaataatttcaatagttttaacaccagttttatcaactacgaaatctttttcctttaatgcagttcccaaataaaaacggatttcttcaactgtcatagagtcattaatcatttaaacctcaattgatgcattcatatttaaattgtaacagtaataaaccccaccctatgataagagttggaatcatagcaggaactgttacgctatagtatatacttattataaccatcaagattaaaagcaacactgctataattttgcttttcattccttctctctgatgataattacctgatttggctgcgcagactttttagtttcacctgcaattgaccaaataaatgtaataaaccaaccaataattgaccagttaaacagtaaagacgtgaaaaagattcctactgtcgattttgacccacgcatcaaggcaataaaccatggaagcatgtatataataatagccaacacacctgaaactaaaaccataaaaattgaacctgctactaaagtttccatgttttcctcacttagtcaaattttttacacatgaattataagaattcactacatactccatcggagcatttttaccggtacgccattggtaattattagcccaatttgcccaaagctcggcgcagtagttttcaattttttcttcgcgtgtaattacatcagaattacgatatgcttgagcagattcatctggacgaatagcctcgtcaaaattcgcctgcatttgttctactgtctgttttggagcttctttataacacttgacattaggattataaaacttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacagtgctagattcaatcacaggttgagtatcattttcaacactaacaaatggaactgctgctaatgcaactaaacaaactgctaagcatcccataacaattttcattttattctccaaatccgtatcagtagttgatagttgtatagtaccatggaagaacattcttgtaaacagttttgtgaaaatttttttagggaattctaaatgtccagaatcatctgtttttcataagtatagatttatattacttgtatgaaaaagggacccggaggtccctagatttattctatcagccaaacaggaagtctaacgaagctttttcttcatagtccatacctgccgattcacacataccagcaagcggtttaacaaacgatttttggaacaaagttgagtagtcaatccaagacagtacatcagaacgaatttcttttggaagttctgtacccgacggccaagcaatgcacttatcaccaaatggatttccttcacgcaatggaagaaccattaccttatttccatccaaaattggagctacacctaaaccgctaacagctcgacgataagttagcacaccacgaatatggaacggacatttaaatcctggccaacctttatcatcatatttcgctatatcgttcgcagtttttacttcagcaataactttatagtcaagttgacgatattctttctcgaagttcttgtaatattcttggacagactcttcaccttcctgaagaatacgacgaatactttcttcgagagcttcttggaccgctttaggcgttgaactctgctgagtttccatacccatgatttttagatgcggttcagcaaatcgcttatcttccatatcataaacgttcagagcataacgctttttcgctttccaaaatccaccaacgccctttgaaccaagtggagggcaagaaatagcttcacggtccatatgcatcagatgctcgcggttattcatataatcacataactcacgatatgcaacatcaatcataggttccatctttttcttaccgaactgattcatgaattcaactaaatcgttctgctctttgaatcggtcaagaccaactttttcaataactttatctacacaaacatataccgaatcagtatcacctgctgcgatgaaatcttcgccattagttccacatactttattcagatactcattaattttacgagcaatccactgaataccgacttgaccaaaaattgtaatagcagtagcatttcgcaaatcatagtaacggaaatgaatattaccaagagcaccataaagactgttaataagaattttacggttcagctgatttgtgttagcaagtgtagctgctttttcacattcttcgatcagactattaagaacagattcagtataattcgatagttcatttaagaaatcatcactgaacttaacatatcgttcaacttctggtttagttgaacaagaccctgcgcctttcataataatctttttaatagcttcggcattcatttcttcagcgaacattttctttttccagtctttacgctggaaaaatactttagcgatttcctttggaatgataccttcttggtgcttatcatacatccatccattcggagagcaagaatattcatcacttggcttaggagctgttcctgcgatatattcatgaattggatgaactttaaactgcccacgaatagtctcaggactaatgttaacctgacgaataatgctaggatacagagacgtcaagtcaaaactcataatgtatcgacgagcaatcggtttaggttcaaacacaaatgcacctggaaaactctgtttaacgtgcgaaccttgttgaggaataaccttatgttcacctttcagtgagttaaaaataatagcatcccaagttttaataggactcattacaccagaaaaaggcattttagcgtaataagacatacttaaaactagatcgataaacccacgaattttatcaattgcttgaactgattctacgtcaatgatgttataactaatgtatcgttgatgattagtctcacgaagtttattaataggaccatcgtacggcaatttaccttttttggtttcatgttgagcaactgattccaaagagaacgatggcaaattagtaaatgcgaacttcttgtataaatctaaataatcaagaatagatacgccatcaatagaataaatttctttgctaccgtacatattttgaattagtttagattttactcgaccgattggagagaagcgtttcatactacgttcaccgagaaccattttaacacgattcatgatatacggaacgtcaaatccctcaatattccaaccggtaaaaatagcaggtcgtttctgttcccagagattaatatattccatgagcatatcacgctcattatcaaatggcatataaattactcggtcaagaatttcttgaggaacttcatcaccaccttcacagtcaagcttagcagctaactttgcatcccattttgatactgaaccgtacattgaattcaacaaatcaaagacgtaaaaacgatcgtcaattgaatcataatgagtgatagcatcaatttcatattctgctttcattgggtcaggaaatttatcaccagtaacctcaatgtcacagttagctacacgaacaaattttcggtcataagcaatttctgaaccatatgtatcactgatataagcgagtttaaaatcgttcataccgagagcttcgagaccaatgtcttccattcgtttcatccagtctcgtgcatctttcattgatggaaatttttgaggagcacaatttttaccataaatgtctttgtattttgactcttccttacaatgcctaaacatagtcggaagatattctacttcacgggtacgttcctttccattttcatcaatataacgttcaacaatgttatttccgactgtttcgatagagatataaaattctttcatagatattccttagtttatagcccgagttattaggctcttgatatattatactccaaataaggggccgaagccccttgcttaaattaataccagttgtcggtgaaaaattgttaatccatctgcattaattgacttaaccactgcggtaaagtgtttttgttctgggtgaactaatttttgaaattctacctgaaattttagttggaggttttctggtaaatcaaaaagtgtttctgttgcagaaagattatatttttctttaagagacgccatgtattcttgcggagttatagcagtcatattaattaccaatcgtatatttaggaacgagtttccattcatgcttttgtttaaaagaaataactcggaagttattagttaaatctttcataaaagttctttgaccaggaacgatttcaatcagtccccaatcttctaatagccatgcaatcgaatcacgacgaacttcatcttcttctgtcatttcaacttggcgaccatccatacgaagcatttctttaaaatgaacgatataatatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaaacctttaagttcttttaatactaaaggtagttttccatttttagtaagaattgatttatagttaattgcatcatttgtattaacttgataccgtttagtaagtaacttaataatcaatacttcggtggaatcttcaaccagttttgcccatttaccatatcttttaccacgaggaactgcagccattagataattaaaatgagcttcatcacttaatccagaaccgattaaattcattgcatatacagctggcatgcattctggaaattgtgataatgcattttcaaccatgaattttgaataatctttttgagcaatagagcatttagttttattattgatagctccaattatttcaaaaaattcattttcggctttttctttaaaagaatcagcagcggattggacagctgtccaatcttttgaataccaagcaatctgatgctcgtttaattgaatatcatcttcaaataagctcatatcacttccactgcatttcgcacgctaattgaatgaaaagatatgctaaatgtaattccgtattagccgcaattccatgatactgattattttcgccaacaatttcgtacatacgaataatactctgtggagttacacgtgaatagatttcttcggcaagtttacccacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaatgtaataactcgacagcgtgactgaagtggtttaataataccatcaatattgttagcagtaataataatactacagtttgaactataagcttccataaaggaacgaagatgtcgctgagattctgctaaacctgaacggtcaaattcatcaataacgattactttttgacgaccatcaaatgaagctgcactagcaaaattagtcaaaggaccacgaacgaaatcaattttacagtctgatccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctctattaaaaatcatgggtagaatcagcttcaagagctactacataattcgcatgttcaccttcaaatttagcagcgccttgtttaccttttgcccaaagcagaagtttataatttcctggttgcattttcatatttgccatattgataatgaaattaaatgtgttttcaccatcataatcaccaagagtcaaagaatatttaacacgagtcaaagcagaatcttctactttattaaaaccgttaattacgattttaccttcttttaccgtgatagcaattgtatcaatttgcagaccacgagatacacgcaacagttgttgaaggtcttcagctttaatttcagtaacaacagatgctaccgggaatggaattggtttattaggagcaactactgtactcggatcggctgctggccaaaaaattgttgagcgggcatcagcaattttaatatttccatcttctgactgggaaatttctgcatcatcattaactagagacagaataccgagaaaaccgttcaaatcgtaaattgctacatcaaaatcaataacgtcagaaatatttgcttccgcataagttgtaccattaactgcgcgagtcataataaattgaccggatttaagcataataccagagttaatagtagcgaaatttttaagcagagcagtagtatctttagacagtttcatgtaatttccttcaattcaaatgagatttaattttataactaatttaataaagcaattaacgattaaaatcagctgcgattgtttcggcaacaatttgagcggcaacaatcagacgttcatctgcattgccacaatattcatcttcaaggcgttcaccacatgaagtcataataaatttagcaccagcgtttagggattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcatttctattggacattatttttgtatattctgctttaaatgcattcctaagcatagattcagtaactatatgctcttcattagaaaaattatttctcagaatatatcgttttatttcaggaatagttaatagatgctgtccggttgaatattccatgtttttcctccatagagattatactctaataaattaaagcataatctcttataaattaaaccattacagtaaatcgaccaactttcttcatttgaagatgctgaccgtatgcttgcgggtcatggtctctatgcgaaataacaaaaacgttagtattttttaaactatctaaaatagttgaaatagcttttacaccttcaacgtcggtcgctgaatcaaaaacttcatcaagaattagtgtgtttattttaacacctgaaactttttcagcaatatcacgccaagtaaataaaagagcaatatcaattcgtgctttttcaccttgactgaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagccgctttaacttttttagctttatctaccgtcgtgattagagattgctttttattgcggatatcatttgccaacgactgttgggttttaatattatctcggtattcatcaacaagaacttttaaattatcacgatgcgttgaaagctgttcaaatgaatgtgtgcattcagaaactttatctttaattttagaaacaactttatcaccggaacttaattgtgacaaacaggttgggcataatccaccttcgtgatacatattaatgactttattatacgagtcaatttttgatttaattaaaactgcttcttgaccgattttattaaatgcatcagtcgggtcttcgtctaaaacaatattaactaatctttcattagcttcttctatttccgattttagcgttctagcttcttttgccaaatcatcatacatattttgcagacgagtaaggttgtcacccgttaattttttctggcgttcaacgttatcattatatattttaatttgttggataatactatcttttttaacatcaagcacttggttttgtgaatttaattcgcgtattagtgctttattaagcttatccatttcagctaatgttcctacctcaagcaagtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcgaaaacgttcggtttttgtcctcttttgatatagtactttttctcatcatattccatccacagttcaactaaaagttctttcttatttgtgctgtttattaattgacctttctttacatcacgaaatggcttgccaaaaagcccaaatgtgatggcttctaacatagtagacttaccaccaccatttcgtccagtaataagagttttttgaaccttatctaattgaatgtcaataggatttccacctactgacattatattttggtacctaactcggtttagtttaaaattcttcacaaaagattccttttaatgtatcttttagaccattctatcatatcatcataatctaaaaagtattcatcaaattcagccatgcaaacaacaccttgtgctgtttttgatgtaatataaattattccaacatatctagaatcttcttcggtataatcaatgtttgctatgaattcatcattaatgtcaaatgtcgaaaacttcacagtatgcatccttaatacaagatacggacatatctcgcaatgatttaggtgtgtcattatctaaaatgttgaagttaaaagatacagcccaatctgtacagaccgtaacttttttaatacaattatcttcaacctctagcggttcaaaccaatattcaataatttctttatgaccaatatcatcttttacttcgcattcaaaatgctgactcatcataacatttttaaattcatcaaaagtcattgtgttgcctctacatataactgatttgcatattgaataagtgcttcacggtcagaatcagtgatgtctggaattgcattaatgtattcttccatcaacgtctgaagagattgaacttcaacttcttcactgtcatctgactcgacagagttatcaatctttgacacaactcgtaatgaatgcacaactttttctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcacctgcagttagtgtccatggtgtcccaatatatctgacgttagcagcctcagagatagtatggaagtgaccagaccacacctctttataagtcttaaggaaatcaggttcaagaccgtgagatttcattcctttataaaaataaaatccattcagttcccagtgaccaacacaaaaagaagcagatgaagttttgatatgctcaagaatttcaccagtattttcttcacacatccaaggaattaaatcaattaaacatccgtcaaaatctactgtagtaggcttatcatatactttaacattaggatatttagccaaaagctcagtagaggcatttggagttaaagtatttttaaagtgcatatcatggtttcctacaatagtatgtagggtaataccagcatcatcaagcatttgaactatttcacgggcgaactccatagttttgtgtgtgattgcttttcgcacatcaaaaatatcaccgtattgaatccaggtagtaattccatttttcttagaatattctattgcttgtttaattccatccaactgaatggattgaacccactcatcatcggctttaacgcctaaatgccaatcacctaaatttaaaattttcatatatcaagaaccgtcattgaaatgcaaaataaaattattgaaataaacccatctggcgtgctaaagaacccaatccaacatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcgcgttcacggtcataaagagttcggtcagatgacagttctttaatacgttcaaatgttgattccatgtcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaactgtttcaggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcgtattcttttgctaataaaaccggaattgaaaatgatttataatcatgcgcacaattacgagtaaatgatttatctttagcataaaccaaagttacttcatgaccatttttaataaaccaatcacgctgctcaagagaaaatttagttacaccgcaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcataactgccaccattttttgacttgataagaatcaacccacactttcatattggggtctgctcttacaataggaggattaacttctttaattgaactatcatggtattctttttcagaaattttcacacaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgtttcagaatatcccgacttttcttgatagcatattcgtattgagcaaaattattgttttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgttggacaaatgcattaaaacaagcttgagttatatacgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaagcagtatgcttggaacactttctccatcatctttttaaattcatgaatatctatgtaatgatcattaatatcagcgcgatataaaaagtctaaaaactttttatgtgtactaacatattcactttcatttaattcagaaacatggctttcccaatatccaacaccagttttatttgggaaaaatgaaattttcatgtattggtcaacatagaaaataccaaaattttcaatagcaatagaaatattaattaatttcatacattcatcaacttagccgcttcaagagctgcatctagtgaatcaaattggtcaacatattcaatcaattcgccgtaattggcatataaccaccattggctaaattcatactcaaggatgaatccgtttccttcaatttgagttaaaccaatgccatttgtatttacttcatatccggcaagacgcaaatcgttaataagagcttcgttcataattataccttagtaattttcaggtctgcaaattttttcttgcgttgatttttcatacgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcagagaaactactttatcatatgcgtaagaattgatggcgtttttaatttgaatagtcatacattatcctcaattgcattaaaattttattatccaaaaagggccgaagcccttagctaaactttttggcacccttccagccttcgtacatcattgcgactgacaatgacaaagctccttcgcatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattaccattttcatcaataaatttaatccagtcatttactaaccacttagttgtatctccttttggagtagcatttaaagtatatagcccttgcttaaaaagcatgcgtttgatattcatattttcctcagctataacgataacactcgtttgatttgcgcttagcaactcgttgagaagtattgtaatcaaaatcatcgtcaatgtaaactgattttttcaactttcttacttcactacgtaattgacgatttagctcatctttaacttctgaatcaatgcctttcattctacgccatttatcagagcgaaaaatgttttcaaccatatctttatgacttacaccatcaggagctttacgctttccgaaatagtcataatcacgtacttttaaatctttacgacgatacgttttacccatggagtttaatttccttagcaactgaactaaatacagcacgatcacaaatcatctgtttatgtaacttgagtataaaagataataaacttcaaaaccgtttacataagtaacacgaacaacattaccattaataaaataatattgtccctttttaatctctttatcaaccacaaccatatcaaatcctcaaaggcaattcatatgttaataataccacagtttgaacttgttgtaaacaactttgtgaaattattttagggaatgataagaagggaacgatagcttagaatggtaatatacagaatgtgagaaagaaaggcccagagggcccgtcttagtcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagtggacgatcatactcaatcttaccattatttgtaagaactttatagaaagtaaaaggagcattgagctcctttagaagttttgtaactgattgacatccaggacaacgacctacttcatctggaattccatagacttcaatcttattctttaagttcgagttttgttccacgagaaataattccttggtaagcccaataaggaggattaacagaatcctcaccagagttttcttcaggaaaataaacctggataacgaagccggattcatcaaaggtgaaataagtagtaggcagttcacctaacaaatcggcacgagcgttgatttcttcgaggtcttgttcacgtccagcccagaagcttgggttcagactacattcatagaaataatagtcattaccgaacatatcaaaaccattccaactctctactacataccgctcaaaactaatcataattaagcctttttatcaagaacagcattcagcttgttagtaattttatccagacgctcattaaactcactagaagataagcccttttctggagaaattaaactaatcacgaaaaatatagcaataaaaggaataaggaaaatagctccaactgccataaacagaaagaatgttacagttgtaagaaaatcagctaaacctttacgaaatttatacatattttacccttaattaattaaccaagcattgataagcactaaactatattgggaataaaattctggaccaaaatgaaaaatcatatcatttatagtatccataatataattcaatttaatcatgtttccacaccccataggtatttgaccaaagtcgctgattatctgatcctcgccacagctttttagtcggaagatttttctcatactttccatcaataataacatcaacatatttaagcatttctagttgtttaatatcttcaaacttatatcctgtccacaaccaaatgcttttattgggataaagattttttactgtttgaacgatgcaatgaatcacgtctctgttatcaggataaagagggtcacctccggttatagttaatccttctatataatcattattcaaacattcaattaattgttctagtgtttcaccagtgaatggaataccatttctagcattccatgttgatttattataacacccttcacatttatgcaaacaacctgtaacgaaaagaacggtcctgcagccaggaccattaacaaaatcgcaaggataaaatctatcataattcattggtgcttaaccctatgcatgatttctttatttttgccgagattaaatccgcgttcgttcggatttcccaaataaccacatgttcttcttattgtgttcatctttttaggatcagtttctccacaaatagaacaaacaaatccgttttcagtaggagtcatttcatgggtacttccgcatgtaaaacacttatctactggcatattaacaccaaaataatctaaatgttgtgcagcataatcccagacagcctcaagaccttttaggttatttttcatatcaggaagttcaacataagaaatgtgaccacctgtcgcaatgaaatgatatggggcttcgcgagaaatcttttcaaacggagtaatattttcttctactgaaacatggaaactgttagtgtaccatcctttatcggtaacatcttttacacttccatatttttctgtatcaagtttacagaagcgataacaaaggttttcagcaggagtcgaatacaaactaaaagcaaacccagttctttcagcccactgtttaagacgagcattcattttagttaaaatttcttgtccaatatcacgaccgacaagaatattcaattcatgaataccaatgtatcctaaagacactgaacttctaccgtttttaaataactcaattatgtcgtcatcaggtttaagacgaaccccgaatgcaccttcttggtaaagaataggagcaacagtcgctttaactccttttaaggaactaattctacacatcaaagcttcaaaacataaatccattcgctcattgaacaattcagtaaatttctgttcattgaactgtgttccaatataagaatccaacgcaatacgaggaagattcagtgttacaacaccaagattattacgtccatcaagaatttcattaccggttgaatctttccacgcgctcaagaaactgcggcaacccattggagaaacaggaatagatgagccggtgatagctttattgttcttagctgaaataatatcaggatacatccttttgcttgcacactctaaagcaagctgcttaatatcatagttcggatcgtctttataaagattaacgccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggagtctgtccgtttgaactaaagagagtatttacttcatattcataagcttggaatgcatcgtatacatctttttctgttttagattgagcataatttaacgcatcagcgatttgccatttttctgcatcctcaatatgttttgcataggtgcgtttaacataaggagaaagtactttatctacattagcaaaagtcgttccgccgtattggtgagaagcaacctgtgcagtaatttgcgccataattgcagtagcaacgccaattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaattgtgttttggtgtcagattcattatattcaaatcctctttgaagcatctcggccatcatttcctcttttcctaaacgagaaaattcctttgatttatctccaacaaagttaggatgaatattattttgggtgtaatcggattttaaataagtaagtaaattttctaaccattcaagataatcaacaccttgtccctttaagccagaacgattaaatttgtgcttcatttgaccttctgcagcattgcagagattacaaagcaatccacgtacctttcctgcttttggtccatttaattcatggtcatgatcaagatgattagcttgaacgtcaggatttagttctcgttggcaaattaagcatttaccattttgtgcatcataaaatttttgtttttcttctttgtataatttgccagtcaataacataataaatacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgtcctgtcagaaaaagaattttgagtttttttcaagtattgtaaaacatttgatgcaatcgcttatattgccgaatcttttggtcagaaaaagaaatttgagtttcaagccattcaatgtactctgcggcagcttgcatcaggttaccttcatagccatcgttattttcttgcgcagctaatttagctaatgcgtatgaaatacgttcaccttgaaaagcggctttaggcttctgaacatcttggctagttctctctacaacttcttcaatttcgccattttcaacggattcagtattccacaaacaccagtatgtaattggcttatcatagatgttaataatctttccgtcggaaagttcaatttcaataattccagtatcaggttctatatcatcttcgcattcttttgcaagttcacgaactttaaagacagtacctgcactaagttccggccagtaattacatagccctgtatcaacacgattaattctaaaccacttatctactgtaatcatgtcccatctccatatcaattaagtcatttatcgttggttcattatatactgtttcttcatcaatgtaaaccggttcttccggctctggctctacagtttcccatctagccgcccaccaaggtttaaccccgaagcttattaagttcttcataatcaatccaggattctaatcctgatggcaaatcagattcaatttcccaaagaagctcttcaattttctgaagacgatctagttcttcggctggaatagtaaccattgacggagttcttgatacattaatatcgtaaatcatatttaccccaatttaaccatacaatcgccgtatttccacttagaaatagacttttcaccattagaataataaacttcgagtttagcacgattatttttaatttgaataaccttggctgtcatcaaagttccatacccataataaactgcaacttcatcacctacatataccgcgcttccgcggtaatcatgaatatagtcagttccttcgagcatcatttaaaatattctcgcagttggtcaaatccaccaatatgacttccatcaggagcaaatacctggggcattgtcaagccgatttgagtatcacgacctagtttagtcagaagctcagcaattttctcatcatcaaaaacacctttttccggcataatgttgataaattcaaacggctgtttcttcacggtcaaaagacgttttgcattatcgcaatacacacatttatgaatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccatgttcattataataagctattgctaattcacggactgccttttcagcagcctccatatattctttacgcttggtcatttttaatccaaaatattattaggcattggttgaacactcacaagttctttaaagaactcagtagagtcaggcaatttaaccatttccggagcatgcttactgaatttatgtttacattgacggcatttatattcaagctctggtttacgccagttaatcaattgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgctttggcggttaaagccttaagaactttagtatactcttcaatctgtttttcaacttcaatcaaacgggcactgagatattcgcgttcttctttcatagtatcatttccatgattggattttggtgtaggtttaaattcactagggtcctttaatttaataacaaatttagtttcaaacagcgaaagaccataattcgtattatcatcaaaggatttgactacatccatatcagataataacacgcgtaaattataagccaaagaactaatagtttcattgtgtttattagcttcgcgtggtttcatatacggaaggtttttatatatctcgtgcggagcacaaatgataattgacaattcaaattgcccattctgggacgatggagtgaatttagccgtaacccagtcttttacattcacattaatagtacggttatcaccatgacaaaacagtctacgagaatgcttaaaaagcatattcacgttattattgaattcgtgtgaaaattcactagcaaatttttctttactatctttagaaaaccattcttctaaataagttcttttcacgtcgttaataatattaaatgtaacaacactagcatttgatacattagtctcaatgtagcttggatacataaattttttaacattattaacagctatcacagaagatagtaatcgggaacgtttgaaccactcgagcaaagaaccaagagaatgtgaatacgcattttgtgtatctttacaaatatggttttcccatccaatatagtctaaaaaatcacgaagaatattattgattactgctctgtgtcctatctgataattacgatgtttagtaataagactgtcaaaataatcaatataatgtttacgagttttcatgttcttctcacttggttaatgatttatactccgagccatccttggctttaaattacttaattaactgtaaagcttgttccagacgatcaagacgattaacagattcttcccaaatccttttagcctgctcatattctttctgcgctttattagaaatttctagaacttctttataagctttttctagtgcaataacttctggacgaatttctatcggttcaggtgaatcatcaagacattccattagttcctcaagggtagtttcttctttaggagtattcacaatttcatcacatttttgttggtaaatttctttatcagtaggtgaataagcacatttcacttcacgaaggctaattacgagtttatatccttcccaaccgcatatattcttaaaaggatatgtatgaatattttctactgtttccatacaaagtaatgcggtctctaattgacgagttatagtgctagcaattgagaaaaatttattaatattcttttggttagtttctggtgtaaaaaatccataattcacaaaaatagatactttatttttatcaagttcatattcttttatgataatcatatcagaagccaaaggatgaatttgacgataatcgccataacataatttagaagctgattttagaatttgtttcttaaaaagtctgaaattactgatccaacgacgagtaaaaatattctcagggtcttctttaatattaagatgataagaattaacatcaccgaaccaattgtatcctactacatctttagttcgtttaatttctttcccaaaattaccaagaatatcccgattaaccaaatatgaaagaagacgagactctttaaaggttttcttgataacatctttatctacacggctagaaattttacgaatttcatgaataaatttagtagaagaaacaatacttgcatcaacactattgagccattgattgataatagaaagaacgctattttggccaaacatcggtatagctttatcatcaataacgctattgaatgatttgatatattcgttacgagtcataataatctcctcagtagaaagtaaaaacattataccacatccttgtggcaaagtaaactagttcagtgcatttagtgcattgttcagtttagaacgttgctttgtcagattttgaacccttgactgagcttgttctaacgccttttcagcttctagcacttcattggtcgctttaacgagttcatcatctactgccttaagagacttctcaatcgcgtcagcgtgccatttttctacaggtttaaaatttgaattttcagtaggaagaaaactcactttattaagtttacatgcatctatattgcttgagctatacatccaaaatttaggatcgtttgataagtaattggataaatttaaatttaaggtatcttgcacttcctgctttttctcttgaacaatttcatcctttctcaaaaattcatatttaaatgaaacgatcatatcaagttcatatgttgttgtatgttcccaatttcgctcaaaacgaggtaaaatcttagattgaacagcagcaacaacatccatatacttaaatgcttctgtcagctgtgatttaagacattcacaaattgaaagagaatttttagtattaggcttaaagctaattcgtgcagttctattattttcttttaacggtcttacttccatctgaagagtataaccatcaaatttcaggttctttaagttaatatcagagccttttaatcgactagcagtagacaaaatttgctttaattgtttacggaatagagcaataaatctccattcaatacgataatgatttggattgaaaaatccagatgataaatcgaccttactttgaccaacgccttgaacaatcaaaggatttttataatcaatagttttacagaaatcggtgagctgttcacgagcagtcatttgtgtaatataccctgctttactaaaattacgcacccattcactgctattcgtatacttaaagtgatgaataacacgattaactttatcagggtctaaattattttcacacaaaaatgtcataacatcacgagtatagctggcattacgaaccatatcttcaatttgagaacgagttttcatggtgttccttaagatttaagtaaatcaacgattttaattaatttttcacgctcagatttagctttactactcaatccagatagtctgaaaatttcatcatcatattgctgaatagaaatatttagctcttcaatctgcttattaaaataagcaatttgttcagaatgtttttcattactgcgaactggtacaggttttgtaggtaatttagttgaactggattcatctgggcgataaattaaaatgcaatttgaaccaatcggacatttagcaccagacacatattctaatgttccggcttcttttaaaacttcaaaagctaaacagagatgatgccccatattaacataatctgtagagcgagctctgatgtaataatcatctccacgagtactaaatttaaagcatttaaggtcttctgtattattggtcttaaaaatcatttgtttatctagacctttagctaatcgagcgcctaatgctaataatcgtcgttgattttcccacaaatccgcaatcatttggtcaaatgataatttcggcattagtcgaccataaaggtcatatcctttattataattgcgaaggatttcactcgcattaatacgagacaacgctccaattttattaagggctttcatgatgcgattagataaacccattccagatccgtttgttcgttgcaaatgtttatctaacccaaacccaatatcaactttaaatttatctaaaatttcagcgtgaacatctctgtcaataacattcaaatccaaagttgggttaaatctatgaaaaaatttatctggctctccacgacgaagtacagtccattcatttaattttttattaactaaagatttaattactgcattgacattattaattactactgacatattttcctcactcaatttcaattttactaaatatacagaataagatggaacagactatataagcaccacacacagattgaactaataccattccaaagaaccaaacaatattatcaaacaatgtctgttttacgtcgaaaggacgtaaacttacagtaatattatcacctttttctattgatgaatacatctctggggaaatatattcactaaatctataaccatctttgagttcatatacggcaataaacgataaactagacccttttccttgtgttcctgtaatggtattaactacagtaacatcataatctttataatgcatataatcattaattgcgtaataaccatatgcaattgctatacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttgtaagtttcaatacgctctgaaatgagagtgtatcgttcatttactgattctttcataaaatcaggaatttcacgagaagctttaatctcatcaaatttatcaataacagcttgctcttcagcaattaagttatcatacatcaaaatatctttcttgatgaactcaatatcttcttgagttacacgagataatttagatgctttatcctttttgtactgttcgttagtatcacgagaccagtgtaatgtacgatttttattcgtattcttgtaaatttctacaataccaatctcatcgataataacgatccaattccaacgagatttgtaaatttgtcctccgtcaaccgtgatttcacctccgattgagatgtcattaaagaacttactttgtgcttcagatttaaatttaccatcgttgtaatttaccaggttgaaaatatctttagcgttcattttgtgttcctccgtagttgatagttgtatagtaccacagaggaacagtcttgtaaaccactaaaagaaacttctttcacaattttttccactgaaccatgcgcttaccgctttcttagtctcaggagcagtgttatccataaaccattcaaaggcagcctttttatgattctggagggcttctcgggctttaatctgctcacggtctattaacactaacatatgagcctttcttgtcaccatgggcttcttatgattttttgaatactcccagtcatttgtccatcgcattgtcgttgcgaacttaaatactgcttctttaattttagtttcgtaaatttcacgagcctttgagtataacatcattacctccattcaccagtttaattctagtcatctttttaatggcagtccatataatctatttctgaactgcctttttgtcatagaagtcctcttatgaattatttcagaagagtaacctcagcaatttcttcccaaccgtttttgtcggtcataataaagtcagcaagataaagagcagtacgcagtgaaacattgcgtaaacgattaacattaactttcatccatgataatgctttataagtttcttcatcagaaagaccgcgcttttgcatcatgtcagttgaaagaataacatcttcaaccctgaccataatttcttcattagtgtgaacacccaaatccaaataaaccgagcgggacactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagatgcggtgctccagcagactttacgggtctctccagtgtccagagcagctttcagaagattaagaatgtccatatcagagaaaacatccacatcatcaatcaaaaggacagaattctcttcacgattattccaaagttgttcataaagaccgataccggagattttaccgttaatgcttttatattcaatgtatccattatcatttgctttattcaaagctttatctaaagaatacgttttaccaatacccgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcacctaagagctcaaaagttccagagatttctttaccgaagtagatacccttattgatagttacagttttcattttattctccaatctcacatttgttttgatagggtaatagtatcacactactacccttctgtaaacaatttattttaacgttcgccaaatttttactgcttcacggcgagatacttctacagctccaagttctacagctttttggcgtcggcgagcgtgtaagtcataatgtttaatgcgtttatcttgaaaccaagaacgtttcattcctattgcttctgccatttcatgaagctcttcaatatctccatcagtgaacatatgacaatttttagttggatgaccgcgaagtttccatccatgattcattaaaacatctacgtaaactgtcattgattcttctccaaataagtttcgataattttctgggcgagataaaccgcgttatcttcagttgcgtcttctaagaaactttcaaaacactctgaaatttcttctgtatcaatcaacttttttacttcaattggtgtaattttcattttgttttccgtttaagtgtttgttttgatagttgtatagtaccataaagctttatgcttgtaaacagttttgtgaaaaaatttttaaaataaaaaagggagcccgaaggctccctatcatttataataacttcgatggttttcaagatagaccttctcaaggaagtcatcccagaaactcatgtctactttttgctgcataccgttcttagaagcttcagtagatgctgcttctacttgatcgaccacatcttccaaaaactcttgaaccgttttaaatggatgtttacccaacttcacgtcgagaataaatggagcatcttggagtggataaaccaagtcaccagttttgtaaatttccaatagttggagtccaccacggcaagcatgactcagagctttccagtcaataccttcattggcttcggccttacgagcgcgttcaccatattcagcatctaatttgttcagtgactgcttaagctcaataagagaaagcgttgtctgatatttacgacccaacactgtgtagaacgtctgtgggcctgttttctcatgattatggaacacccattcacagaattcgttttctggaagacgatgcttaatatcttcaactttagtacgacgctgcttaatagaaccatcttcttggtaatcaacccactgctcagggatttgattaactactttcaatacatcacgtaatgcagccaaacgagaacccttaacgccgtatttagaagcttgcttacggacatatcctaaataggatttcatgttagtcgtataaaaacgagaacggttgtcttgaataaacttccacacatcaggcaaatcagatttaaccactaactcaggtggagtgtgaagcatatctaacgctacagtttcaccatctgctgctaatttaaagaaatatttaagactgtatagttcatggtcaatatcatctttagtgtttttagatgatgtgttgttagtgtttttactcatatgctctttaacatttccgataagaatatcgcgagcaggaggaacaaagatttctttaaaatctacatcagattctggagtagaagttccataaagatgactaccaaaatagcttttcattactgttttcatcattcagccttatattcaataacaggacatactttagctttacgcgcttttaaaaattcgacgataatagatttcttgggttgaataggaggtaaacctttatacgccctatcaatattttctacatgtaaagcataatcctttttccatttataatctttatatttttcatgtagttgtgcaggaataacaaatgaaccgataataagtaaaacaagcaaaatggcaagtataaatgctgatggaataagagtccataaactaccaaaaataagccatttctgtatgatttctgcacagataatagttagacctgcgagtatagtacatccgaaaaaagaaacgaaaaatgtagggataacaatagaccaaaaatatgcacaaagtgtcttaggtcgtttccattcgtcgttaaacattttgaataatttataatgccaagagttttcattaataatcataattatcctttcattgaaggtgtaacagttgttaaatacttaatcatagcttcagcttctgattttgataatgaaatttctccattattttgacgaatagaaataaaatccggatgacggtcaccaccagcttttaaaacacacatataagtatcagtttcatcttcaatatttgaaatgattgaagcagttccacatgaatgtggtttttgataaactaatacagcttttcttccaccatttgactgttcataaacttttaatacatcaaacaaatcacttcttttatcaatagctaaaatgttgttttcatcttcaatgttaaatccttcggatacttcataaagtgtcacccataaatcacctatatcgatagtagcattttcctttccatgactttcaagagcatgacaaattttcttgatttcgtcataactcattttaataatatcatctccttgactaagaaagatgtcatttttaaattcaacacgaattaaaccgcttccacttgaaataaacatatttcctcactttgaaatcatagttggaatgacagaatcaagataagtctttaacgcaatagcttcgtctttggtaaatgtgacaatatgtgatcgaaaatcgtcaatttggcgaatagttaagacatctccctcttcataacattttgatacatttaaaagagtttcatcattctgattgcaagcgttagtaataatagcattgcaatttttgagccattttaaactatgttttctttcattagaataataaaaatatttaatcttatctataaaactatcccaatggataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgcgtcaaacgatacatgttatttactttttctatagccaattcaccaaaaagcggactaacttctaatactaatcgtttcatattaatcctttttattggcacgaatttgttctaaaattttagaatattcctttgtatcagatttacgtacaattgatacactataaggcatactatcggtgtcttttataaagcgttccaaatgacactctaacaaaatttctggattataaatcgtgtacatcaaattacctgttgctccacgatattggcagatttctactgattgaacaccattccataattttgttaaaactaaatcacctacttctaatttaggaaagcccatgttattcaccaattaaagtttcaatataagaatcaagatttactttagcttcttccataagagttttgtatttaatcttgttagcatgtccggagaaagctgattcatcaataactgttgctgtatgaacagctttgctatatgtttcaattaattcttttaattttaaaagcctgctcacttgtcattacatactcctttgaataatatcaataatgttgttcaccagattataagtaaacattgggtaattatattgaatcatcacatacacaacaaacaaaactttcattctcttctccttggcagttgacaagattactatatcataaccttgccaacttgtaaaccattaaatgacgttttcaataaaattctgaagctttgtatgagcatcaaccatgattttcaattcttctttagcgaaagctgtacctctttcacgagaagaacattcatagtcagaaactgcattagcatattcttcaattagcttcattaaaaacatctgcttttcagttttcattattccacctaatcatttcaagatattgaactaacttagctttagatttatccaaatcctttttagctgcttctataccatcgtatgaatatccttcacaatgctcaactgctaattgatatgaatctatttcaatatcacgtgctaatttaatgattttttcaaactgttcgcgtgttagcatacttacactctcgtattatgatcgataatttcatcaagaaacatatctaacgcttctaaagcattatcaactttagcttcaaatttttcaatacctttatttgcaatgcctgccgaaaaccaagcaaagtcactaagttcctcatctgctttgcgaattaaagctaccaattctttaattttatctgcttgttcaattctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattaagtgcttcaattttcatgatgttctcctctttatccgatagttgtatagtatcacagctcaaatggaaagtaaaccggtaaaatgaaaaaagtctcccgaaggagactaatgttattcgagggaaagaagatatttactctggtaaaacatcccagtaatatcatctatcgtgctttgaatggctggaggcatttctttataaatgctgttagattggtctagtatgcgatcaatcattttaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttattttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcgttccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcgcgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcatattcacataagctattaattcgttttctttcttatcaaaccgatcagcaaattcttcttgctgttcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatactgtaactcaaaactattcatttcggtttaccttctttaacgaaatcaggataaggataaaatcctgaataaaatccttcacctttatgattgatgcatcctttattagaacaatagcaccaataatcgaaatcacaagccatttcatcattacataaagcaaaaacaactggccattcacacttttcgcagtgggcatttttaagaatactagtttggctcataaccatgtaacctttaaacaatattcttctacatgttgtttacgacctttcctatcaataaaggtatattcaacgaatgttccaatatagtctttatctacatcatgtggactattaattgggcatttagtacggcaaatgcgttcccattgacgaataatttccactttgtttttaggatcaaacggatgcgggtaatgtactttcataatccaccactattaaatcaatatcaggagtaaacatgtcgattaatttagaaaccttatcccaatcgccgccagcaataccgcaacctatgcgtggaatgtaaattactggtttaaacaaaagggtttctgcctgtagatttaattctatcatgcagtttactaaagcaccataatcaagattaggacccggttcgtattgtgtatacaggttatagcatataccaaatcccgtaggactatgtttaaaaacaatagacatatcgcctaatttatcacgagaaccgtactcggtagtggttttatctatttctaaaattttgggataggctcttgctaattgacccgctacgccagagcccattgtgtggaagcaattgcacccgtgcgcaataatattaccttgaagaaatagggcgacaatatcgcccttgatatattttacaatcatctagtactcaatcctcgattataagaatctactaaacggtcaaccattgaatgacaagcggctttatctttctcctccgcaactgaacattctaaggtattccactttttagcatatcgttttaacaatgtatcatttttgtatctgcttgatttatctctttctccgtctttatatgcatatattaatttctgcgcaaattcagcttggcatgctttatttttcccgcaataatccgctgcagtacggtttacatactctctaatttcagtatatgatgtatctgctaacacagaaaatgaaattaatcctatacataaaaccaaaattttagtcatttactatttccaaaagtttattatttttaaggtaattagccttttctaggacttcagaagcatatttagaacctgctttaacattccatcccgaattataagatgatattgcttttcttatatcacccttatgtatatttaaccaataagaaagttcaatgtacgcccaggaagctgaattggaccgtttattcaacattctttttatttcagcatcggtcatattataaccaagttccttgactctcgctcgcatagtaggcaaataattttggaacattccataggcatgatgctttggtttagattttaaattaactccggcagagctttcttgccacaaaatagcagccattatatgacccaatccgctcttatggatgtttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctacattgaagtgacgggtctttgaacttcgcgttaggtttacaaactgtaaatccaagccaaagatttccatctgtgatttctaaacgtccaggacgatattcaaccccatcaataaaatcctcgtcaatgtcaggacgcggaggcatactcaggaattcattaacttctaaaacatggtcttttattttatggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaagtgacgacgaagcttatttcgacggataaaaacttctgtattgatagtcatgttattctcctcttaactgatagaaaaattataccacagtcaagaggaaaagtaaacagttattctttaaatctaatcaatttattcatagactttgaaacttctgcacgaacctcatgtagatttttgagctgttcaagacgctgctcatagtaagcaatttcatcttcttcgagacagtcctgtgaatcttctttaagataacgtgcatagtcctggaaagcgttacgaactacttcctggaagtcatcaagactttgaattttcttaggagcaacagatacacgacgaggggcagtataatactcataaccaaaccctgcgcttaattgagccattagtatttttcctctggttggaacactgcgcgacaagcccacatactggcttctttgagtttcattttagcaatagttaactgatcgaggctttcggcgtaattcttcgcgagttcatcatcttcacagctatcaaatgcttcccagaattcatcatataaagcatcaaagataagccctaaacgaacttcagcatctttgatagcattcactttactgattttatcgtcagtatgtggtttataacctttaatgtcttcaatcatattttacttcctcacctgttcccaaatcatattcaactaaacgaataggttcatgaatgccatatccttgaacagaaatttctgtcgtaggataaattccattaatatcacccatgttccatgcttcgttaaattgctgttcgcctgaattactaaaccactcggcgaaagcatttagcacatcttcagaaccttcaataattatctttgccattacaaactctcggtgaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattaaaaaataaatttatccaagattgttctttaattaaaaatggctcagaatcatatgccattaaactctgtgtgattagtcctttaaaaggcccatcaataaattccatggtaaaatatggaattttattcattagccgtgcattaggagccgtgcacaaaactctgcatcctttgaatacgcctttttgtaatttgtattgcttgggataaaattcgctcaaaatgttattttttgccaaaatttcaaaatgattcaccaatttatttttaatagtttttggcgaaaaataaagatattcgaaaagctgagtgtctgtcatcattgcattccgattacgaaaaactgtggacgagtaataccaccaatgcaacatttaatattacagcagcagtgtacagtgtcaatatggacactataaatcttatccatatcaggagatttgacaggctcatcaattatatacaaaattcgcgaaagcgataaacctctgaacttgcttcctttattaccaataaaactgcgcacagaatcagtaaataaacgaaaacgtatatcatcattagaataacgcgaaaattcctttttaatattatctgcggaaattttagcgtaagctgaagtattagaaagaacaataactgttccaccgtcatacaaccaattagcggcaaaattagttactgcagttgatttaccagattgacgcccaccatctagtcgaagtgtacaatactgtttaagtaagtcttcaaatggcgggatatattcgtttttacaaatttcttctactctagcatcagaatggtgtgtaaaagcattcatcagggatagataaggaccagttaaaaatgttctcattttgttctctctaggtttgggccattccatggcgcatgaattgtccatttctgtatttacccattaccgcacttgggctcgaccttattacaggttggcgggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacacgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaggtgtttgattataccatctacttttagctaagttaactgctgcttcatcccagcgtttttgctggagcatgcgtaaagaattagtaaatcctgctacgccggtttcccccatttggaagaccatgttaatcaatgcacagcggcgaacagcatcaagagaatcataaactggttttaatttagcatttctcagaattccgcgaacagcagcatcaacatcctgattaaagagtttttcggcctcatcttttgtaattacaccattacaattacgcccaatagctttatctaattcagatttagcaacacttagtgatggacttttagtaagcaaatgaccgatgccaatagtgtaatagccttctgtgtctttatagattttgagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaggtcttctagaaggtctggattataattgctaaaaccggtctcttctaagcattctctttttgcagcttccagtgcattcaaatcagaactttctacacgtccctttggaatatcccagcgatgtgccatcattccaggcttacgagaaccagtaacccgacccataaataaatctttatcttctgtcatgaagataataccagctgataatgttttcattttaatttcctgcattcagtgataaagttatttaaattttgagtatatttcttttcatcaaaaatcttttgttgtctgcgtagccgccatggcatttcaatgaacgtgtaccatatcccagataatattgatgctgtaaaaatattaacaagtatggttaaaagaatccaatctcctattctgtccattggattttttataaaaaagtaaaatacgaatgatgacacaggaagactaatgatataccacagaatcataatcttatctgtgaaccattcagcattcgttaacttagcacgaccattatgaatacacacgaatttatcatctgttacagtagatggcttaactgcttgatatcccattctaaactccctaattaatcgtttctttgtatcttcagaacagccgctccagtcaactctatcaactgaaatgccatcgtccccatcatctaaatcataccagcgagtttttaaaatcatttaattttcctacaatcactcacaaactcttccattgattctttttcaatataagacatatagctattatattcctttaattgtattttgtaatccttttttctttgccaatttattttaaaattatcataatgaaaatataacatggtaccaaagaatgaaaataatgaaatcgctatagtaaaacgaagttcactccaaacctctgttataattactgtgccgtcgatatttaaaataaaacagtcaattaacaatccaataagactacccgcaagagctgtaaatactgatacagcaagaattaatagtgcctcaggaaacgaatatttgactttatttagttttggcttttgcatcgtgattccttaacaaatttcataatttcatcaaattcatacatatctagcttaagctggtgttcctttttaatctttttacactgagctttccaatcacgtacacgtttacgataatgtcttccttgataccagtatcctacccaatttacgggtactaataaaagtggaactattaatggaagaattagcattaacacaagtatttcgccagaatcaatatcagtcataacatctaaaacacctccaataatcaatagaattacaaatgatatgagtataacaggacctattaacacatcagtagaaattatctgacgctttggttcatacttcacaggtttacttggaaggtatagtgatggttttgacatattctctacattccttaacaaatttttctagtaataaatcactttcaaaattgggattttctacaaatttatcaaaaagatcatcaacaatagttaagatattctttttactaagaatacgtttattttcatgcttcgtttcagaatcaactataagagtaaagaaatatttcttgccctgaaattttacagtagtatcaatataaaataaatttgacttttgtaaattacgtttaaaccatgcgtcacttaaactataaacaccgagataatcaaaatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatgcgtttaagagcatttagtaattggtctggaacatcaacctgtctttggaactcttcaaacattgaattgaaatcactttgcattttcattttcattcctatttactccaagtataaggggccgaagccccttatcattatttcagagaattaatgtattcctgaacatcggcagaggtagtttcaaccccagaaatattaccgttaaaggtttcaactcgagcaagggtatcttcaatatcaaccttagtcagtgctgcaatttcaactacatcatcagcagtactaattccaagggcatttgctgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcgtcaaattataggctcataatatctcaatcatgagcctgcgtaaacttatttcatattattgaaatattcttctgcgatttcgtcgttatcatggtaaactttagaagacagtttaacataaccttctgctgtgaacatattaatcacaacttttacagtataccactgaccgtcttcattacccattactgcgtaagtttcaaacatcggatgatcaggatcgataactttaatatcattcactgtacgaccgaaatattctgaaacgcatttcataaagaagttgaacagttcgccgtaattatccatttcattctccaagttgttttctgtatcagtagttgatagttgtatagtaccatggaagaacagagatgtaaacagttttgtgaaaaaatttttagggaattctagggcagggatgggcaattaaaggataggataatatattataaagggtataaactaaatgatgcctagagaggtccagaaaggcctagataccaaaaagccctatcatttagatagggatttaaaattatttacctagtttacttattatagcttctgcagcagcttttagcttagatgcagtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccacttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtaacagcgttatccgagtgattcaaactaaaaagccccaacctttcggtcggggctaagaatgtcatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttacccgaagcctttgcaaaagcagcgccagtagcaactaaacttttccaggccatactaactgcatttcccgtaaatccttccgctttcatgtcgcgtgcaaactggaatcgcgattcatcagaagcatctttataggaatatttacccgcggcaatggcagcttttgcaacagcttgaatttcggtgctagatgcttcatttaacaccgcttcatttaaaaattgagtatatgatttcatcttatttcctgttttaatttgtagatttaatatactaatatttataccaaaaagccccaacctttcggtcggggctaagccttgcggcaaccttgtcggggttccacctgctaaggcaagtgtttgtacgaaacgccgggattcgaacccggttattaagtagttgacgctactcaatatttttaaaaggccatatctcgaccatatccgaacgttccgtcaaaaacgctactcggcttacggcaaagatatttcctcgaatcgataattcggtgcgccgtttctgctgtgatagtaaagagccagaacacagtaaaactgtgggaggaaactatactccagggaacatcagtccgacgacttaccggtagcgacccggtttcttaatattcttttaaagaatcaatatattcacggcgtttacgccacaaatcaattgcttcatacgcggattcagcatttcgaattagccggcatttatgtaaagacttatgattttgatattgtgtagatagcggaattgtatctaaaaggtctttacgatcaaaatattcgtaaccatctaaaccaaatgaacgatttttgagaaattgccaatgaccatattcgttttcgacataaacataatctgcatgctgataaagcaaattaattacacgttcagaaataacagtatcattatgattaaaatagaatgttaaatcatgaactactaaataaacattacctttcatattttcctcacttataattggtcgaggcagtagggatcgaacctacgacctaggacttagaaggtccttgctcttccttctgagctatgccccgtaattggggtgaccgatgggagtcgaacccatgactacgagaatcacaatctcgagttctaccaactgaactacggccacattaatacctactccaacaatcaagatgtcttcacacgaaattaagagaagagtgatcagttcaacccctataatcgcgtcaagtagatattaatgtgacagttgtcacaaatttggcggacgtgataggattcgaacctataaccaatcgcttaacaggcgatcgctctgccattgagctacacatccaaattggtggggaatggtggagtcgaaccacccgagtcgcaatgataatggatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccgtggcaggatttgaacctacgacattctgctcccaaagcagacgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttggccattctcgcgctgggaataaaggactcgaacctttgcatcctggaatcaaaatccagtgccttaccaacttggctaattcccaattattaacaaaggctcttaagcaagaacccttgatgatagagggtattaatcagtgcgatatgagttaataataacaaataattcttaaagcatatttaccatttataataatacatatttacgatgcattcaagacccaaaggattcttgaaaatatcatattcaagaggacctttttctgtttcaataaagaaatcaaaatttactgtattaaatttacgttcttccttcactaatttaacttgagaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaaaacattttctgccgtagtcaataatccgcatataaatccaacaaacattgaaaaactgaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttgtagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactcttgaataacatatagtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgcccttcgtcatcaaaaacaaacacacctttaattgggcttttaccattaagatagcaaaatgcttgttccataatcgtgattacttctaatttagttagatttaaattagtctcacgatcatagtcaattccttcaaactctttacgagttaagcaaggatagtcggtatttgctgcaaatactccccatgcataagccaatgcatccttaataggaccagcaagttggtatttaactgcagaataattgctcatgataaaatcagcagtagtatcttttccactacgctttacaccgcttaaaaagattagtttcatatgtttctcctcaaatttagttaagattataacacatgaaactgaagcattaaacttccgctataatttttccatctttttctacttgaaaatacgtataaggaatcgttgctgtacatactaaagccgggtctgaatcttctgtgtagctaaattctacttcagacaggtcagaaacccaaggcttataaaaatttattgacatcacgatttcagttttgctattatctaaaatgtaaagcgtaatgtattcaggacctgttttttgggcagtattttcacctgtaagatagttgctagttcctagcatccattcatacattcctatccatgacttaagttcttcatcaactataaatctcacgatgagtggatcgtactcaaatgtagcacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataactgttggtggtataatgggtctaagtcccttccattcaattccatttagaacaaacaacagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccaggtatatatgccttaatcatttggtctgcacccctaaatcctttcacttgactccaatcaatttttaatttcgttttattagtaatagtaggtgtatttgcatattgctttaaaagctcttctagaaactgttgacgagctttaggtggaatatagtgcaagttcaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcgcgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgattcctctttcttcagcaaattgctttccggtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgttaaaattctaaattttattccacgcttttcagctaaagcttgagctgctttccatttgtcagtattaacggaatatgtataaatttcattcataaatcttttcttcgctgcagttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgtcgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctgggggttctggcagtaattctaggtcatcctctgatactactgaaccgacggatcctcctgctccagtaagaaaaactctagttaaaaattacacaaaaactatagttggaaattggagtcgttgggctaataaattaagaagctatgtgtatgagaggtcatagatgtcaggattaagttatgataagtgtgttactgctggccatgaagcatggcctccaacagttgtgaatgccacacaaagtaaagtattcactggaggaattgctgttctcgtagcaggtgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacgtttgctgaaataaaacaaaacctcattgaatggcttaatggccaaaatgaatttttggattatgattttgaaggctcaagattaaacgttctgtgtgaccttttggcttataatacattgtacattcagcagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattacaattcctcgcggaactcgctttttagcatatgcaaaagatacttctgttaatccatataactttgtatctaccgaagatgttattgctattcgtgataaaaataaccaatattttccgcgtttaaaattggctcagggacgtatagtaagaactgaaatcatttatgataaattaacacctattatcatttatgataaaaatattgatagaaaccaggttaaattatacgttgatggagcggaatggattaactggacaagaaagtcaatggttcatgctggttctacatcaacaatttactacatgcgtgaaactattgatggaaacactgaattctattttggcgaaggtgaaatttccgttaatgcttctgaaggagctctaactgctaactatattggaggtcttaaacctacccagaactctacgattgttattgagtacatcagtactaatggtgctgacgcgaacggagcagtcggattttcatacgcagatacattaacaaatataactgtcatcaatattaatgaaaatccaaacggtgacccagattttgttggggcagatggcggcggtgatccagaagatattgagcgtattcgcgaattgggtactattaaacgcgaaacccagcaacgctgcgtaactgcgactgactatgatacattcgtttcagagagatttggttctattattcaagcagttcagactttcactgattctactaaacctggttatgcatttattgctgctaaacctaaatcaggtctgtatttaactactgtacagcgcgaagatattaaaaattatctcaaagactataatttagctcctattacgccatcaattatttctcctaattatctttttattaagactaatttaaaagtcacatatgctttaaataagctgcaagaatccgaacagtggctcgaaggtcaaataattgataaaattgatcgttattataccgaagacgtagaaatttttaattcatctttcgctaaatctaagatgttgacatatgtagatgatgcagatcattctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgatgttcgtatagtatcaacagaccgagattctaaaggaattggtaaagttattattggtccatttgcttctggcgatgttacagaaaatgaaaacattcagccatatacaggcaatgattttaataaattagcaaattctgatggacgcgacaaatactatgttatcggtgaaataaattatccggctgacatgatttattggaatatcgctaaaattaatttaacatctgaaaaatttgaggttcagactattgaattatattctgacccaaccgatgatgttatctttacccgtgatggttcactgattgtatttgaaaatgatttacgtccgcaatacttaactatcgatttggagcctatatcacaatgacagtaaaagcaccttcagtcactagtctcagaatttccaagttatccgcaaatcaggtgcaagtacgctgggatgacgttggtgctaatttctacaaaatagtagaaatcgctgagacaaaaacagactcgggggaaaatctcccgagtgatcaatatcgttggattaatttaggatatacagcaaacaatagtttcttttttgatgatgctgatccactaacatcatacattatcagagtagctacagctgcacaagattttgagcaatctgattggatttataccgaagagtttgaaacttttgctacaaatgcttacacatttcaaaacatgattgaaatgcaattagccaataaattcattcaggaaaaatttactcttaacaattctaattatgtcaattttaataatgacactataatagctgcattgatgaatgaatcgttccaattcagcccatcatatgttgatgtttcatcaatcagtaattttattattggtgaaaatgagtatcatgaaatacaaggttccattcagcaagtatgtaaggatattaaccgagtttatttgatggaatcagaagggattctatatctttttgagcgttatcaacccgtggttaaagtatctaatgataaaggacaaacctggaaagctgtgaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagtaatgcacctatagattctgacccgttatcaccaacatactcggaaagactttttgaacctgatacaatgactataactggaaatcctaaagcagtatgctataaaatggattctatcggtgataaagtttttgctcttattattggtgaagttgaaacattaaatgccaatccgagaacttcaaaaataattgattctgctgataaaggaatatatgttttaaatcatgacgaaaaaacatggaaaagagttttcggtaataccgaagaagaaagaagacgtattcaacctggatacgcaaacatgtcaactgacggtaaattagtttctctgtcttcgagtaattttaaatttttaagtgataatgttgttaatgaccctgaaactatggtgaaatatcagttaatcggtgctgttaaatatgaatttccccgtgaatggttagctgataagcattatcatatgatggcatttatagcggatgaaaaatctgattgggagacttttactcctcaaccaatgaaatactacgcagaaccgttctttaattggtctaaaaaatctaacacacgctgttggataaacaactctaatagagctgtagtagtttatgctgatttaaaatacactaaagttatagaaaatattccggaaacatcaccagatagattagttcatgaatactgggatgatggtgattgtacgatagtaatgccaaatgttaaattcacgggatttaaaaaatatgcgtctgggatgcttttttataaatcttctggtgaaataatttcttactatgattttaactatcgtgtgagagatacagtagaaattatttggaagccgactggagtatttttaaaagcatttttacaaaaccaagagcatgagactccttggtcaccagaagaagagcatggattagctgatcctgatttaagaccattaattggcacaatgatgcctgattcttatttgttgcaggattcgaattttgaggcattttgcgaagcatatattcagtatctttctgatggatatggaactcagtataacaatttacgaaatttaattcgtaaccaatatccacgagaagagcatgcgtgggaatatttgtggtcagagatatataaaagaaacatttatttaaatgctgataaacgtgatgctgttgcgagattctttgaatcacgtagctatgatttttattctactaaaggaattgaagcatcatacaagtttctttttaaagttctttataatgaagaagttgaaattgaaattgaatctggggccggtactgaatatgacataatcgttcaatctgattctttgactgaagatttagtaggacaaacgatttatacggcaacaggaagatgtaatgttacttatatagaaagaagttattctaatggtaaattgcaatggaccgtaactattcataatcttttgggaagattaattgctggtcaagaagttaaagcagaaagactccctagttttgaaggcgaaattattcgtggagttaaaggaaaggatttgcttcaaaacaatatagactatattaatagaagtagatcatactatgtaatgaaaattaaatccaatttaccttcttcccgctggaaatctgacgttattcgttttgttcatccagtaggatttggatttatagcaattacccttttaacgatgtttattaatgttggtttaactcttaaacacacagagacaataattaataaatataaaaactataaatgggattctggattgcctactgaatatgctgatagagtagctaaattaactccaaccggtgaaattgagcatgattcagtaacaggcgaagcaatttatgagcctggcccaatggctggtgtagaatatcctcttcctgatgactataatgctgaaaataataattcaatatttcaaggtcaattgccgtctgaacgacgtaaattaatgagtcctttatttgatgcatctggaacaacatttgcgcaatttagagatttagttaataaacgtctaaaagataatataggaaatccaagagaccctgaaaaatccaacacaggttaaaatagatgaatgattcaagtgttatctatcgtgcgatagttacttcaaaatttagaacagaaaaaatgttgaatttttataattcaattggaagtggtccggataaaaacactatctttatcacatttggaagatcagaaccgtggtcatcaaatgaaaatgaggtgggctttgccccaccttatccaaccgattctgtattaggcgtaactgacatgtggacgcatatgatgggaacagtaaaggttcttccatcaatgcttgacgcagttattcctcgtcgagattggggagatactagatatccggatccatacacatttagaattaacgatattgtagtgtgtaactcagctccttacaacgctactgaatcaggcgcaggctggttagtatatcgttgtttagatgttcctgatactggaatgtgttcaattgcatctttaactgataaggatgaatgccttaaattaggcggaaaatggacaccttctgttaggtcaatgactcctcctgaaggtcgaggagatgctgaaggaacaattgaacctggggacgggtatgtatgggaatatctttttgagattccacccgatgtatctataaatagatgcacgaatgaatatattgtggttccttggcctgaggaattaaaagaagacccgactagatggggatatgaagataatctcacttggcaacaagatgattttggattaatttaccgggttaaggcaaatactatccgttttaaagcatatttagattcagtttattttcctgatgctgcattgccaggaaataaaggatttagacaaatatcaataatcacgaatcctcttgaagctaaagctcatccaaatgacccaaacgttaaagctgaaaaggattattatgacccagaagatttaatgaggcattcgggcgaaatgatttatatggaaaataggccacctattattatggcaatggatcaaacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcagcgtaaaatggcagtagcaaatggcactggagcagatggtcaaattatccatgctactgggtattatcaaaaacactctattacagagtacgcaactccagtgaaagttggcactagacatgatattgatacctctactgtaggtgttaaagttattattgaaagaggcgaactcggcgattgtgttgaattcattaactctaatggatcaatatcagttactaatcctttaacaattcaagctattgattcaattaaaggtgtttcaggtaatttagtagtaactagcccatatagtaaagtaactttacgctgtatttcatctgataattctacatcggtttggaattattctattgaaagtatgtttggacaaaaggaatcaccagctgaaggtacatggaatatttctacatccggatcagttgatattccactatttcatcgcactgaatacaatatggctaaattgttagttacgtgccaatcggtagatggaagaaaaattaaaacggcagaaataaatattcttgtagatgctgttaattcagaagtcatttcttctgaatatgctgtcatgcgagttgggaatgaaactgaagaagacgaaatcgctaatattgcatttagtattaaaacaaattatgtaacagcgactataagttcttcaactgtcggtatgagagcagcagttaaagttatcgctacgcagaaaatcggggtggctcaataatgaaacaaaatattaatatcggtaatgttgtagatgatggtaccggtgactacctgcgtaaaggtggtataaaaataaatgaaaactttgatgagctttattacgagcttggtgatggagatgttccatattcagccggtgcctggaaaacttataatgcttcatcaggacaaacattaacagcagaatggggaaaatcatatgctattaacacttcatctggaagagtaactctacaacttcctaaaggaaccgttaatgattataataaagtaattaaagctagggatgtatttgcaacatggaatgttaatccagttactctagtagccgcttctggtgatactattaaaggatcatcgtcatcagttgaaattaatgttcaatttagcgatttagagttagtttattgtgctccaggacgttgggaatatgtcaaaaacaaacaaattgataaaattattagttcagatattagtaatgtagctcgcaaagaatttttagtagaagttcaaggacaaactgactttttagatgttttccatggaactagttataatgtcaataacatcagagtaaaacaccgcggtaacgaattatattacggcgatgtatttagtgaaaacagtgactttggctctccgggggaaaatgaaggagaattaattcctcttgatggatttaatattaggttaagacagccttgtaatattggcgacactgttcaaattgaaacgtttatggatggtgtatcacaatggagaagttcatatacaagacgccaaataaaagtgctagattcaaaactaacatcaaagacttctttagaaggaagcatttatgttactgatttatcggcgatgaaatcaattccattttcagcttttggattaattcctggcgaacccattaatcctaattctcttgaggttcgttttaatggaattttacagcaacaggctggaacagctgggtatcctctgtttttgtgcgaaggcgctaattcagatacgcaagaaggatgtatatctcttggtggcgaatggaaagaatcaaacacagattattctatagaatatgaagatggaaaacctgtcagtcttttatttgatagaaaatttgaatcaggtgatataatcgttataacatggtttaataatgatttaggaactcttttagaaaaagatgacattattgaattaactgatgaccgttatgttagtaaaggatcatctactgaagttactggggatgtagccttaacagattttgataaaatcggttggccaaatgttgaaaaagttgattcttatactagaacgtataattcaatatcatctattttcgacagcatttatcctgttggttcaatttatgaaaatgctataaacccaaataatccggtgacttatatgggatttggttcatggaaattatttggtaaaggacaagttttagtaggatggaatgatgatgttacggatccaaactttgctttaaacaataatgatttagattctagcggaaatccttcacatactgccggtggaacagttggtacaacatcagtaacgcttgaaaacgcaaatcttcctgcgactaaaactgatgaaagagttttaattgaagacgaaaatggatcagttattattggaggatgtcaatatgacccagacgaaactggtcctatatatacaaaatatcgtgaagactacgcaacaacaaactcttcacacactcctcctactaatattagtaatattcaaccgtctattactgtataccgttggataaggattgcataatgagtttacttaataataaagcgggagttatttcccgcttagcagattttcttggttttagaactaagaaaaatgatatttcggttatgaataatcagccggtaggcgctgtaacaatttcacaaatagcaaaaggtttttatgactcaaatgtagaatctgctatcaatgatgttagaaatatggcagagcaacaggttggagctgtattaattaatataagcggcgtatctcctactggcgtgcaacaaaccgactattggtcatttgaaggaactgttactgatacttcagccaaaccaggtgacccagttattgttaacatgtttggtattccagttaaagctactaatggaatgacttcaattgaatttactagtgctgttagaacagctctacaggaaatggttgtaaaatttattgcaattgattcatttgaagaccatcctaccatagggaataaaatacaagttaagtatttagataaccaagaacatatcttagaacaatactctgataaaggaattactttcaaacaagaaataatttctccttctaaacccgggtatggaacttggcaattattaggtgcgcaaactgttacgctagatagtcacacacaacctacagtattttattattttgagagaatagcatgagtaacaatacatatcagcacgtatcaaatgaatcaaaatatgttaaattcgatcctactggatcgaattttcctggcactgttacgacagtacagtctgcattatcaaaaataagtaatatcggcgtaaatggtattcctgatgcaactatggaagttaaaggaatagcaatgattgcatcagagcaagaggttttagatggaacaaataattctaaaatcgttacaccagctacattagcaacaagattattgtatccaaatgctactgaaactaaatatggtttaacgcgctattcaacaaatgaagaaacattagaaggctcagataataattcatcaataacgccgcaaaaactgaaataccatactgatgatgtgttccgaaatagatattcatctgagtcatcaaacggggttattaaaatatcatctacgcctgcggctttggctggtgttgatgatactacggcgatgactccgctaaaaacccaaaaactcgcaataaaattaatttcacaaatagctccttccgaagatactgcatcagaatctgtgagaggtgtggttcaattatcaactgttgcgcaaactcgtcaaggaactctccgcgaaggatatgcaatttctccgtatacctttatgaattctgttgcaacacaagaatataagggtgttatacgtttaggaacacaatcggaaattaacagtaatttaggagatgttgcagtaacaggtgaaacactaaatggtcgaggagctactggttctatgcgtggagtagttaaattaacgacgcaagccggtattgcccctgaaggtgatagttctggagcattagcgtggaacgcagatgtaattaatacgcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggcgattggaataatcctggcgttcctgatatgcggggtcttttcgtcagaggagctggcacaggcggtcatattttaaatcaacgaggacaagatggttatggaaaggatagacttggcgtaggatgtgacggaatgcatgttggtggtgttcaagcacaacaaatgtcataccataaacacgccggtggttggggggaatatagcagaagtgaaggcccatttggcgcgtctgtttatcaaggatatcttggaattagaaaatatgccgactgggataatgcttcatacttcactaatgatggatttgaattaggcggaccgagagatgcccttggtacacttaatcgtgaaggattaattggttatgaaactagaccatggaatatatcattaaactatattattaaagttcattactaaggattacaaatgattgaattaaaagatttaccttttgttgatagcgttcctgatgaaggtcaggaacgtatttcatggattaaaaatggtgaagaaatactaggagctagcactaagtatggaaacgatggatcaatgaatagaccaattgtttccgtgtttaaaaatgttgaggttcttgacgaaaatataggaattcttaaaactgccattgaaacatcgcagaaagatattaaaacaattcaaggagttttagatgtatcaggagatatagaagcactatcgcagatcagtgttaataaaaatgacatatcaaatttaaagacacttactaatgaacacactgatatattaactggaactaataatacagttgacaaaattattgctgatataggtccatttaatgatgaagaaaactctgtttatagaacaattagaaatgatttattgtggattaaacaagaactagggcaatattctggccaagacattaacggtcttcctgttgttggtaatgctagcacaggaatgaaacatagaataataacaaatagtacattattatcttcacaaggcattcgtttaagtgaattagaaaataaatttactgaatctgacgtaggatcattgacggttgaagttggtaaattacgcgatgaacttggtaataaaccagtagattttggaccaaatatttataatagattaaacactatagatgataaacaaactttaataaattctgatatagcagaaattaaatcttctattggatacccagaaaatgtttctataataacagaaattaataataacaaaagtagcattgaatctattaataatgaattaaatcagagtgaaggtgttaaacagcgcttaacggctattgaaacttctataggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctataaaaacgaatgaaactaacattgcggcagtcacgcatgaagtaaatacagctaaagacaatatatcctctttacagagcagcgttcaagctctacaagaagcgggttatattcctgaagctccaaaagatggccaagcttacgttcgtaaagacggcgaatgggtactactttctacctttttatcaccagcataacatggggccgcaaggccccaaaggattttaaatgtcaggatataattctcagaatccaaaggaactcaaagatgtcattctaagacgtttaggggctccaattattaatgttgagttaacacccgatcaaatttatgattgtatccagcgtgccctagaattatacggtgaataccattttgatggacttaacaaaggttttcatgtattttatgtaggagatgacgaagaaaaatataaaactggagtcttcgatttaagaggttcaaatgtattcgcagtaactcgcattttgcgaacaaatattggatcaataacgtcaatggacggaaacgctacatatccatggtttactgattttcttttaggaatggctggtattaatggcggtatggggacttcttgtaatagattttatggaccaaatgcctttggagctgatttaggatattttacccagcttaccagttacatgggaatgatgcaagatatgctctctcctattccagacttttggtttaattcagcaaatgaacagctcaaagtcatgggaaacttccaaaaatatgatttaattatcgtagaaagctggactaaatcatacattgatactaataaaatggttggaaatacagtaggatatggaacagtcggtccacaagatagctggtcattatctgaacgatataataacccagaccacaatttagttggtcgtgttgttggtcaagacccaaatgttaaacagggtgcttataataatcgttgggtgaaagactatgctactgctttagctaaagaattgaatggtcaaattttagcacgccaccaaggtatgatgcttcctggcggtgttacgattgatggacaacgcttaatagaagaagctcgattagaaaaagaagcattacgtgaagaattatacttgctcgatcctccatttggaattttggtaggttaatatggctacttatgataaaaatctttttgctaaattggaaaaccgcactggttattctcagaccaatgaaactgaaatactaaatccttatgtaaatttcaatcattataaaaacagtcaaatattagctgatgtattagtagctgaaagcattcaaatgcgaggtgtagaatgctattatgttccaagagagtatgtttcccctgatttgatatttggcgaagacttaaaaaataaatttactaaagcttggaaattcgctgcatatttaaattcatttgaaggatatgaaggagctaaatcgttctttagtaactttggtatgcaagtacaggatgaagttactttgtccattaatccaaacttgtttaaacaccaagttaatggaaaagaaccgaaagaaggcgatttgatatattttcctatggataacagcttatttgaaattaactgggttgaaccatatgatccattttatcaattaggtcaaaacgctattcgtaaaattacagcaggtaaattcatttattctggagaagaaattaatccagttctacagaaaaatgaaggaattaacattccagaatttagtgaattagaactaaatcctgttcgcaatcttaacggtattcatgatattaatattgatcaatatgctgaagtagatcaaattaattctgaagctaaagaatatgttgaaccttatgttgttgtcaataacagaggcaaatcttttgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcgataaattcacaagaagatgtggccaaggttgaaactattctacctcgtataaatttgcatttagttgattttagctataacgctccatttaaaacaaacattttaaatcagaatttactgcaaaaaggtacaacttctgtagtatcgcagtataatccatctcctattaaaatgatttatgaattgagtatctttactcgttacgaagacgatatgtttcaaatagttgaacagattcttccatattttcaacctcattttaatacaactatgtacgaacagtttggaaatgatattccatttaaaagggatattaaaattgtactgatgtctgctgctatagatgaagctatagatggagataatttatctcgtcgtagaatcgaatggtcactaacatttgaagtaaacggatggatgtatcctccagtagatgatgcagaaggattaattcgtactacttatacagattttcacgccaatacaagagatttgcctgatggcgaaggtgtttttgaatctgttgatagcgaagttgttcctcgagatattaacccagaggactgggatggaacagtaaaacaaactttcactagcaatgtaaatagaccaacaccgccagaacctcctggcccaagaacatagaggttattatggaaggtcttgatataaacaaacttttagatatttctgacctccccggaatcgacggggaggaaattaaagtatatgaacctctacaattagtagaagttaaaagcaatcctcaaaaccgtactcctgacttagaagatgattatggagtagttcgtcgaaatatgcattttcaacaacaaatgctaatggacgcagccaagatttttcttgagacggcaaagaatgctgattctcctcgtcacatggaagtatttgcaactcttatggggcaaatgactacgacgaacagagaaatactgaagcttcataaagatatgaaagatattacatctgagcaggttggcactaaaggcgctgttcctacaggtcaaatgaatattcagaacgcgacagtattcatgggttcaccaacagaattaatggacgaaattggtgatgcttacgaggctcaagaagctcgtgagaaggtgataaatggaacaaccgattaatgcattaaatgatttccatccattaaatgaagctggaaaaattttaataaaacacccaagcttagcagaaagaaaagatgaagatggaattcattggataaaatcacagtgggatggaaaatggtatcctgaaaaattcagtgattatcttcgtttacacaaaatagtaaaaatcccaaataattctgataagcctgaattatttcaaacttataaagataagaataataaaagatctcggtatatgggtcttcctaacttaaaacgagctaatattaaaacacaatggactcgtgaaatggttgaggaatggaaaaaatgccgagatgatattgtatattttgcagaaacatactgcgccattactcatatcgactatggtgtcataaaggttcaattacgtgactatcagcgtgatatgctcaaaataatgtcatctaaacgtatgactgtttgtaatctatcacgtcagcttggtaaaacaactgtagtagctatttttcttgcacactttgtatgttttaacaaggataaagctgtaggtattcttgcgcacaaaggctcaatgtctgcggaagttttagaccgtactaagcaagcaattgaactgcttcctgactttttacagcctggtatagttgaatggaataaagggtctattgaactagataatggttcttcaattggcgcttatgcttcctctcctgacgcagttcgtggtaactcattcgcaatgatttatattgacgaatgtgcatttattccaaacttccatgattcctggcttgctattcaaccagtaatttcatctggtcgtcgttcaaaaattattattactacgactcctaatggattaaatcatttttatgatatttggactgctgctgttgaaggtaaatcaggatttgaaccatacactgctatttggaattcagttaaagaacgtctttataatgatgaagatatttttgacgatggatggcaatggagcatacaaaccattaatggttctactttagcacaattccgtcaagaacataccgcagcgtttgaagggacttctggtacattaatttcaggaatgaaattggctgttatggatttcattgaagtaactccagatgatcatggttttcatcgatttaaaggacctgaaccagatagaaaatacattgcaactttagactgttcagaaggtcgtgggcaagattaccacgctttacatattattgatgttaccgatgatgtgtgggaacaggttggtgttttacattcaaataccatttctcatttaattctgcctgacatcgttatgcgttatttagtagaatataatgaatgcccagtttatattgaattaaatagtactggtgtgtcagttgcgaaatcactttacatggatttagaatacgaaggcgttatttgcgattcatatactgatttaggaatgaagcaaactaaacgaacgaaagcagtaggatgctctacattaaaagaccttattgaaaaagataagcttattattcatcaccgtgcaactattcaagaatttagaacgtttagtgaaaaaggcgtgtcttgggcggctgaagaaggttatcatgacgatttagtaatgtctttagtaatttttggatggttatcaacacaatcaaaatttattgattatgccgacaaagatgacatgcgattagcatctgaagtgttttcaaaagagcttcaagatatgggggatgaatacgctccagttatatttgttgattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaacgaagtagatttagttaatacttttggtcaacctacagctgaaactgctgactattttatgtctgcaatgaatttcttacaatatggaaatgatttgcgagttgtgcgcgctgtcgatagagataccgctaaaaactcatctccgattgctggtaatattgaatacacaatttctaccccaggtagtaactacgcggttggagataaaatcacggtcaaatatgtttcagaagatgttgaaacagaaggtaaaattaccgaagtagatgctgatggaaaaattaagaaaattaatattcctactgcaaaaattattgctaaagctaaagaagttggcgaatacccaacattaggttctaactggactgcagaaatttcttcatcttcttccggtttagctgcagtaataactcttggaaaaattattactgattccggtattttattagctgaaatcgagagcgctgaaactgctatgacagcagttgattttcaggcaaatcttgaaaaatatggaattccaggagtagtagctctctatccaggcgaattaggcgataaaattgaaattgaaatcgtatctaaagctgactatgcgaaaggcgcttctgcattactgccaatttatccaggtggtggtactcgtgcatctactgccaaggcagtatttggatatgggccgcagactgactcacagtacgctattatagttcgtcgaaatgatgctattgttcaaagcgttgttctttcaactaagcgtggtgaaaaagatatttacgatagtaacatctatattgatgactttttcgcaaaaggtggttcagaatatattttcgcaactgcgcaaaactggccagaaggcttctctggaattttaactctgtctggtggattatcatcaaatgctgaagtaacagcaggagatttgatggaagcttgggacttctttgctgaccgcgaatctgttgacgttcagttgtttattgcgggttcttgtgccggtgaatctcttgaaacagcatctactgtccaaaaacatgttgtttcaattggtgatgctcgtcaagattgcttagtattgtgctcacctccgcgtgaaactgtagttggaattcctgtaactcgtgcagtagataatttagttaactggagaactgcagcaggttcatacactgataataactttaatatcagttcaacctacgcagcaattgatggtaactacaaatatcagtatgacaaatataatgatgtgaatcgttgggttccattagcagctgatattgctggtttatgcgcaagaactgataacgtatctcagacttggatgtctccagctggttataatcgtggccagattcttaacgttattaaacttgctattgaaactcgccaagctcagcgcgaccgtttataccaagaagctattaatccagtaactggtacaggtggcgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccaatacttacagggaattaaagctctcggtggaatttatgaatatcgtgtagtttgcgatacaacaaataacactccgtcagtaattgatagaaatgagtttgttgcaacattctacattcaaccggctagaagcattaactacattaccttgaacttcgtagcaactgctactggtgcagatttcgatgagttaactggtcttgctggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagtcggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagagcgctattgttcgtcaatatgctcgtgatgctaaaacagtaacaaaagaaattgaaattaaaggtctgtggcctactaacgtgggtgaacttcaattagattgggattcaaacaatgaaatccaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtagataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggtgctgataatactggcaatatggaagatattcgttggtttagacaagctctttacatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccacttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtaccaatgcttgaatctcatgatggaaaagacttaggtttaaaaccgggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccacggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgaacacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgccgcaggtcagacttctggcgcagtaactcagattggaccagctgttatgggtatggtacgtcgtgctattcctaacctgattgctttcgatatttgtggtgttcagccaatgaacagcccgactggccaggtattcgcgctgcgcgcagtatatggtaaagatccaatcgcttccggcgctaaagaagcattccacccaatgtatggtccagatgcaatgttctctggtcagggtgctgctaagaaattcgctgctttgaaagcaagtgatactcttgaagtcggaactatttacactcacttcttccaggaaactggtacagtatatctgcaagctacagcagctaaacaaattgattcaggcgcatctgacgcagacaaattagatgctgaaattaagaaacaaatggaagctggtgtactggtagaaatcgctgaaggtatggctacttctatcgctgaacttcaggaaggtttcaacggttctaccgataacccatggaatgaaatgggcttccgtatcgataaacaagttatcgaagctaaatctcgtcagctgaaagctgcttactctattgaattagcacaagaccttcgcgctgttcacggtatggatgctgatgctgaactgtctggtattctggctaccgaaattatgctggaaatcaaccgcgaagttgttgattggattaactactccgctcaggttggtaaatctggtatgaccctgactccgggttctaaagctggtgtatttgacttccaggacccaatcgatattcgtggtgctcgctgggcaggtgaatcctttaaagctctgttgttccagattgacaaagaagcagttgaaattgctcgtcagactggtcgcggcgaaggtaacttcattatcgcttcccgtaacgtagttaacgttctggcttcagttgataccggcatttcttatgctgcacaaggtctggctactggctttaacactgatactaccaagtcagtatttgctggtgttctgggtggtaaataccgtgtatatatcgaccagtatgctaaacaggattatttcaccgtaggttataaaggtccgaacgaaatggatgctggtatttactatgctccatatgtagctctgactccgctgcgtggttctgatccgaagaacttccaaccggtaatgggattcaaaactcgttacggtatcggtatcaacccatttgcagaatccgctgctcaggctccggcttctcgcatccagagcggtatgccttctattctgaatagccttggtaaaaacgcttacttccgccgtgtatatgttaaaggtatctaatctttgacgatttaagggaccttcgggtccctttagttgtttttatggtataaataaatcatataaactgaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaattggtgctacttacgccggcgaagctggatatgtagaccgagaacaaatcacagaattaacagaagagtctaaattaactctcaataagggcgatttattcaaatataataatatcgtttataaagtattagaagatacaccatttgctgatattgaagaaagcgatttagaattagctcttcagattgcaattgttcttttaaaggttcgtctattttctgacgcagcgtcaacaagcaaatttgaaagctctgatagtgaaattgcggatgctagattccagattaataaatggcaaaccgcagttaaatctcgtaaacttaaaactggtatcacagttgaattagcacaagatttagaagcaaatggattcgatgctcctaatttcttggaagatttgcttgcaactgaaatggcagatgaaatcaataaagatattctgcagtctttgattacagtatcaaaacgttataaagttacaggaattactgatactggattcattgatttgagttatgcatctgcacctgaagctggtcgttcattataccgaatggtatgtgaaatggtttcgcatatccaaaaagaatcaacttatacggcaacgttctgtgttgcttcagctcgtgccgctgcgattcttgctgcatctggttggttaaaacataaaccagaagatgataagtatctttcacaaaatgcctacgggttcttagctaatggtttaccgctttattgcgatactaacagcccattagattatgtaatcgttggcgtagtagaaaatatcggtgaaaaagaaattgttggatcaattttctatgctccgtatacagaaggtctcgacttagatgaccctgaacatgtaggtgcatttaaagttgttgttgatccagaaagcttgcaaccgtctatcggtttattagttagatatgctttatctgcaaatccttacaccgtagcaaaagatgaaaaagaagcaagagtaattgatggtggagacatggataaaatggcgggccgttcagatttgtctgttttattaggtgttaaattaccaaaaattatcattgatgaataaaacaaagggaccgaaaggtccctttttatttagctcaccaactcaatccaagccggacgaagtacatcttgtaccattttaactaattcctttttaatcaaagaaggattatctgcttgagttaaagtaataccttcacgagaagtttcttccaaaatatcttgaacagttagccccattacctttccaaaatcttttggaccaatttcgccaattttggaaataacgttatttactcggttcaatgtaacataacaagctaaaattccaaccaatttattatcagcttctgacaattcaactttagctttaataggcttatcagactttttcttttcactaaatttagaattcttgcatttgatggctacacgatttccattatgaagccaagaaggataacaaggtttcaatacatatccttcagcggtaaatacttcgcctttggcttcagctttccaaacacatttgttagcgtcaattaaacctgcattatctacggtaaaattataagacggaacaacagaatccaaatcatttggaagtttaataagatcttcaaatttaccacgacccaaaagtggagcgattttaaacccaaatgaattacaaaacgattccatcatgtaatcatcaacataagttacatcaccactttcggtagtaacaataatatcaaacacgtaaaaatctttattaccataatcaacatttttctgaataccaggaccagcaaattcgccaaatacctgataagtcacaacagctgaagtttccataatatcttgtactgctttaatggaatcagcgtaattctttagaataatttcatacccaaagaaatcttcagcaggaagaatcggtccagtacgtttagcgcaagttactttatcacgctcaataatcaatgagaaatttgtgccgtgaatcttttcacgagctacccattcgccgccagtcaatcctaagctataaagtttttcaataaatttagagttgtaatgattttcaagactgctatactttttaaacataattaatcctcaaaatgtaatttctaaccaatcaccatcacgctgatcactattaactttaaagatgaatccttcttttctcagccaatcaccaatttcttcagtaatcaatttatcacgagcagtacaataataactaaaatatgttttaccttgttcagctgctttattagcaagttccgaaaaatctttaataaaacactctagtttaaactgtttgcttttaagtgctttttcgcgtaatcgattagcaaaagattcattttcataaagatcatactgttccatttttcacctttttattgatatgtctttttctatagacaactttttctcgagtttcaaatttattcttagcagtcatagctcgagcccataatacagccacttcttttgcctgtaagttcaattcacgagcaatttcaatgaatgactttccagactcatgaagagtaaacaccacaacctcagttctcataatcaatctcatgttatcgagttggtgccattatatacatcattttctgattgtgttttgtgtgctttcaaaatgaagaaaggggccgaagccccttatgattatggataggtatagatgataccagtttctaaagcagttttatgaatgatgtatccattacgtgattcttgaacatcaacttctggatagtctttcatcatcttctggagagtgtaacgatgcaagtagtacttactatctggatcgtcagttttccaatctttaccttcttcggtcattttttggatttcatccataacccaccaaccacaccagatgtaagctgaagtacgatgtggaagaggatgaacataaggtaattcaccttctggttctggagcaactttatcagttacctgaacttgaccttctgctgtaatagttttgctatcatagtcagtagcagtaacagttgcagtaacttcaatagtttgacttccaatagatgaggtatcaactgtatacacattagtcgatccttctacaggagaagagtctttcttccatgaataagtaatttgcgcttcttctggagcatcagtgacattagcagtaaatgtagccgaagcatcttgttgaacgttaatagaaggaggagtcaatgtaacctgtggattcattgtcttcttattaactgttaatgatacttcattcgaagtaacttccttttcattgtaattttcagcagttacttgggctacgcatttaattctttttactccacttgtagttggagtatagctaaatgtagagttagtttctccaccaacttgtgaatcatctacataccactgatacgtagcagatgctccatcaggttgagaaactaaggcagcagtaaattgaactggtgttccaattactccagctgaaggactatcgggagttactgccaaagtagttgtctgtgtctttttattaacagtcaatgacacttcattagaagtaacttcttttgcatcataatctgtcgcggttacttgagccacacacttaattctttttaccccgctttcggcaggagtgtaattgaacgtagcgttagttgcttcgcccacaggagaatcatctacataccattgataagtagcgtttgcgcccgatggctgcgaagctaaagcggcagtaaattcaatagctgttccgattactccagcgtcagggctattaggagttacagctaaggtagtcgtttgtgtcttattttgaactgtgatagttgtcgcttcagccgtttccgggcctccttcagaaagtgtatttgttgcaactactttaatagttttctggcctgcaggtccttttagtacataactaaaagttgcttcagctccatcttgtggagcatcatctacagtccaagcataggtaatagttccgcctccagtttcaccactgggtgtagcagtaaactgctgagtctgatcgatcacccctgtaggtgttttaggagttatatcaactgtaaaagccataagttatcctcatttaccacggtggatgtcgatgtgacgtttcggggtaacaacagagatgttgtccatgtcgtaaacaccaccgttctgagagatcggtttttcgtggtgcagttcgaaagaggtacgtttaccagaaacgtcctgggtacgggttttcggagctttaccaactttcatacggtcgttgttgttacgagagaactgtttagacagttccgggtctttagaaacttcttcccagaattttttacggaagtcgtcgaaagatttgaattctttgtcacgcagtttgttagcgatacggtccggaaccggagaacccaggtctttaccagcgttgttcagccatttgttgttaaccggtttacctttaccggtagctttacccggtttgttacgtttagattctttgtccagtttagctttagcgtctttttctttgttttctttctgtttacgacgttccagagcagaagacagagcaacgtcagcgtcagatttttctttagcagcagcgtcgaaagcagcttttttgttgttaacgtcggtctgagcacgctgagctttcagaccagccatctgccacatacggtgaccagcagccatcggttcacgagcgaaacgttcgaactgtttgatttcagctttagcgtcagccagggttttgttagcagcgtccagttcagatttacgagagttgtaaacctgaacagctttagcctgacgttcctggttacgagcaacgtctttgttagcctggttcagttcagcacgagcctgttcgtagttacgttcagcaacttcaaccgggtgagcgtcgttccattcctgctgcagacgtttttcttcgtcctgacgctgtttaacctgagccggggtcagaacgtcggtaacagaaacgtaaaccggtttctgaccagattctttcgggaaacggataacagcttcgtgagaaccaccaccgaaggtgaaaccagccggaacagcggtacgacctttgtcttcggtgataccacgcggcagggtggtagaaaccggcagacctttaacggtagaaacggtcagagacggaacacccgggaaagaagcgtggaaaacacccggggtacgggtcggtttagcgttaacaaccggaacagacatcggaacaccagcaacaacagcgatgtgctgacgggtgtctttaacaacgtcggtaacacgtttggtaacagaaacggtagcctggtccagcggcagggtagaaacctgaacgttggtaacggtttcagccggcagagaggtaacgattttagacatcatgttcgggtcgtctttagcgatttcagacggcaggataccgtacagagcgataccccaagcagagaatttgaacggacctttcagagcagcgaagatgtcagcgatagcagcagacagagcttcaccagaaacagagatacccagggtaccagcacccggagcagccagagccgggaaaccgaaagccatcggagcagcaacagaagagttagaaccaccaccagagttagagttaccaccaccgttaccgtgacctgaaccaccaccccagtgaacaccagaaccagaaccaccaccccacgggttgttttcagaagaccaaccagaaccgtcagaagcaccaccgttaccacccagaccggtcggaccaccgttgatgttaccaccggtgttgtgagcaccagagttgtgaccacgaccgtcaccaccagacatatatatttacctcctcgtactttattttaatgttacgaaagaagagttgcgtgtttcacgaattaaaactgatccgtcacggttaatgtaataaattaagctaaataaagtttggtgtgctgacgcatgttcaaaactagttgggtgagatttccaatccggagtttcagcgatccattgataaatccaccaaggaacagtacagaatcctggattttttccaatcaactgaagattcgggctaaagttttccggaagagtaaatacagacggcttttcagattcaataatctcagctacagcctgttcgaatttttcttcaacaaaaggagtatcttcaatcaaaacatcggtattttcaggaattttatccgtttctactacttcaattttaatgtcagatttaactggagaatcaatcaaaagtgctgcttctggattgacttcttcatcgtcatattttaatccctctgcagcatcagcagcatcaattaagtctttaatagataacccatcagtctctggcataggttcactagcgagcttctggagggcttcttcaatatcaacaacgatattatcaaaagatttattctttttgacctttataccaaactgttcagcatattcagctaatttagctttagcttctttattatcatcaagagccttcagctctgcaatataatctttatctatcataatatttcctcagtataaatatagatatatttattactcggaaaatagtatgtaccactttgtatatgaaacaacaaatctaataaatggtaaaaagtatataggaaaacactctactgatgacttgaatgatggttaccttggttccggtaaggcaattcagcaggctataaagaaatatggtgaaaacaatttctctagaacaatactaaaagagtttaaaacttccgaagaagcgtacatgtatgaagaagaaattataactcctgaactaataaaaagcaaaaattattataatatgaaacctggtggaattggtggaattattatgactacagaggttatagcaaagatgaaagaatcttccgctaaaagatttgaaaactcaccaggcacggtattaggtaaaacttgttacactaatggaactaaaaatatttttattaaacctggagaacttgttccagaaggatttgtaaaagggatggttcatcctaatagaaagtccagaaaaggatgtaaagtcaaaccgactaccacaggaactttttgggtcaataatggcgcaataaataaattaatacaaccagacggtattattcccgacggatttattaaaggtcgtctcatgaaaagagattctaaaggcaaatttagtaaggcataattatggatattaaagtacattttcacgacttcagtcatgtacgcatcgattgtgaagagagcacgttccacgaattaagagatttcttttcgtttgaggccgatggatatagatttaaccctcgcttcagatatggcaactgggatggacgaattcgtcttttagattataatcgccttcttccattcggtttagtcgggcaaattaaaaagttctgcgataactttggctataaagcctggattgacccacagattaacgaaaaagaagaattatcaagaaaagattttgatgaatggctttctaaattagaaatctattcaggaaataaaagaattgaaccgcattggtatcaaaaagatgcagtgttcgaaggattagttaatcgtcgtagaattcttaatcttccaacatccgctggtaaatcgttaattcaagctttgcttgcgcgatattatttggaaaattatgaaggtaaaattcttatcattgttccaacaactgctctaacaactcagatggctgatgacttcgttgactatcgtttattcagtcatgcaatgataaagaaaattggtggcggagcatcaaaagatgataaatataaaaatgatgcaccagtcgttgttggtacatggcaaactgtagtaaaacaaccgaaagaatggttctcacagtttggaatgatgatgaatgatgaatgccatcttgctacaggaaaaagtatttcatctatcatatcaggtttaaataactgcatgttcaaatttggtctatctggttcattacgtgatggcaaagccaatatcatgcagtatgttggaatgtttggtgaaatatttaagccagtaacgacttctaagttaatggaagatggacaagtaactgagctaaaaattaatagtatttttcttcgctatcccgatgagttcactactaaattaaagggaaaaacttatcaagaagaaataaaaattattacggggcttagtaaaagaaataaatggatcgctaaattggctattaagcttgcacaaaaagatgaaaacgcttttgtcatgtttaaacatgtatcacatggtaaagctattttcgatttaattaaaaatgaatacgataaagtttattacgtatcaggggaagttgataccgaaacccgcaatataatgaaaaccttagctgaaaatggtaaaggaataattatagtagctagttatggtgtattttctactggtatttcagttaaaaatctgcatcacgttgttttagcgcacggtgttaaatcaaaaatcattgtattacaaacaatcggtcgtgtattacgtaagcatggttctaaaacaatcgcaacagtctgggacctcatagatgactgtggtgtcaagccaaaatctgctaatactaaaaagaaatatgttcacttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgcgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaaggacatcttcaccacacgggtgatcggccaggatacgaatatcctgacgcttgagattatactttttcattaagaattgaatttccgtttcaaattcttcttcataattaaaagcatcatcaatgctatatctcattattttccagcctcaaatgcccgcatgtcttgaatatgcttaatagcaaatccacgtgatttaatagcatcaagagctccgctacagaaatctaataaaatcccccaatactgcaacgaggtatcaacctttaaaacatccttatcagctgatagaactgtcttcatttctgatttctcgtaacgatccatactaaattcatcaccatctcctcgtcccgagtagtagtctaatttagctttaagagcaacttttttctgtgcatcaattctaagcatttcctttttaatacttgaatgcttattaagccatttactatataacatcacattattagctgcttcatactgtaatttagtcgaatctataaacacatctttcttcaattcttcttgaagatcttctaatctcatattgttctctattcaattgttattggatggacttagattcattataccacgtttatacgtgaagcattatactctattactggaagccagttgtagttttatctgctcaatatcatcagggttatcgatgactgaaaagcgtatttctactatcaaagtataatcatcataaaccggtattacattaactgctaatttatcaatacgtggctcatagtttcttactgcgctttcgatattacgctcaaccgtgtcagcagtaagaggagtcatattctcaaaaagttggtcagataaatcgcatccaaattcagggtcaaacggtcttgaaccttttcttgttgtaataattcctaaaagactatttttaattgaccttaatccaagtgatcttgaaacgtctttgttccaatccattttcatctctgggtcaatatcagaataaagcttattaatatttgccattacaatagctcaaagaattctttgagtcctcttattacatgagcgtgagtttttccacactctggacatttaattggaacagccaaataaacagtaggctttaaaagcatatcttttatagctacaatatctgactctgtgatgatagaatataaatcttccagttctttttcatttaagtcttcaactggaatgctttcaccgttagcatgaatcgtttctatacatgatactatcatgtgggctatatttttatcatcaaaaattttagggtaatggaatttaattttaatgtcacccagtgtataccagaggtcttctggtgcatccatttgtgtatgtaatagatttatatgggttggtatttcagttccacaggtgcacttccaggagttttcgtgattaacttctccaagagaatgcgcccataaatgaatcagtaatagttctgattcttggcggtttaaatcttttgcatttgtacagtctttgattagctttttaacaatctcttctactgaaccattctttttagcagtaataagttctagatattctttaagagtaaatgcgcgacagttgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagaacatcggtcaccacaagaacaaaaagaagtaattgctgatttaattgctgattattttggagactatccaaagacttggcaaccatttatatttttgcaggtatttgtaggttcaataggtaaaactaaagtaccggtcacatttgtatgtccaaaatgtaaaaaagaaaagacagttccatttgaaatatatcaaaaagaattaaaggaacctgtttttgatgtagctaatgttaaaattaaattaaagtttccttctgagttttatgaaaataaagcaaagatgattactgaaaatattcattctgttcaagtagatgaaatatggtatgattggaaggaaattagcgagtccagtcaaatagaactagttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgaacgcggattcgtattaaaactgattgagaaggataaacatcaatgagtatgttacaacgtcctggatatccaaatctcagcgttaaattatttgagagttatgacgcttggagtaataatagatttgttgaattagctgctactattaccacattaactatgcgtgactctctttatggtcgaaatgaaggaatgctacaattttatgattctaaaaacattcatacaaaaatggatggaaatgaaataattcaaatttctgtagctaatgcaaacgatattaataatgttaaaacacgaatttatggatgcaaacatttttccgtgtcagtagattcaaaaggcgataacatcattgctattgaattgggaactattcattctatagaaaatcttaaatttggtagaccatttttccctgatgcaggtgaatctataaaagaaatgcttggtgtcatttatcaagaccgcacattattaactccagcaataaatgctataaatgcttatgttcctgatattccatggactagtacatttgaaaattatttgtcctatgtaagagaagttgctctagcggtaggaagcgataagttcgtatttgtatggcaagacatcatgggagttaacatgatggactatgatatgatgataaatcaagaaccatatccaatgattgtaggtgagccaactttaataggtcaattcgtccaagaattgaaatatccattagcatatgattttgtttggttgactaaatcaaacccgcataaacgtgatccaatgaaaaatgctactatctatgctcattcgtttttagattcttcactgccaatgattactacaggaaagggtgaaaactctattgtagtgtcaaggtcaggtgcttattctgaaatgacttatagaaatggctatgaagaagctattcgtcttcaaactatggcgcaatatgatggctatgctaaatgttctactgtcggtaattttaacttgactcctggtgttaaaattatttttaatgatagtaaaaaaaaccaatttaaaacagaattttacgttgatgaagttatccatgaattatcaaataataattcagtaactcatctatatatgttcactaatgcgacgaaactggaaacaatagacccagttaaggttaaaaatgaatttaaatctgatactaccactgaagaaagtagttcttccaataagtaataaagaagtttctattcctaagatgggtcttaaacattataacattttaaaagatgttaaaggtcctgatgaaaatttaaaacttcttattgattctatttgtccgaatttatcaccggcagaagttgatttcgtttctattcatttattggaatttaatggaaagattaaatctcgtaaagaaatagatggttatacttatgatattaatgacgtttatgtatgtcaaagattggaatttcaataccaaggaaatacattttattttagacctcctggaaaatttgaacaatttttaactgtaagcgatatgttatccaaatgcttgcttaaggtcaatgatgaagttaaagaaattaattttcttgagatgccagcatttgttttaaaatgggcaaatgatatttctacaactttagcaattcctggccctaatggtccaataaccggaattggcaatattattggattatttgaatgaaaaagccacaagaaatgcaaacgatgcgtagaaaagttatttcagataataaaccaacacaggaagcggctaaatccgcttctaatactttatctggtcttaatgacatttctacaaaattagatgatgctcaagctgcctctgaattaatagctcagactgttgaagaaaaatcaaatgaaatagttggagcaattgataacgttgaaagcgcagtgagtgatactactgccggttctgagttaattgccgagactgttgaaattggcaataatatcaataaagaaataggcgaatcactcggaagcaaattagataaattaacgagtttattagaacaaaaaattcaaacagctggaattcaacagactggaacgagtttagcagtagtcgaaaatgctattcctgttaaagtcgtcgaggatgatacagctgaatctgtgggtcctttattaccggctcctgaagcagttaataatgatcctgatgctgattttttccctactcctcagccaattgaaccaaaacaagagtctccagaagagaagcaaaaaagagacgcatttaacttaaaattatctcaagctttagataaattaacaaagacagttgatttcggatttaagaaatctatttcaattactgataaaatatctagcatgctatttaagtataccgtcagtgctgctattgaagctgctaaaatggttgcattgataatggctgttgttattggaatagacctgctgatggttcattttaaatactggtcagataaattttcaaaagcctgggatttatttagcactgattttaaaactttctcaagcgaaacaggaacttggggccctttattacaaagcatctttgaatctattgatgaaattaaaaagttctgggaagctggagattggggcggattaacagtagctattgttgaagggcttggaagtgttctttataatttaggagagcttattcaattaggtatggctaaattatctgcagcaattcttcgagtcattcctggcatgaaggatactgctgatgaagtagaaggaagagcactagaaaatttccaaaatactacaaatgcttctcttagcaaagaagaccaagaaaaagttgcaaattatcaatataaaagaatgaatgacgatcttggtccaatagcaaaagggctagacaaaattgcgaactggaaaactcgtgcatctaactggattcgtggtgttgataataaagaagcactaacgactgatgaagagagagcagaggaagaagaaaaattaaagcaactttctccggaggaagctaaaattgctttaatgaaagctaatgaagctcgtgctgctatgaatcgttttgatgaatacgctaattcagctgatatgagtaaagactcaacggttaaatcagttgaagctgcctatgaagaccttaaaaaacgaatggatgacccggatttaaataattcaccggcagttaaaaaagaacttgctgctagattttctaaaattgatgctacttatcaagagctcaagaaaaatcagcctaatgccaaacctcaaacttctgctaaatcgccagaagcaaaacaagtccaggtaatagaaaagaacaaagcacagcaagctcctattcaacaagcatctccttcaatcaataatactaataatgttattaagaaaaatactgtcgttcataatatgacacccgtaacgagcacgactgctcctggtgtatttgatgcgactggagttaattaaggaataatatggcaattgttaaagaaataactgctgatttaattaaaaagtccggtgagaaaatttcagccggacagagtactaaatcagaagtagcaactaaaacatacactgcccagtttccaactgggcgtgctagtggtaatgacactacaggggacttccaggtaacagatctatataagaatggattattatttactgcatacaatatgtcatctagggattctggaagtcttagaacgatgagatctaactactcttcttcatcttcgagtattttacgtacagccagaaacactatcagtaatacagtatcaaaactatcaaatggactaatatcagataataattcaggaacaataagtaaagttcctgttgcaaatattcttttacctagatctaaatctgacgtcgatacgtcatcacatagatttaatgatgttcaagatagtcttattacaaaaggtggaggtactgctactggtgtgctaagcaatatggcttcaaccgcagtatttggagcgctggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatctagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgataaaacacctaatggtaactttaacggattagctattgctccaaatctccctagtacatttactctcgagattactatgagagaaattatcacgttaaaccgtgcttctttatatgcggggactttttaatgtattctttagaggaatttaataatcaagcaataaacgcagatttccaacgtaataatatgttcagctgtgtttttgctacaactccatcaactaaaagctcttcgttgataagttcaattagcaacttttcttataataacttgggcctaaattcagattggttaggattaactcaaggcgatattaatcagggaattactacgctaattacagctggcacacaaaaactgataagaaaatcaggggttagtaaatatcttattggtgccatgagtcaacgtacagttcaaagtttattaggctcatttacagttggtacatatttaattgacttctttaacatggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggcagatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtgatgcaggctggagcagttgatagacaagctgccattgaatggcttgaatctgctactataaatggtattcaaagcgttctcggaaatagtggaggtgttactggactatctaattcgctttcacgacttagtagattagggggaactgcaggaagcatttcaaatattaatactatgacaggaattgtcaattcgcagagtaaaatattaggagcaatataacaatggggacctttcggtccccatatttttatttacggaatgaaatgaaagcagcaactgaagcaactaaactgtcttcaatataaacttcaatttttaccggagcttctgactcaaatttacctgttactacaccctgaaaaatactttcagtctgttctggctttgaaaaattttcagaaggaaaaattccgaactttttatctgttccaaaaattttgataaattcatcgtaaactgcttcattaaaagcattatcagcaggaataatgccttcaactacaagttcttgacctaaaaagcgcaaagaagatttcattttgtgttcctcatgttatgtcagtaagactactataacacaacacgagggacttgtaaactacatcttgaactttttagacattccgttgatgttaaccaaagaagctaagatttgagaaacttcgttttcctcttcttttgattcttctacaaggaattgattaaatccagccattggacgaacttcaccagtttccatcaaatgatcgccatcatatactgattcttctaattgctcagaaggaggaacgattgtaccttcgattagatacttgttataagcagtttctttcataaagtaagtacttactttattaatcttcagtaaaattccacgcggtagaataacttcagcttctgatggaaatcctgataaatgacccggaacgataactttgattcgctcagctcctttaattaccatacccacgctagtttcagcatcttcattagcatatgtagaatgactacccatatgcatcaaatcttctgcatcaacggaaccttctccttcaccagaaaatactgcaccggaatcatctagagccatatagtttttaccatgctcgccgaagatatttggtttaagcgatgtagatacgaagttcttgaaatagaacattttgttttcaatgttatgacgcaaagttttaaaggtaacttcttgtccgcgataaagcgtagttcctggaggaagaactgaacctttagcgaatgcagaatccaacgtctcgatgtgcttaatagctcgttccatatattcttcacgggtagaatctggtttacccaaaaggaacgagttcatttcaacatatgaatctgcacaataatcttcaattacatcagattcggcctgagtcagtccttttggagttacttcagtgcttgcgtattcatatgcctgggcagcagattcattaatcaatttataaatgccattcatgacaaattgaataatagctgtcttttcatctggcgtagctttagaacctttaactaaatcattaataattttcttaataacatcaaagctattagaaatattaatgtcagcaagatcgcttaaaattttatcagttttataatcaaagaattctttattctttaaatattcttgagaaccttgatatgttatatcgctctgcaacttgatagatggatcacgtaaacgtgcatgggccaatgcaatatgatttcggaagttttctagttcataatcgctagatttaaaacgagaagcacttctcataccaccgatagctcctttgctgaagtttgaaccaatctggataacgccagagttcattggtccttctgctttatataccggaactttagattcaaactcttgatatttcttggcagcgaagctatcaccctgtagcgaagcatcgacagtagaatattgagcttgtgctgctaatcgacgactaattttagttttttgaataacagcttgatccgtgcgcttatcattttctaaagcaatagaagcagcaacagcgacagctttaggaacagcattacctgttttaacatctacataaacatcaccgaccttcgattcaacttttgtgaataactcagttgaaataggaggtacacctggaatgtcttctaaattggcatttttacggtaaaccataatatatgcatactttttatcatagtcccagatttcctttaaaagaacatatctacctgctcctttagtacgtactaaacggtcagcaataacttgcatttgacgagcagcgccatttgttttactctttagtacgcggaataagcatgcatcaattttatactgtttcattgtttgaagagcagtatcaaaaacagcgttaatgacgccaattggatttccacccaagtttctaagtttaaccagtgataatttctcgttgacacctatcattacgatatgcatcattttatcgcccggcttaacgtttttatttgtatcacctccagaggtgtatgtacaaaatctaaatccaggaagcacgctttcttcgccggcttgaatagcaaaaatttgaggtattttatgcttaggatttaagttaacaaccggcgccgaagcgccgtcaaataattctgtaataagttccatgatttatccttgaacgaacttgtaaggcatgtttgcaatatctatgcaagacgcaataattccaagagatgattctactttctgtttaacatttgatgaaacaaatgatgcaaagtcaactctatcttctatatcacctgtcattgtaaccaattcaccagtttccattaaatggtctccgtcatagattaccgattcggtgagttcttctgtggtcataacttcagcttgaataagcttgttgttagttttaactgttccatcattgtaagatgcatcggttattttattaactttgaccattaatccacgtggcaaaatgacttccatttcatttgaaggtgctaaacttccaccgggtaaaacaacattgaccttatcagccccagtaataacccatccaattccaactaaattatcgctagaatttactagtccttcatcagttttatcaatagaaacacttagacgcttttcgtctggtaaaacacctacagatgaatcagtcatccaagtaccaaaaatatttggatataatgatgttgacacaaagtttctaaaataaaaaactcgattttttaccattgcttcatatattgaaggtaacattcgttgtgaacgatacaaagtaataccttttggtaatcgttcaccatttttaaaggctgaatctaaattatcaatagctttttctatgtcagatgctgtcaaaatacttgtacgctcatctggattatataatcccaaaagagcattatttatatctacatatcctgaacctacgtattcacgaattccgcgtttttgcgccggtgtgtatttagatgaatctttattttcgactataggatgtaatgaccatccagctgtaagagcatatccacgtaattctcttcgaataatctttgtttttattgcattccaagaattttgtactaactcatttgcagcatcttggtttaaatgcgaatgtttgttaatatttctttcaaaccaagcacctttatatttttctaaagtatcatcgacgatagaagcaatagtttctaaagtttttattgaagtaatagattcttttcgtaatctttctaaagctttattttttatttctgtattaacatcagattctttatcttcaggaattatagaagcttctctgaatgccattccagctgtaacactattaagagcattctctaatgcaaatcctgaagtagaaataacagttaattcgttagcatcggaaattaaaggcgcatcagcgggtttatttaattctgctgctgaagcctcaaatttttgaaacatcggtgtttcaaatctagaagattccaatgactgactttgtgcaattgctctacgggaaattttaactttaacgattacagcttggtcagaacgtttatcattttcttgtgcaatagatgctgcaattgcctcatttttggttacttgagctccggtatctttattgatataaacatcaccgaccttcgattcaactttagtaaagagctcggtactaatttccggaactcctggaatgtcttctagtgatacatttttgcgatgtataagaatatatgcatactttttatcataatcccagagttccttaagaaggacgtatctgccacctgaacgactacggataagtctatcagcaataacttgaatttgtcgagcttgaccagcggttttagacttaagaatacgaagcatacaagcatcaattttatactgacgcattgtttgcattgcaacagtaaaaactgaattgatataattaattgggcttggaccaagaccttttaatttagcaattgaacctttagcggttaatgtaaaaggaacaatatgcatcattttatcgcccatttttaaatcgcgattagtatcacctccagatgtataggtacataaacgaaagcctggttgttcaattgcatcatcaacatgaactgaaaaaatttgcggtattttcttctttggatttaagtttgtaatcggaagagtagtatcttcgtcaaataattctgtaataagttccatcatagcctctctagtgtttattctatttataaaattaaaggcccgaaggcctttagtaatctagtggtaagagagtacgatatatttcaaactttggtcctttttcataggcatcaaatgtttctgtaaatttattataagcgtatgcatctacaaattcgagaatgacttgtgatacagaagtagaaacatctccaccttctttttgagcaatgacaattgtttctaagtaagctttcataaaccagttacctcatgaaaatcaccaaatacatcctcgaatgtattagctttagttttatcttcacgtaaacgaatcgcaatcggaagaaataatttaacgtaatcagtgcggccatcagattttaaccaaccgttgcattcgcactctagaatttttccaatataataattttggttttccataatgcgagtacggtcaagttcatgcgattttacaccggctttatcttttaagcctgaaccagcatttaccttaatttttccacactctgattcaagaataaatccacccgctttagtagggtctttacggtgaggataaattcctacaatttttaaatcaacatcaattacttctttaaatttatagagattttttgaacgagcattttcccacaatccatcggtatttttgagaataataccttcaagaccttggtcaatatactttttataaattaccttagcttcatctaggttatttactacctggttttcaattaaaattactttatcataacctgatgtcatttgttctagtttagaaaaacgtacatcatatttcaaacgaaatgcaggaagaccgtatatttctaccaacgggacataatcccagacctgaaacttcatgcattgagcttctttttcagaaatggttccctttaaagatttattggcgatgccattagatgcagtacgtgattcagctacttcggcgaattctttagctttactaatttcaggataagcatcaaaaagaaaatctaggccttctggctccttttcaacttgctcatggtataccaattcgccatcaattaacacaccttctggatgaatctggcgagcttctgcagtcattttgattaactcttccttaagaagatctaatcctagatattcattaccagctcgtgataaaagacgaacatcatctaattcatcgcctcggacttcagcaaaacaccgagctccatctgcttttaactgcgcaaaggctggaaacttgatattcttattaatgcctttttcatcataagaacttgcaagcatttgaggttgttcaggaattaaacctggccaaactttatttgcaatagatactgaagcaccgcattcaaggtctcgcatcatcacccgacgcaaaacttcaacatcatcttttttaccgtcagtaatatatccagttaattcctcaattgccgcatttccagtcaatttccgagtagctaacgtgaattcaatgaagtcaagcatatcggtaagagtcaacattccaaaactctgggtagcaatacccggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacgtaaatgaaaccttgctctacgcattttttaaaaattcgttcgtctttttgagctcggaattctggattgcatctaaaaaattgatttacgtgaccgtaatcacgtgtagtattaccttcattttcataaatagtgtgaacaacaaacattagaatgctccttggaaaatattatcaccacaagtaggtctattatacaaatactctataccgccgggtttaatatagttccatgtctgaaacggatgcgtctgatatggatgatatagatgattataaggattaaatccaggagttctccaggtagtgttccaaggaaaagaatcgtttttaatcatcttttcaattacatcttttatagctttttcactatcaaaactttctttattttcctttggtgaaaaaagcttattctctacatcgttccatatataaactcgctgagcagtttttggaatactgtcacgctcccctcgagccatccaataaacaggaacatttaatatttcactcgcatgatcgcagtggtgagcgagatcgtcaatataacaaattacgttatatttctcttttgcctttttgaacaactcttcttttgaagaatcatgaccacacatcagtacttctgagaaggcaccaggaaaaagagcattcaaattaaattgacgattcagcagagcgtcaatagaatcacccagtgctgtaacagctacaaaattataatcttcttttaatttgttaattacacacagggcatctttatatggcgacaagtaacgaataaaatctgaacgattgtatttttcaattagcttaacgccaagttcttcatcacaattaaaaagtttaccaggagaaataaatttctcatcctggatcatttttaaaatatgttctaacggaagattatatttctgagcaaaataaggaaggcctgattgccagcttaaacatactccatcaatatcagttaaaatagtaggcttcatagagagtctcttaataggtttaacacatcaataaattcagcttcggttagtattgtatcatcttttgttagaccactagccatgctgtgcttcaaaacttttcctttcgaggcttgtaatgcatcacggaagcccttgttttggatcgctgcttcaaaatatgcatttgtgtataattctttccacgccggggagtatcttgaaaatggaactccaagccagaagagggtcccacggtcctgagctcttgcataagaccttccagcttgttgggcggcaagcccggataacccaaatatacgacgttgttgttcaacatttttcactttgcatccttggaggaatccttcaagacctccaaattgaatgccatccataacgaaaggccaatgggcgaaattacttaatgcacatgatggccacctaaaattgcttctaatctctaactcagacattttcaatgcttataatttcaacatcagcccaatgaccatagcaaggaagacgaaattcaactggccagttagggtccttttctaatataatagactcaacttgcggttcttcatgttcatcagtatacggatttttatctgttactttatatgtgaccttaatgtactgaattccaaaaatcttattaattatattcatactatttcctttaatccgtagataggagataattcatcacccatacgaaggtcttcatttccatctacccaggaaacaatataagcctcttttatttgaataccactccatttaaatggaggtaaaaccttagaaattaatccaggtataccaactccctttaattcaacggtttgacctaaaaagaatttcattaaaacctcatctgaaaaccgtgcgatttaacattaccgccgccaatatcagaaatgttaatttcacgcgcaattgaagggtcaatgtcaatttcgcgattgagtttagtgatagctaaagtatcgcgcccatttacagtacggaactctaaagggcagactacattaacgtagtttttaatcgattcactggtaggttgcaaatgtgcaggaaggtctttaggcgcctttgagaaaactacttcgcagaagtttttacgggtatcaaaataagtagtcataaacataacattttcctcagtaaggggccaaagcccctcatttattttaaatatcaaattcgttaagaactacatcaaagattgcttcaagatgctcaggtttagctctgttactcagaatatgacgaatccaagttttaaccaaaagcttgcgattaacgccattccagcaaggatgagtccctaaatcgcgttcacggaaatcatcatccagagcgattttaaagttggaaccttccatcgtgattgaaaccgtgataccgttttcaaatcgcatataaacgtaattaggagtcatatactgctcaatttcgcatactgatccattttgatgtttccaaaggcaaatagtatcaatagaacctgcaataccattagaaacatatttacgttcaaagttgatgtagttcattttattctccaagatgtttaattgcggtacaggtatataatatcatatcctgtaccaaagtaaacaattattttactactttccaatgctgcatgtcaagtttaccaacttttttcatcttctcaattaagcgttcggcacgttggcgagctgtaacataataccattcacctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagttttaactgcagcgttcagattaatcgttttcattttattctcctttgtttgtgtaagataatactatcacaaaggaaccatactgtaaacaactttatgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcgacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggtttttggatatttaacgaccaggataaccataaacccgtcatcattcacattcaagaggtacaccgtaaaactgccggggtcttaaaactataatgattcgcaaatcattaatcagacagttcgacggctcctcgatttagctcacactaaggcagtgaatctccaataaattacttcaatgttaccacaaagtgacgaactgcttttcgcgcagcagaagccaaaggcttagcatatttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaggtaacgaatttttgtttaatttcttttggctgcttaagacccagagctacaaaaggatgcggaacatttcgaatttgaccaactggaagagaagtcaaatcgccaacttcgcagaaaccttcaggaacatcaggaccgacagagtgaactacacacagttcaggaacttcaccttgaacacgtttaccgataataagtcctgattctgtaacttcttcatcaccggcttgtgcaggttcagaaactaaaataacatattcaccgacagcacgaattggtagctgttgtacttcagacatcgtttttcctttttgttaacagatgaattaataataacaaataattcttaaagcatttatttaccaataaattgaagcaaatgctcaactttcataccattaacggaaatcaatttgtcaatagaaaaacctcgccatgcaccaagctcaacatcaaataccggaatcatgtcagtagattctttccgagtagattcagtcaatttgccagtttgcatggttggcataaagtccgcgtcgcgagtacctttcataacacgaatagtaccgtcagacttttcaaaaactacgtttgaaacacccatggacaatttagttttcaaaatttcacgaattgctactttctgctcagttgtcagtttcatttatttacctattacagttttaatatgagttgttccacgttctttaagggtggaaagtaatttttggcatttttctaaatcagatttccaactatgtggtctatcaatacaaacccagtttgacttataatactgcttccatttagagaaaaaatatttcttatactctacagcaaatgaaatgttctcgttggaataagaactaattgctgtgagctgtaccaaacgaaatttcattattcaccacagaattcgttgatattttcccagtttaacttatttaagtttttcttaggaacattaaacacttcaatacctgcatttcgcagaatatcatcccagccaggtttatttttatcgtatgtttcacaataaaccagctttttaattccagattgagctattgcttttgcacaatctgggcaaggagaaagtgttacatacatagtagcaccttcaattgaagaaccgtttcgtgcagcaaacaaaatcgcatttagttcagcatgaatttcatttttagacgaccattcagagtgcgcgctacgatgttctttcgccaatacaaaacgatcagttgaaccaaacgatacacattcaggcttatgaccttgaatgatagtatgtttaggcttattcagcaaccaaccttgctcagcagcataatcacagcagttcacaccacctgcaggtgaaccattatatccagtagaaataatacgtccattcttttcaattactgctcctactttccaggagcaacattttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcaccagtcatctttttgtgaagctcaaccggatacttcgtcacaataatagcatcatacacagaaggatgaatactattcaccagagtatcattcattaaagttattctaatgaactgtgctgtttcagaatcaagcgctctatgatcgccagtatcattttcaagacaattatcaattatatcagttaaattcatcatagtacgccatacaccctttgtgcttcaactaatccatcaaaatccagtttaagatgcgatatttgatcgccatcacctggattcacaattactaatactgaacgaggagtttcggtaataacacgaaccgacgtttcaggaaatcgttcagaaaccttatttaccaattcttgagcaaatagtttaactttttcttggaattctttaacagtaattggtttttcgcttagcatgttgatcctagctccttactttcaacatttttaactaatttgacagaaactaattcagcatcttgggtaatcattaccggaccttcttcatgctcttcaagatattctagagctttctttttagcttcttccttcgtatcagtttgagcatagatatagaacatacaaccagtaatacctactactttccacttaatttctttatcagttttaatttcaaatttacttacagaatcatctttttgaacttcttcgaaaaaagaatattctaacatataagcaattgaaaataacgggctaactttataggattcacccattacatcaacagctttataccaacaatcatcaatttcacgtttaatgctaataacatttttcgcaggatctatttttactttaaatgaattttccccaataaactgggcaattcgtttattagccccgcaagtttcattaaaaatatctttatatccagctttaaagcgataaaccttatcttcttcaaaccattcgctcatttcaatttcctcatttgttttggtagagctataatatcacaactctaccgtaaagtaaactattaaattgctttgaattctgatgtctgtgattcaaagcgaatgtcgcctttgataactagctcagcatcaagaccaaatacaacaatgatatgcgcggaacctggatacaacgtaatggcaatagaatccacctggtctggaagcaaagcgttcaatacatgagtcacttgagcgtggattcgaagttcagctgcattatcaagcttttcaaacatgttattagcgataatttggctaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccaactaaaccgctatttacaataacaaagcccaagtttcatggtgccaagccattaaaaatctcccgaagcgacttgccagcattcaacaccgatgcggcgccacatttcaactacttgagttcggtcatcaatagctaatttcacatcaaaatgtggtgcgatgtgtttccagaaaatttcttctttaactacatcatctttacgggtatcgccttgttcgcgttgacactgcatgactaatggaacaccagcaatgtcctcaacccatttacgggtcatacgataatatttcgttggatcttcttcggttccactttcacggcctgaaacgactacgatttgataacccataagagcatacatcttggatagttcaacgaccattggattaataatatcgatatcgcatttttcaaggtcataaggaccacgaccattcatttttgctaacgtgccatcaacatcaaaaataactgcttttggtttaccaggagtccctttatataccggaagaccgagatactctcgcatgcttttatacattgagcgtaaaacatcaattggtactgctttagttccgcgttttgagttacgtttaaccaattcagtccaaggaacatcaaacactttatattcaatttgatgcccaagctctttggcaaactcttcccaaaccttacgtcgttcaggattcagattagtatctgaaacaattacacccttcgttgcgtcttggcagagaatcatgttagcaacatcatgctgcatgtaagttacgataccttctttatttttggtatacttgtactcatcgcgttcttcatgtgccataatagattggcgatagtcatcacgattgatattataaaaccctggatttttagcaataaattcacgagcccaagtactcttaccagaaccaggacagccaatagtcaaaataatctttttcatcatttaattcctaagaaaacttcaagaatacgaatattatgctcacgccgccctttatataattcagctgttgattgattcaccgatttgctctgaacattagatgaaataaattttatcatgtgatttttaagctgatacatatcaaacccacgagcttttgcttcttttcgtagggctttaccagcatcatctaaagctttagcatgttcaatgtcttcgctaatgcttgatgcactttcatggcatacatcaatgtaacggtccgagcattcaatataacgttctagcagagttttcatttatttttctcaactaatgattgaatataatcatgcaagtctttagatgctttaccccacttattttgatattcatttttgagattagcacgtgattgagctaataaaacatcattagttggaggtaaagattctaatcgttgaatctgtcgtccataaatcattgcagccatctcggattcataaattaatccttttagatgttcaaattgataccatgaaatcatttacatttatcctcttttagctcttgacgataataacatatcatagttttctggtcatgtacatatcgttttacatcattaagccaaatacgaaattcctgagaatcttcaaatggcatacctacccaagctttaccatcaataactttaacttgccaagatagtttagcttcgtcatatgactttatttgcacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttatgagccaccacatccgccttctttgcgtctttgcgcagcttttcattttcacgctcaattgcagcaattgattcacgatttttattattcattgcatcaatataattatattgattttttaaatcatttaatgctaaggcgttttcattggccgtttttgtaatttctacaacagacgtttctaatctttcaattttattttttaaaattaaagaagttccgcccaatgcaattacaattaataacaatccagctgtaaaattacttacatgcataaagttttaataacctctataatatcgtcttgagaaagaccgttaattaaaatatgatgttcagctggagatttagaaattttaaagcatgcctcaacatcttctgccatatccgatgcactacgatttggattactaattccaagacgatgctttccagtcaaaggattaacgatgatatagcatttacaactattgatatgaacattaggttgagtctgattaataaatacatcacaatcatatttcgcaagctgattttctaaaaagactttcatctcttcaaccgcatcaggaagcatatcacgggcttgctcaagacgacgatttcgatattctttaatggtcgttttccgcttgacttgcttagctaaatctttcttaagatcggtgatatatccaactcgacggtttcctttaaatacagaaatcccatctgtagtatcaccgtatgcttcaacgaccatttcagtagtaatgagctgcaaatccatcataaagtcctcatgttatgtcagtaagactactgtaacacaacacgagggacttgtaaacagcttagtatccttctgggataaattttttataatttttcaaaaaattctgttcgatttcacacataaccttctcttgactatcatacccctggtataagctcatgatgataccgaacaagtgatccattccagcacctttagcaacaccttgcgcttccatcgcataagtctttctatccttaccacaatgcttattatgacagtcaagaactaaaaacagagctcggtctaagtacttcagataagtcgtttcaaatgcttcaatttttctgtatgaatattcatcgtcagcatacattgctttaagatcatctgatgcaccatcaataatagtcttaaacaatttttctggattatctaatgaactttttgtgctatgaagagacacataccagtcagacttaattttaaaatgagaaccatctttcatcacagcaacatagccttcgatgttttccgcatttttagcttcttctacccatttagggctatcgatttcgtatcgttcaactagatatggacgaagagcagcatctttataaatatcatcatatgaaatgtattcacccgtttcgttttcacgaacattcagtaaaataattttcatttcttggtaagcaagaacgattctattcgtcggagcaacgaattcgaagttagcagtaaatccatcttcagctaattctttaagtctatcacgcaaccgatggtgattaatattcatcaaaataccattagccattaaagcctgttcggatttgattgaaccctttgatttgaacagaatttcatcaccgtctaaataagttgataccaaagacccatcttcttttgttagaatgtaatcaacatcatttaaatcgatattcatcgtgaatggattttcattcaagttaaaaaacttttccataggacgagaagcaattcttactggtttttctccatccatttcaaacatgattccacgacattccaatgcgtctggaagtaaccaatcagaataagatgcataattatatgagaaaattctgtaagttcttccagacgcacttacatcatccgagtaaaaaaacttacgctgtgaatccttgcatagttccattaaattgttaaaaagttcttgcattgtgtatcctcttttgtgttttgaatatagtaccacactccatgtggaagcatcattttttcttatgttgaatattccaaggcgggttaaacagcttaatgaatagtggttcctctaggtcaatcgtcgcgattgtcattgtacctaactcatttgtcatagaaagattaaaacattggcgggcgtaaaattcaactttgcttccttcctttagcgcagcatgaattaatgcagatttagtagaatcagacgttttgtctttacggttaatagcagttctataatagtttattcttttgcgtaaatttttagtttttccaatataaacaagttcatcatttatagcaatagcataaattacgttatacttgtttggaatagataattgttttatacttccgttgtagtctaattctagctcagtatatttaataaatgaatattctgttgcaatttctttcataataaaatgggccttgcggcccactccttaaaagtattttttaaaactcatcataactttatcatcaacatcattatcaatctgtgcaacaaggtaagatgacaattctacttcttgtggcgcagattgaacattatcagaattaagatattcacgaatccaaggatatggatgtttaaccggagcatcggtaattgggcatggaagaccacactgcttcatacgagatacagttaagtaatcaataaagctccacatgctatttgtatttaatccaggaacatcaccatctttaaataaatgaactgcccaatctttttcttggcggttaacttccatgaaaatatcaactgcttcttgttcacactcttgagcaattttaacccattcatcgccatcagtgccaagttgaagttgacgaataatatattgggtgcctttaaggtgaagctgctcatcacgtgcaatgaacttcataatcttggcattaccttccatgatttccatgttcttatggaagttaaaggtacatgcaaaagatacataaaaacgaatagcttccaatgcgttgattacatgcaaacagaggtaaagagatttcattagctcacgcttccaatatgtctcatgctcaatagcatcttcaataacgtcttcgtctgcattaatttctttttggtattcgatatcagctttagcgttttcccaataacgagttttaatcagaacatcatcataataacgtccaatagattcagcacgtttcataatagcttcatctaatacaatttcatcaaataccttcgatggatcagtataaagatttcgcatgatatgagtatatgaacgactgtgaatagtttcactaaaagtccatgtagcaacccatgtatcaaggcttgggtctgaaatcaatgacataagtacagcagacggtgcacgaccctgaatgctatctagaagtgattgatacttcagattattagtaaaaatattctgctgatattgaggaagcttattaaactgtgcagcatccatcattaagtttacttcttcaggacgccagaaaaatgataattgcttttcggtcaaatcttcaaaaactttatggcgttgaatatcataacgcgcaataccaagacctgaaccaaaaaacataggttcttttaaaacatcaactggatttgtattaaaaactgtgctcataaattttccgcttagttaatagttggtgactcgtccgtgagtcaaattatatcataatttacaggatgaacaatcttcagcttttggagtttctatttcataatcatcagtaccagaaccatcacgggtattatgataatagaaattttttccgccaaaataccaaaaatacaaaaggtcatcaatcattattgacattggaacctttccttttggaaaaatctgcgggtcatagtatgtattcgctgaagctgattgacatacccatttcagcataatagctacttgcgtaagataaggtttattacctttcttagctaatttccatgtataatcatataggtctatgttatgttcaatattgggcacgacttgattaaaggaaccctcttttgattctttaacagagactggtccacgtggaggctcgataccgtttgtactgttagaaacttgggaagatgactcacatggcataagtgctgatagtgtgctattacggatgccaaagagcttaaggtcttcccgcagcgacgaccagtcacaaacgtattttggagctgcgatttggtcaatctttttattgtaccagtcgataggtaattcgcctcgagaccaacgagtgtctgaataatattcgcaaggtcctttttctttggcgagcttaatggatgctttaatgagtccatactgtaatctctcaaatagttcatgtgttaaatcgttagcatcttcataagaagcaaagttacttgccagccaagctgcatagttggtaacacctacaccgaggttacgacgctttttagctttttctgcttcaggaactggatatccttggtaatccaaaagattatcaagagcacgaacttgaacttctgccaattcattaattttatcttggtcttgccagtcaaaattatctagtacgaatgcagagagagtacacaatccaatttcagcatcaggactattcacatcatttgttggaatagcaatttcacagcacaagttactctgacgaataggtgccttttcacgaataaacggagtatagttattcgtattatcaatgaactgtacataaattcttgctgttcctgaacgttcagtcatgagcaattcaaatagttcacgggctttaatacgctttttacgaatattagggtctttttctgctgcttcgtataattcacggaaacggtcttggtctttaaaataagaataataaagctctccacccatttcatgcggactgaacaaagtaatgtaatcgttctttccgaatcgttccatcatcaaatcattcagttgaacaccataatccatatgacgaatgcggttttcttctacgcctttgttatttttcaaaacgagaagattttcaacttccaaatgccaaataggataataagcagtagcagcgccgccacgaattccaccctgtgaacatgatttaactgcagtctgaaaatgtttccaaaaaggaataacaccagtatggcgtacttcacccatgccaatcttagaaccttcggcacgaatcataccaacgttaataccaattccagcgcgtttagagatatattcaacaatcgaagcggaagccttattgatagacttcagcgaatcacctgcctcaataacaacacatgaactaaactgtcgagtcggagtacgacaaccagccataataggagttggtaatgaaatctgtcgagtagatactgcttcataaaaacgaataacatgttttaatctatcaacaggttcatcttgatgcaatgccattccaatagtcataaatgcaaactgcggagtttcataaatttgaccagtggttttatctttaacgagatatttttcttttaattgcatcgccccggaataagtaaattccatatcccgctcgtgcttaatttttgattctaaaaatgtaatttcttctgctgaatattttgacaacaattcagggtcatatttaccttcatttacacagtaagaaatatggtcaataaatgaacgcggttcatactgcccataaacatgcttacgaagagcgaacattagacaacgtgcagctacatattgataatcaggctcttcaaccgaaatagaattcgcagcggccttaatgacaatagtctgaatatcatcagttgtcattccatcacggagataagatttaatattttcatataattcataaggatctactgatgttccctcagctgcccaagataaaactttaataattttttgtgggtcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccgacatagacggcccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctagctcacttggattaggaagtgtaaaaagaactacaccagaagtatctttaaatcgtaaaatcatattgccattttccctttaattgctggatgcgattcataattttcaaggataaaatctttcggtttcatgtattcagttaaccagtaaagctgtgtttcggtgtcacaatttccaaactctataggccaatcaattttaagttcacatagttctttaggctcacgacgtaaaatttctttacattgctcagtatgattcatatagatgtgagtattaccaccagaaaatatcaaatctcctgggataagattacacatcttagccacaatatgcgtcaaggcagcgtacgaggcaatgttgaatggcaatcccaagaaaacatctacacttctttggtaccattgtaaatcaagataaccattacgcacattaaactgatagaacatatgacagggcggtaatgccatttgattgatttcagctggattccatgctgaaacgatttgacgtcgatcagttggtaattttttaatacgatcaatagtttcaactaattgatccacgccgccgaaatcacgccattgtttaccgtatataggaccaagttcaccactatgatatcctaggtctttagcctggttttcatagttatcgtcccaaatagttttaccttgaataagactaccatgtgtgcgaagacgtaaatcattaacattggtagaaccggaaataaaccatagaagctcagcaatgcatgcattccatgcaagcttcttagttgttaccgcaggaaaacctttagttaaatcccaacgtaatttagtaccgaacaaagcaattgttcctgtgcctgttcggtcatcggtttcatagccattttcaaaaatgtctttaattaaatcttggtattgtttcatttagtaccttatataaattataatacattttatgaagctaaataatcaatacggtttagcatcaaattttctctcaatttcaggcgtgaaatataattctttaccgcgtttggaaaagcgaccaataatatgataattattctcatcaaacgtgatattaccaatatccatagctttcaaccaaatatcgatatttctatccagctttatgtcaaaattccaatacagagaactattaccgaaaatactgcaagcggattcagtgaaacaactgctataaatcttgtctttaggaactactaattgatagacacctttaataaactgaggaccctgccactttggctgtttcgtgtctttttctaatagaatagggtaataattaaaattcatattttccgccacgtgttatttcatttatatactgattctgtaagggttgttacttcatctattttataccaatgcgtttcaaccatttcacgcttgcttatatcatcaagaaaacttgcatctaattgaaccgttgaattaacacgatgccttttaacgatgcgagaaacaactacttcatccgcataaggtaatgcagcatataacagagcgggtccgccaattacactgatgcgattttcgctggaatcgataaacgtttcaaaagttgtattaggactagataattggatacgtccaccggctactaaggtaacatactcatcccaggtaatataaaaatgagccaaatcaccgtctttagttacaggataatcacgcgcaaggtcacacactacaatatgactacgacctggaagtaatgtaggcaatgactggaacgttttagcacccataatcataattgtaccttcggtacgagctttaaaattctggaggtcctttttaactcgtccccatggtaaaccatcacctaaaccgaatgctaattcattaaagccttcgactgttttagttggagaataagcgaatactaatttaatcattacgcaaaacccctttcaataaaccattcagtggctttatcagcatcaaagaataattcttcgtaagtcttttctttgttttcaaagactgtcacacaaacacgttgacagtctccgcagtattcttctgacatactcaaagcgtcagaaaacatttcattaaactcatttaaatcaggattatgcaatgcgttaaaaattgcataatcgaattcgtcattcataaattcaaaaacaaaaatcatattattttccttaaacagactttttcacaattttccaatcagctttaaactgatcgacgtcagagtgataaatccaaaatcctgcgctttcaccgtcttcataaagcggacacccatcacattcatcttcccatcccatgccacgtaaaaggtgttcagctttttcaacaagttcagaatctttaccgatgatattaaaataccatttacctctaacttctgaatctttgatgctctggcgttgtaatctcattttattctccttagcaagctttaatcaaaagatataaacagaccaacataactgctgccataatataaggtgcgaacattttcttttctccattagttttgatagggtaatagtatcacactactacccttctgtaaactactttttgaaagtttttcgcaaaagttcaatgatttcatctacattgttttcgtcaacaatgcagtgaatttttgttacgccagaaactttgtctttgacttcatcttcttcagaagtcggttctttatactcacgaaaacaatgaaattcgtcttcacaaacgttaaagtaaaaatgctttccatttgcgcattcaatgtgttttattactctaaatccatcaacaaagaaagcttctttaacttcaaaccatccgccattttcttgaataattttaactattgctgaattagaacgtgggcgataattaataaatgtatcaataagtcttggaacaagttcatactttttaccgatatacattatgttttcctcattttaacggggctgtaatagccccttgataattattgttcaatcaatcccatgtaaaattctgcgtcttcagaatccataccatcacaatattcattagccataaagcgggtgaggtcttcaagaggaccttcaataacgatttgaatactccaaaacttagaatcttgcacgcttgtgatactaagttcaggataacgattacgaataatttcttcgatatattcaaaatcaacgatgtcaatatcaactttagccatattattttcctctttaatcatcagcagtattgccgatagttgtatagtaccatggaaggacaaggatgtaaaccgttttgtgaaaaaatttttgaaataaaaaaaggggaccctagaggtccccaattaattagtaatataatctattaaaggtcattcaaaaggtcatctaggtccgtgtcatcagcactagatgaactgccagagcttgagctcataaaatcatcttcagtttttgtattgaagtcatcaacattgaatgcatccaaatcatcagcaactttatcagctttcttagcagcagttgcagcggcaccgcccatcacagcagttcccataacttgaccgaatttagtgctcagttcttcaaacgatttgaatttatctttagaagtcatttcagaaaggtcaaccatttgttcgaacagttctttctggaaagattcatcgtcaatgtttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttacaacaagaatattagcccagtaagaagttttacgtttaacaagaccatactctttattgtcagtgttgtacagatcatttttactgatgtattgacatactgggcaagaatcgtaatcaccgtgggtagatgaacagttttcaatataccatttaccatttttcttgaaaccgtgatttacaagaattgcgaatggtgcttgttcatcatttttagacggaagaaaacgaattactgcttgaccgttacccgcattatcgagtttcagtttccactcgcctttatcttcagaagaaaaaccacctttatttccagccagtttagccatttgtgcagcgagttcagcagtagatttacgtttaaacattttatttcctttttaatttaattaacagttggtgctatgacgatgtatgacctcatagctggtcagtgagataattataatctatttataataagcaattaatacttgcaggatttcacagtttcaataaaaacttttttagcttcctgtgaatcaatatttaaaatttttctataagcctttaactttatagaataattattccagactaaattatcagtctgttcatcatgtttatcaattatatttaaaaacgaatcaagcaagataaacgtttcaaacgaaattatgttcgactgaagcagtttaaaaatataacttgattgaacttttggattatattcaaagatttctttaaaagcagaaacttcaacttttttactaaaataataaatgttgcgaatatcttcttcaaacttaaatttaatttgctttaagcgtccgatatattcacgataaaacacaagtgcatcagcgtcagagatgtcgccaatccaagcatcttggttagcaaccaaattacttataaagattaaagcaagttcctttaatttatatttttctgataacttctggaaaaaatacttatcccttcgcttttgataagcggcatcagacacccgcatgcaccaattatacttaataacatcatactttccattcatatgttgttttatcattaagtataatttataaactgatttaccatcaatgtatctttcaccaccagcaggcatgcggagtttaatcatagcagaaaatctaatgtattagttttttcacaacgaacaacagaaggacgtaaaagattttcgtcaatggcttctgactgaattttttcaattatacccgaaggaataaatttagcaaattgagtttcaggaatagagttttcttccaagaatgctgtcgtagcttcaagataactcattccaaattcttctaccattttttcaataataaatccattttcttggcggtcaagaagctttgcaatttcatccttttctttcttaattgaaagttctttttctgaaagaccggtctcatcgaccgggcgaatatcatttagagaaaactgtgtcataaagttcaactacctcttcagtttcagcttcaaacacatcacggttatctttatgatacaaagctaatagacgattaaacatcttaccatcaacgccaagttcatctttagcacgaattcgaatatctttaatcagttcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacgattgaagttttcattgaaggggttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttatgcatcggtgaccattgcttaacatttggatatttgtgaagctgtgtaaagtcaccgtccgatgaaatgattaaaatcttatgtccttctaaagagaactttttaacaagaacagcaatgtggtcatctgcttcatacttatcaatatccataacaatgtatggcatataagctttcaattcatctataactttatgactggattcaaaataaccttcccagtcccaagtagattcttctcgtgcttttccacggtttttcttgtaatagtaagcaaaatcacgacgccagtatccagatttcgcgttatcaatacacagcacaattttagtgtatccaagcgtttttgcttttttgacattaaacttaattgagttcaatatcaaatgacgaaccatcgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttgggcagcaacggataatattccaaaacctgctggaaattttaatagaattcgttggaaagcattacgtactgatgctgtatatacaactgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaagtacgttcagttttaatgactcatccaaagtcacagatgatattcatttttaataatcgtttgtggcaaatgtatgttgctgattatagcagagaagctgcgattgttactccatcgactgcgtatcaagcacaatctaatgattttatcgtacgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaaggccgtacatcgattgacggtttcttgatgtttgacgataatgagaaattgtggagattgtttgacggggatagtaaagcacgtttacgcattataacaactaattcaaatattcgtccaaatgaagaagtcatggtatttggcgcgaataatggaacaacccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaacggtgaaactaattatgttccagttttacaacttgcttatatagaagattctgatggaaaatactgggttgtacagcaaaacgttccaactgtagaaagagtagactctttaaatgcttctactagagcaagattaggcgtaattgctttagctacacaagctcaagcaaatgctgatttagaaaattctccgcaaaaagaattggcaattactccagaaacgttagctaatcgtactgctactgaaactcgcagaggtattgcaagaatagcaactactgctcaagtaaatcagaacaccacattctcttttgcagatgaccttatcatcactcctaaaaagctgaatgaaagaactgctacagaaactcgtagaggtgtcgctgaaattgctacgcagcaggaaactaatacaggtactgatgatactacaatcatcactcctaaaaagcttcaagctcgtcaaggttctgaatcattatctggtattgtaacttttgtatctaccgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacaccagaaacgttacataaaaagacatcaactgatggaagaattggtttaattgaaattgctacgcaaagcgaagttaatacaggaactgattatactcgcgcagtcactcctaaaactttaaatgaccgtagagcaactgaaagtttaagtggtatagctgaaattgctacgcaagttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttaataactcctaaaaagcttttaggtactaaatctaccgaatcgcaagaaggtgttattaaagttgcaactcagtctgaaactgtgactggaacgtcagcaaatactgctgtatctccaaaaaatttaaaatggattgtgcagagtgaaccaacttgggcagcaactactctgataagagggtttgttaaaacttcttctggttcattaacgtttgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgggtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattaacggaaattatggtttcattgttcgcaatgatggatcagtaacgaattttatgcttactgcatcgggtgatcagactggtggatttaatggattacgtcctttagctattaataatgcatctggccaagtaacgattggtgaaagcttaatcattgccaaaggtgctactataaattcaggcggtttgactgttaactcgagaattcgttctcagggcactaaaacatctgatttatacacccgcgctccaacatctgatactgtaggattctggtcaattgatattaacgattcagccacttataaccagttcccgggttattttaaaatggttgaaaaaactaatgaagtgactgggcttccatacttagaacgtggcgaagaagttaaatctcctggtacattgactcagtttggtaacacacttgattcgctttaccaagattggattacttatccaacgaccccagaagcacgtaccactcgctggacgcgtacatggcagaaaactaaaaattcttggtcaagttttgttcaggtatttgatggaggtaaccctcctcaaccttcggatataggagcaatcccatctgataatggaataataggtaatcttactattcgtgatttcttacgaattggtaatgttcgcattattcctgacccagtgaataaaactgttaaatttgaatgggttgaataagaggtattatggaaaaatttatggcagagtttggacaaggatacgtccaaacgccatttttatcggaaagtaattcagtaagatacaaaataagcatagcgggttcttgcccgctttctactgcggggccatatgttaaatttcaggataatcccgttggaaatcaaacatttagtgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtatcatatgctgctttttatacttcttctaaaagagctattgcattagagcatgttaaactaagtaatagaaaaagcacagatgattatcaaactattttagatgttgtatttgatagtttagaagacgtcggagcgacaggatttccaaaaagaacttatgaaagtgtagagcaattcatgtcagcagttggtggaactaataacgaaattgcgcgattgccaacttcagctgctataagtaaactttctgactataatttaattcccggtgatgttctttatcttaaagcacagttatatgctgatgctgatttacttgatcttggaactacaaacatatccattcgtttttatgatgcatcaaatggatatatttcctcgacccaagctgagtttactgggcaagctgggtcttgggaattaaaagaagactatgtagttgttccagaaaacgccgtaggatttacgatatatgcacaaagaactgctcaagcaggtcaaggcggcatgagaaatttaagtttttctgaagtatcaagaaatggcggcatttcaaaacctgccgaatttggcgtcaacggtattcgcgttaattatgtctgtgaatcggcttcacctccagatataatggtacttcctacacaagcctcttctaaaactggcaaagtgtttggacaggaatttagagaagtttaaactgagggagccttcgggttccctttttctttataaataatattaaaataaaggggcatataatggctgatttaaaagtaggttcaactgtgggtggatctgtcatttggcatcaaggaaattttccattgaattcagccggtgacgatgtactctacaaatcatttaaaatatattcagaatataataaaccgcaggcagctgataacgatttcgtttctaaagctaatggtggtacttacgccggtccaattactattaattacggggtaaatagttatcttcaattaagtaataatgaaacccctatccgaattcgttctggtggcggcactggtaatactcttgtagttggcggctcttccggtggtattagttttagacctgcaggtagtgaaatcactactggacaaattactattacgccagaaggtttgacaacatttaccagggctgtaacggctccatcggtaactgttacatctactccttccgcagcatctgatgttactcgcaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaactgcaggtcaacgtcctgctgcttcagtattagccgaaggtgaattggctataaacttaaaagataaaacaattttcacaaaagatgactcaggtagtgttatagaattaggtttaaaatatggaggaactataaatgggtctttagaggttacagaaaatataactggaactttaattggaaattctagcacagctactaaattgcaaacacctaggaaaattaatggtatatcttttgatgggtcaaaggacattaccttaactccatctgacataaatgtcaatagcacaacatttataaaaaataatggcgaattacctactgatgctaatttagatacgtatgggcccattgaagaatatcttggcgtttggtcgaaatctacttcaacaaatgcgcaaccagcaaataaattcccagaagaaaatgccgtaggtgtactagaagtgtttgtggccggccaatttgctggcactcagcgttatactgtaagatctggtaacgtctatattcgttccttatctgctaaatggaatggcgtcgatggtccatggggtgtgtggcgtaatgttcaagcgtcaactcgtccactttcacaaacgattgaccttgatagcttgggagaattagaacattgtggcttatggcgaaacagttcaagcgcaatcgcatcatttgatcgccattatccagaagaaggatcagccgcacaaggatttttagaaatatttgaaggtggtttatacacgagaactcagcgttatactacccgcatgggtatggtttatactcgttgtctcgctgctgcatgggatgctagtgcacctaagtgggaggaatggaagcaggttggtcatggcacaccagcgactttctatgatggagatctgaatgattttaaaactcccgggttatataatattttaggcactgatgccgttattaactgtcctacaggtgaaggtttgccgactgttattgttggtttgctggaagttaaacagcgtgcttctggcggtgctattttccaacgtttcactaccgcaggaacgggtgcaactactcgcgatcgtatttttgagcgtgcatatactggtggtgcgtggggtgcatggaacgaagtatatacatcttattctctgccaattactttgggtatgggtggtattaaagctcaattagcggagttagattggcaaacctttgattttgtccctggtagtatgtttagtgttcctttgaacaaaataaagaatatgccagcaaatatggattggggcacgattgatggaaacctggttatgttttctgtcggtcctagcgaacataccggaacgggtcgaactgttcaagtgtggcgcggtactgtatctcaggcgaactatcgttatttcgttgttcgtatcgctggtaatccaggaagtaggactaatacttgtcgtcgtgttgttcttgaagacggatcacacacttggactgctcaacaaaactttaggggattgctgaatatcactgctgctgttaatcttggtgctaatcagaaaatttcacttgctccaggagcatatattcaagcccctgctagcggttctggttctaatacttacgcaaatcagaatactaccattgcgccattatatcaggctattgacgattcaaataaaaaccagtttgcgccaattgttaaacagaaaaacactgtaacaaatattactatggcttctggtatggatattgctagttcagaatatcgtatcgttgctcagggtgatttatccgctactggaactacagccactaaattagctacatggcgtttcttgccgtctggccgattcatgtcacaaagccgagtttatgctggcgcagcattcttgaacactgatggtaacattgctggttcaatctggaagaaatacaacgatgcaaccaatttagatgctgccttgaatactcgcctaggtaaaggcggtgatacgatgacaggtcggttaacaatcaatgcacctaatgattctattgtattatcaacaactgctagtaattctttgcatattcgcggtgacatagacgggactggtaactggtatattggcaagggtggtgctgataattcgctagcattttatagctatgcttctcaggcggcagtacatatcacaaacactggtgagattgcgttaaacccgcaaaataccgcaatggttaacgttaaccgtgaccgtgtacacattaacggttctggatggattgctagacaaccgggtgattggggcaaccaatggcgagtagaagctccattattcgttgatcatggttatgttggtcaagatagttattatcctattcttaaagcaagaagcgttataaccaatcaaggatatagcaccgctgttgactttggtatgcgtcgtattccatcacagtgggggcaagcaatcattcgtgtcggatccacggaggcttctcctgatgctggacacccacaagctgtgtttgaattccatcatgatggattcttttatacaccaggaaatggtagctttagcgatgtgtatattcgttctgactcccgtctcaagattaataaagaagaattagaatatggagcagtcgaaaaagtttgccgactgaaagtttatatttacgataaagttaagtctattaaagaccgtagtgttattaaacgtgaagttggtattattgctcaggaccttgaaaaggaattaccggaagctgtatctaaagttgaagttgatggatctgatgttctgacaatttctaactctgctgtgaatgctcttttaattaaggctattcaggaaatgagtgaagaaattaaagaattgaaaacgcctctctttactaaaattgctcgcaaaattagtaaatattttaaattctaacaacaagggggaaatgccccctttggagtataaattatggcagtagttggtgttcctggttggattggaagttcagccgcaaatgaaacaggacagcgctggatgagtcaagcggctggtcaattaagattgggtgttccttgctggatgagtcaatttgcaggtcgctcacgagaaattattcatactgtaggagcaaaccacaattttaatggtcagtggttccgtgatagatgctttgaagctggcggtgcacctattgtattcaatattgttggtgatatcgtttcttattctaaagatgttcctttattcttcatgtacggagatacaccaaatgaatatgttcagttaaatatacatggcgtaacgatgtatggtcgtggaggtaatggcggtagcaatagtcctggctcagctggaggtcattgtattcaaaacgatattggtgggagactaagaattaataatggcggagctattgcaggcggtggcggcggtggcggcggcggatattattctcctttttcacaaatgagattgacctttggtggtggtggcggtcgtccttttggtgcgccaggaggatctattgatatgcaatcaggcgcgactggcggtactatttctgcacctggctcaggatccgtgaatggtatctataatggtggaaacggtggtgaagtaggttccgcgggaggtagatgcaatattcgcggtcaaggatctgaatataatggcggcgctgctggttatgctgtcatagggtccgctccaacatggcaaaatgttggagcaatatatggtccaagagtataatgtgaataaatacccttaaaaggagggtctatggcagcacctagaatatcattttcgccctctgatattctgtttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacaataaccatgtactggtatagaaatgatcatataagtaatgaccgccttgaatcaatatgtgctcaggcggccagaatattaggaagggctaaataattatttgttcgtatacatctctagatatcgatatacaccctcaaaaccctcgttgaattcgtcgatgagggttttcttatcttcttgagttaattcagaaacaattttacggaatgaattctgatttaactttctaccttcatgcgttactccaatctcattcagaaatgcaataaaattagcgcgattctcaacaatatcttctctggaaaatttaatcaaaatagacgcaacagtaataatttcacgaactgtatcaatatttttattcattaactataccactcaattagttgactttgttataatatcatcagacgtttgatttgtaaactggtctgtgttattttcttcaaaaattttttctacgaattccttgaacgactcacgttcctgagctacattatgctcgattaccatttcaagattataactcattcgaaataatcttcaatttcataatcatggacataaatcattatagtttttaatacatcatcaatactttttcctggagctggaattacgtaaaaatatcctgcttttgagaggtctttataagttccaatcaagaaatcattattctcaagatgtagttcttcaactaattcattaacaattgagtggtataaatttggtagaaacttatatagcttttctagaatatcaattttgattgtatattgaaccacagattgagaatcaataatcatagaccttccccttatgtttctgtttgcgattagattctttaaacgctttcttcttatctttatggacagaagctttattaaaattatgttttgcgactaaattgttcataatgctgaattacctctcttaaacatttgcatgtgaatgaaaactttttagctacaccacattcaaatatatgttctcttaaatcacgtgtatcagtatatcccatctcaacaataaaatgccgtattagatttttatctttatcattgagagaattaaaataatcagattttgaattaatttccctggccaaattgaatcaccttcagttgacgttttaattcttttatcatttcttcgttcatcgcaatataaagatcgcgtaaagcaggttttagcattccatttaccggaaaactaaatgggcatacataatcttttcctacgagctttttagtgaattccatatcacagaactgaaatgccggttcatttgtataaattccccaattagttgacatcattttattggcatattccaacgcctggatttgattcttaattccatcaatttgaaactttttaatattcattagtaaaggtcctcagagtaaagttctttttcactaccaccacgttcaatacgcacttgtccagcgtaagttgcaataatcattgcttcttcacgtgtccagtaattgctatactggtcaataaatccttggtcttcaccacaaacatggtctgatacaagtttatcacttacctggtcaagaacttcagccatatctttagaataatgacgagcaccaggaataaccagagtcccaccatcttttaacttaaagcggttggctgcacacacaattcgacgttgatatttttcattattgttccaatgagctacttgccaacagatttcaggaacctcttctaaaacatcctcttccgtatattcggtgtagtcgccataggcctgtaatttagctgctagactttctggagtttcacgtaataaagccaggtctaataattcaagacgctctttgaaggttttcatttggtttcctcaacacttttaatttttatagcttgtttagaactttcaaagcattgacaatatactcttaccgcatcaaactggttggccgctttaagatggactacaccttcgccgttataaaattctacgacaattttaaatgttttcatttaaaccatcctttaatacgttgccataaagttttctgttgagctttgttaacaccaattgagcgaataactggttgagattcatggaattctttataatcagcaaggtaaatttcgtaagctgaatccataaaggaacttatagctgccatgaaattattgcgaatacctactggagcatctttactttcacgaataatcatgtatttgccagtcttaatctttacgatagttccaagataagctccatggtaccagatgtcccaaccctcttgagtaggttctacacaacgacgaagttcattgacaatttctaacttgttcattatttattcctcacagttcagatgctacagtgattacagcttcaatgttttctgccgaacgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactgcggtaagtttcaacctttttaagaacaaatccattttcatctaaaagttttaacatgaagtctttatcttcttccatatcagaagtaatttcgcgagctttacgagttgctcgttttttcagcagttccggagcgttttcctgtgcgtataaagttgctgcatttgaaataatatcctgagcttcaccagtaatgattaatccatcaccagatttctccaccaggccttttttaatcaataccccaatattactattaactactgcattgcctaaatctggatgcacctcacgaacttctgcagctgtaatgaaatctttcttagcaatggtaattaaaatcgcagcagttttttcattcagaatatcgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcattttttgtatctccgggttgtttgtttcagttcatttatttgatagttgtatagtaccacagtatgctttggttgtaaaccgttttgtgaaaaaatttttgaaataaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagcttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatggcgttcttcttcattatcgctcaaagagtattcttttcggaatttaactttgaagccaaagccatgctcaccacaagcatcatcccatgtaatgaagcctttatcttcaagcgggtctaagattttactcacataagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgcagtacagctttcttgacagaagaaacactatgaggaagaatgtaagttgcataaccagttgcaataccggaaacgccattaagaagaacagtaggaataataggcaaatagaaagcaggcggaatgtgttctttatcttgatgtactggagcatattcagtatctttatatacgttatagaaatttttacttacacgagcaaaaatataacgacttgctgctgccttttggacagtacgagaaccaaagtttccttgaccgtctaacagaggaaagttattattccaagtgttagccatcaaagcacctgcgtcttgcgcagagttttcaccatgatgatatccaaggtccgctacaccgcctgcgatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcacgattattcagttgcataaatttaccatactagtgaatgtagtgccataataacatcagaaatgaaaagcacgacttgaattaatccgaacattattccgtaatataatgctatcaataaaatagcaagggctaatgaatagcccaagattttcttaatcattagtagataacaacacaaatgttaaatatgcacacataccctgagctaaagcttgcgaaaacacactgctgacatcaatacagatagttaaaacacatgctactatccaacaaataaatgaaataactcctaataattttgcaatattcatattttcctcactggcgtccgaagacgcctttagttttaaaattattacgatagaactgcatcacatgttcgttgtggaaattactcattaatatgcctgcaaaacgaatttaaagttatcagccaacatacggttcatttcttcaagtgtttgatactcagaatgatgattacgaataaacgccaaagctaactgaccttttccaaatcccgtagtcagaggtttcatcttagaagcaggcagataaaatactgtgtatggaacattgttatttgcaatagtacgcgcaagctgagaccgacgttgacgaatatgacttagaaccgcactaaatccttgcttagaacgctgattacctacataaaatcgtgcagacacacatggattactaaatggacgaccatctaatttacttactaaaaagtaaaatccaggtttagataaaatatctttatgtggaactcccaaaaaccattcaccgttcttgattgtaccaataacggtagcgcctgcattattcagatcagtaacagtcatgtatttcatattaatttcctctaaattattttctactccaaggccgcatgaatacacacggccattaaattaatcgtcgcagtcgacgctcaattcccaaaactcttctacggtataagtttcagtatcattttcaatacagaaacgttcattactattgtttgctaaagtagcgttaactgtcggtttctcgctagtgctcttaagaggtgaaatacgaattaactgatcaccgttatctaaacagaaaatttcaccaacttttacatctttaaagattttcataattcacctcaaggagtataaaatccaaacgcagttgttgaccatcccatccaatatggaaaatttgcgccaatgtaaaacataagaatataaaaccaaccgctcagcaaattcatcattttacaccgttccaaattgtttcaactacggattttaaaccattttgatgaatatcaattccgactactgtcatcaaatagattccaactacaactgaacctaaagcaaaaatcagcatgaaaatgaataaagccggaaaaatattatcgaaaaaccattcaataaatgtaaaagcactgcgtttacgcttcatattttcctcacataaatccaaagtaagcgtttaatacatcaatcattaaaacgattgggaatatactcaaaactattagtattataactacattccatatagctttaacaatctttttcattttctgttcctccgtagttgatagggtaataataccacggaagaacagtcttgtaaacaacttttttaaaaatattcgtaataaatgtgaataccaactactactgctgaaacttgcgcaacccaccacgcacaagcaataagcacagaattcaaaattttcataataacctcatcacaaaagtaaatgttaaacaaattaatggaatactaattaaccaaacgaaacaccaccataatgaactcatagttcaatctcaacgatttccaagtgtttttgttttattgcctttttaacacaatcatggactaaatatgaccatgaatcattatattctccattaactaatcgttggagatcttcacgtgatgataagtaaggttgatctgattcccattttgataaaaatactgcagtaaaaatatctccttcatctgtagttgaagtcgtaaatgcaataaattcaccggtaattttatgtttagcgtaataaaatttaaatttcatttttactcctccgtagctgatagttgtatagtaccacagtccttgtggtatgtaaaccgttttgtgaaaatttttaaatggaaagataccatccattgtagttgctttttcttacaaccttacgaaggtcttctctgtcaccgatgaacttcggagtgtactggatgacacctggatgaatttctttagtgttgaatataattatacagtcagcaacttgatgatttagaatgggccctagatttattccagaaccatatggatactctccgctgcatcctgttgttaccgaaatccaacgtgagtcagtttgatgtgtcttaacttctacacgaagcccgcagtattttggatgcgccagtacatcccatgcgtatgtatacgggtcattaacatcctcttggcctttgttaacataccctcttagccaatctgccacaaaaaactctgcgtacacagcgatacgacatctttcgataacttctgctttatcctggttcgggttttgttttaaagagtatcttgcagtatcagcaattttgaccttcatttcactagtcaagtcactgttcgatagggtaaatgacggaatctgaaatagtctctgcaaacccggattcgttttctgcatttaaactttcctttatgtcggaatcataatttcccttaaaacaaaagggccgaagcccttattttatttgaattgtgcaattcttttttctaaacaatctgcgtaagatttcattgagataaactgcgaaagtagcaattcttgctcaactgcactaaccgttagaaactttgtgctttctaaaaaattgctaagtgcattaattttgagcattaattgatcgtattcttcttttactcgtgcttgataacctaacataattttccttagttaagggccgaagcccttatttaaattgttcagtaacgtcttcaactacttcgtattggcaggtacgcattttagcatcgttgtaatcaatcggaattgatactacatcacgcggatgtactttaacttttacgactcggctggttgaactgccaaagtgacgaatataagatttagaacatacatgcaaaccgcgggaacaagtttgcgtatcatcgtcattcacacgagtacgcggcattttaactactttaccaggactgttatcaaaagtgtttgagtgacaatcaaagtaattgctacgaactactttccaagcatagaagtaaccatcttctgtaatttcaatatcgtttgctaccaagaaatcaaagagtcgagataccgctttctggcttgggttttccagcagattttccaagaacggaaaataaaattcaaagttttcgcctttttccatcgaatcaagaatacgatcaaccaaaccagaccgcaattcaatattttgatagaataagcttccaccttcaattcgaacatcgccggaaatatatttttcaacagcgcgacgaacattaattttttgtgccgcttcttccaacttatccgctacaagcagattaagaatttcctggaagtttgaatgagtattaggagttgcgttataagttacaccgtcaacagtaattgaaatgaattttttagatgcattccaaataatgccagatttagcaactggagcaataactgcatcgctattaactttaactgtaatgtcaccgctaatagtaactttagagcgttctgcttcttcagcatttttcaaaacacgacggattgtgtcaaccgatacaccttgccaatcagccaattcctgctgggtgtaattaccacttgaatacagtttaacaatttcagcttgttcgtttttggtcaggcatttaatattgtacat

SEQ ID NO: 16 - protein, 551 aa, synthetic construct
  REGION 1..551: note = targets E. coli
MSGGDGRGHNTGAHSTSGNINGGPTGLGVGGGASDGSGWSSENNPWGGGSGSGIHWGGGSGHGNGGGNGNSGGGSGTGGNLSAVAAPVAFGFPALSTPGAGGLAVSISAGALSAAIADIMAALKGPFKFGLWGVALYGVLPSQIAKDDPNMMSKIVTSLPADDITESPVSSLPLDKATVNVNVRVVDDVKDERQNISVVSGVPMSVPVVDAKPTERPGVFTASIPGAPVLNISVNNSTPAVQTLSPGVTNNTDKDVRPAGFTQGGNTRDAVIRFPKDSGHNAVYVSVSDVLSPDQVKQRQDEENRRQQEWDATHPVEAAERNYERARAELNQANEDVARNQERQAKAVQVYNSRKSELDAANKTLADAIAEIKQFNRFAHDPMAGGHRMWQMAGLKAQRAQTDVNNKQAAFDAAAKEKSDADAALSSAMESRKKKEDKKRSAENKLNEEKNKPRKGVKDYGHDYHPDPKTEDIKGLGELKEGKPKTPKQGGGGKRARWYGDKGRKIYEWDSQHGELEGYRASDGQHLGSFEPKTGNQLKGPDPKRNIKKYL

SEQ ID NO: 17 - protein, 490 aa, synthetic construct
  REGION 1..490: note = targets E. coli
MDKVTDNSPDVESTESTEGSFPTVGVDTGDTITATLATGTENVGGGGGAFGGASESSAAIHATAKWSTAQLKKHQAEQAARAAAAEAALAKAKSQRDALTQRLKDIVNDALRANAARSPSVTDLAHANNMAMQAEAERLRLAKAEQKAREEAEAAEKALREAERQRDEIARQQAETAHLLAMAEAAEAEKNRQDSLDEEHRAVEVAEKKLAEAKAELAKAESDVQSKQAIVSRVAGELENAQKSVDVKVTGFPGWRDVQKKLERQLQDKKNEYSSVTNALNSAVSIRDAKKTDVQNAEIKLKEAKDALEKSQVKDSVDTMVGFYQYITEQYGEKYSRIAQDLAEKAKGSKFSSVDEALAAFEKYKNVLDKKISKVDRDAIFNALESVNYDELSKNLTKISKSLKITSRVSFLYDVGSDFKNAIETGNWRPLFVTLEKSAVDVGVAKIVALMFSFIVGVPLGFWGIAIVTGIVSSYIGDDELNKLNELLGI

SEQ ID NO: 18 - protein, 271 aa, synthetic construct
  REGION 1..271: note = targets E. coli
METLTVHAPSPSTNLPSYGNGAFSLSAPHVPGAGPLLVQVVYSFFQSPNMCLQALTQLEDYIKKHGASNPLTLQIISTNIGYFCNADRNLVLHPGISVYDAYHFAKPAPSQYDYRSMNMKQMSGNVTTPIVALAHYLWGNGAERSVNIANIGLKISPMKINQIKDIIKSGVVGTFPVSTKFTHATGDYNVITGAYLGNITLKTEGTLTISANGSWTYNGVVRSYDDKYDFNASTHRGIIGESLTRLGAMFSGKEYQILLPGEIHIKESGKR

SEQ ID NO: 19 - protein, 548 aa, synthetic construct
  REGION 1..548: note = targets E. coli
MAKELSGYGPTAGESMGGTGANLNQQGGNNNSNSGVHWGGGSGHGNNGGQGNSNSSGSTSTVMKTGESYLTPWGDVVINNDGLPVMNGIVMTEENSTLVDNPFGGVSRVLNSLISDMPSLFAESSGNNNNNTASVNTAPTNAQVSDMDKSSKVVGNVINEKQKQKNKIATQISEKQKKIEEMKKVFKHHSYHGITDLERDVDELQKKSNQLDADISKLNSYKNTLQSKIGDVNKQKEAEEKARENAEVAEHETLNEEKQAVAEAEKRLAEAKAELAKAESDVQSKQATVSRVAGELENAQKSVDVKVTGFPGWRDVQKKLQRQLEAKQAEYSAVENELKNAVSFRDGKAAEVKEAEQKLKEAQDALEKSQIKDAVDTMVGFYQYITEQYGEKYAKIAQDLAEKSKGKKIQGVDEALAAFEKYKNVLDKKFSKVDRDAIFNALESVNYDELSKNLTKISKSLKITSRVSFLYDVGSDFKNAIETGNWRPLFVTLEKSAVDVGVAKIVALMFSFIVGVPLGFWGIAIVTGIVSSYIGDDELSKLNELLGI

SEQ ID NO: 20 - protein, 576 aa, synthetic construct
  REGION 1..576: note = targets E. coli
MSGGDGRGHNSGAHNTGGNINGGPTGLGGNGGASDGSGWSSENNPWGGGSGSGVHWGGGSGHGNGGGNSNSGGGSNSSVAAPMAFGFPALAAPGAGTLGISVSGEALSAAIADIFAALKGPFKFSAWGIALYGILPSEIAKDDPNMMSKIVTSLPAETVTNVQVSTLPLDQATVSVTKRVTDVVKDTRQHIAVVAGVPMSVPVVNAKPTRTPGVFHASFPGVPSLTVSTVKGLPVSTTLPRGITEDKGRTAVPAGFTFGGGSHEAVIRFPKESGQKPVYVSVTDVLTPAQVKQRQDEEKRLQQEWNDAHPVEVAERNYEQARAELNQANKDVARNQERQAKAVQVYNSRKSELDAANKTLADAKAEIKQFERFAREPMAAGHRMWQMAGLKAQRAQTDVNNKKAAFDAAAKEKSDADVALSSALERRKQKENKEKDAKAKLDKESKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGK

SEQ ID NO: 21 - protein, 276 aa, synthetic construct
  REGION 1..276: note = targets Klebsiella
MSDTMIVVATPTPGFSYASGLTYGGGAFAGAPANGPSEGQIFFQTVLPAYQSPNLCIGQLAWMTDYINKNGVGNPKTWEVISQNVLIFCSADTALVLNPRIAVYDGFHKTKWAPAKFNFKTQSQEKFSGNVTTPIAAFGHYLWGEGKPRTVDLSSVGLKIQANQIDPVMIAVKNNAAGTYQISGNFNRNTFIDGDIPGLYLGNITMKTEGTLKIDAKGNWNYNGVVRAFNDTYDANPSTHRSKSAEDLTTLLRLTQGTPYEIRIPGELKVSGSGKK

SEQ ID NO: 22 - DNA, 152130 bp, synthetic construct
  source 1..152130: mol_type = other DNA
atgcctaaactaaaacgtggtcgtggaagaccaacagccgaaatgcaacagatttacgcaatggatgcggcgcaagcaagtgtaaaagaattatttgcagagcattatttagaagctatgcggtatattgttgaacttgttaatgataaggatgcagcaaaacctctccgcttccaagcagctaaagctattaaagagcaagtagaagaatggttagaagaacattatgaagctatggaagaagaaactcctgccgtgcagaatacagatgacgttcctaaaaagatcgtaatctaatccctctcctctcttggggctttgcccctcctccttgttatttttaacacccctctccgaaaggttaggggcttttttatttttaatgcttgcaattgtatatcattttatgataagatcagatatgaggaggataaaatatgcgcaattttgtagttaaaaatgattttaaccgttcttcttatcataaagataaaaagaatgattacacacgggcttggaacttggaggaagaactttatgatgacagagaagacttgggaagagatcctagcggaggctcaaccaatggaagtgaagaagatagttaacaacgccccttctcttcctaaaataaaattttatgaggaagtagaagataatgaatctaaagactaaaactgtattaagttttgttttaattgttgttcttattcttgccggaatgtttgcttataacaagatacgtgagtctggctacaaagatggtgttgcctatcaaacgcaagtatatcaagcagcccaagcaaaagcaaaacaagattttgatgttcttcaaaaaagagcagatgaagaaagagcattattaaatactcaaataagcaacttgtctaaaaacaatgcacaattaaaagcagatttagagaagaagaaacaaacgatcaatgaggatacaacgaattatgcaaaaactaattctggcagtatgtcttgctttgcccctaatgatgacgggttgttcatcatcaacaaaagtttccccagttcttattgatgagtgtaaggctgtagccatagaaaaggttaaaggtccagattcggacttgatggataaagtatcgacacctgtgccatacactaaaaatcaaattgcaaaaggggttagtagatctgaagttgttaacaaccaaactcaaaacaatgctctttgggagcaagatagacgaaaggttttaggtttacaaacatatattaaaacactgcaagaaaaaggtattattgctgaataaggagggaatgtggcaaagaaaaaggcagcaggtagtttagctggagtagatattgaagtaaaggctcaaccaggtaaacagactcttgcaatggatttaatgccagaagttatgatttatggtggtgccgctggatgtgtttctgctgaaacggaatatcttacaaaagatggttggagacagattagtgaatattcgggagaagatatttaccaatacaaccctaagaataagcgtttagaattggtaacaccttactttgtagaatacgatttaaatggagataatctatacagaataacaaatggtgtaggattgttccaagaacttagtatggaacaccgttttgtattctataagaaaaagaaatcaaagaaacatttcgagattcttgtaggagatcttattgcattacagcaaataggaaaacccctgcaaggttatgtagaaaatccattcggtaaacgtgttccttttaacatacctggtaaaaagagcacttacttaaaaatacacgaggttatttcaacagatgataagaaatattgttttgagactccaagcagctatattgtctttagacgtggcgatcactgcttcgttactgggaatagcggcaagtctcgtctgctattgctgaaagctttaaaatacgcctacaaagaccctttgtttggtggaatacttttccgtaagaacaccactgctcaccgtaaaccaggtggtctgtttacagaagcaaaacgtttgtatcttcctttacaaccgcacgtaaaagaaagtacaatggatatcatttttgaagccactggtggtggaaccctcaaatttgaccatttggaaaatgataacgtaacagcagaaacaaaccatcagggtacacagtattcaatggtaggttttgacgagttaacccacttcacgcaatatgaaatgctctatcttctgggacgtatgcgttcagaatcagaaacaagcttcatgttgtgcacatgtaaccccgatgcagatagttgggttttgaattgggtattaccttatctcgatgagggtggttatcctagagaagatatgtgtggtaaacaaaaatatttcatcattgttaacgatgaacctgtttttgctgatacacctgaagaactgaaagaaaaatatccagaaaactgtttcatggaaaaccctaatacaggggagacagttgttattgaaccacaaactttcgtatttatcggtgggacaatatttgataacccagaattgattaggcttaaccctaattatttagcacagcttaaatctcaaacagcaatcaaaagagcacaactcttggacggctgttggtttgcacgtatacagaaagagtctttcttccaacgtgaatggttgcataagatatcttataaagatgttcctaataatcttaaactaatgcgagcatgggataaagctgtttcagttcctacagaaacttatcgttatccagactatacaacatctgtcaaaatgggtaaagaccaagatggtaatatctacatctttggtgactatgattatgatgctgtggatgagaaaagtaaaattttcggaaggtttcgaagattacctggggaaagggataacctgattctaaatcaatgtaagattgatggaccagaagttacagtagttcttcctaaagacccatctggtgctgggacaatagaatatacagagtctgcaaagaaacttattctagagggttttgttgttaaaccagatgctatgccaggcaacaagaaaaagcttcagcgttttatgccttttagtagtgcgtgtcaaaacggttttgtttatattgttgaagattctttccctaatgtggaaactttaacccacttttataaagaattggaatctttcaatggtgaaagatctacagccactattaaagatgacattcccgatgctgctgcttcttgtttcaatactctgtcaaaagagaatactttcaaagcagtagcaatccctgcaacaacaaatgctcctacaggatacagtagaatgaacagcggatttcaccaaccgtatagtgtccgtaaaagataattgttgacaaaagtcactttaaagtgtattataactagataggtgaggttgtatataatacagccttgccttaacgattttatacctgactggaggaacaagtgtcaacaggaaaaaaaacgtacactaaaaagtcagaatactgggacaaaggtgctgcaaataaagctgctctctctccaacaaaagaggcagagaaagagaaaacgttactcctgtcacctgaaataggaacgatcggattaaactcaatcaaagcatttacgaatttcatgcaaccttatgagactcgtttcccagaatgtattcgcacttttaaagagatgggtgaagaccctgatgtagctactgctcttgacgctacatatatctttgtagatagagcattctttgatttcaagataaaatacaatgtaaactcggcaaagtcaagaaaagctgctaagtttattgattacatgttacgcaatatgcaagcccctctacgtcaatatgttagatcacttttgacatataagcaatatggttttgcattcgcagagaaagtttatgagttggatgaagatcctaaaagtccttactttgggtattggagattgaccaaactggcttttagaccacaagacactcttcacatggctcaaccttttacatattcggcagacggacgttctattctatctgttaaccagaatatcaccaatacgatgttagctccaggtaatacaactttagaaactggtattaaagaaattcctttcagtaaagttttatttgttggtagcaacattacagagaataacccactaggagttagtccgcttttagctgtatatcgtagctggcgtgaaaaatctcttattcaggaatttgaggttattggggtatctaaagatttaggtggtatgccagttcttaaggttccaagtgacattctaaacagggcatctttagatcctgctggggatgaagcacaatctcttcgagttctccaagccaacatcgctaacctgcactctggtgagcaagcctacatggtattgccttcagacgtttatgaaggcacagtgatgcgtcaatacgatcttgtattccaaggtgttgatggcacgggtaaacagtttgacactcaagcactaatcaaacaacgcaaactggatatttataaccgctttggtgcaggtgtgttgattatgggtgatggtgatgcaggaagttttgcgctttctgacaacaaacaaacactattgtctcattttattgagcgagatgtagatattgttgtagaagctataaactctcaactgatccctcaaacactacgactaaacaatatcttcctttctgatgaagatatgcctaagtttgtcagtggtgaaatgggtgatcctgatattgaagtaaatgctaaagctattcagcaattggtggcctctggtgcaatacctttaaccccagaagttattaacgagttccttgaaaaaattggttttgaatatcgcatccctgatgatattgttgccaataaagagaaattctttgaattcatggataactatatgcctgacaaaacttcacgatcaggagatggtttagctacagcgggaactggaacgtctgatactgtttctgctttagatccttcagcacaaaacctgtcgaattaaaaatatttaatattttttaatttttctattgacaaaacaacaaatatcctgtagactaagatttatgggatatctgtttttaagaggtttcaaatggaactcaataaagatacactgtgggaactcttcaaaacctttgctggttttaaagagaattctgaatcccaacaagattctataccatctcaaaaacctgaaactttaatcaaacaaaataaatttgatgaagaaaagatgcaggttattgaggtcttgtattgtccacctgaagaagacgatctccacggagagcgaatgtctgatttggaaatcaggaagatggttgacaacttcaatgagaacattaccaatattagtggtaatcttggtcacatgaagaacaccgataagttttctccaattaaagcttgggtaaatgaagtcgattgttacattggtgacgaactcgttgtggaaggaactcccctcgttaaaatccaattcaacgaccctgaattatatcaagctcgtaaagacggcgttcttaaaggtttgagtataggcgcaatgggcgttaaagtcaagaaggactaatcgtggcaaatacatatttaactaacgtagacttttcaggaaaagctacggaagagtcactaggtgcgcatattgcttacacttttgattttcaaggtggagcagcatctggttataatactccccttttatttaagtcagacggatctccagacataacttttgaaaagttagaagctctcactaaaatgggagaagatgttacagagttacgtaaaagctatattcaacaagtaatggatcgcatttctgaaaaagtgcgtgaaaaatttgaagctggttgggattgggtttacgttattgatgctgacttcgatgcgaacgttgcaattttctgttcagataatggtatgttctctgttggctttaaagttgacggactgaatgttgaagttgaagaggttgctaaacctgttgttcgtgttactgattatcaagttgttgatggtgatgtaatgatctccattgatttctttgaggacgttttagacgatgctttgagtaatctcgttaagagttccttgaaacaaagtcaagttaaagattatttagtgaaagctcacgctaaagctaatacaaactctgtggatgcagaggctaaccccgcaggtgataaatctgcaaacacaactggaatcaataaaggagaaacccctttggaaaatatcaacaaagaagaattcctgaaatctgctgaattccaagaactgatgaaagcacagatcgctgaagctgtagaaaaagcagccgcagatgcacgtgcagccgcagaacttgaagcacaggaaaaaatcgctaaggcagaacaggaagcagaagaacttcgtaaagctgaacaagctcgtatcgaagaagaatatacaactgttgttaaatcctattctttcgtagaagaagacaaagttgaagctctcgttaaatatctggtagataataaagatatcgctgaaactatcgtcaaagcattcgaaaaagcacgtgcagaagtggacgcagttaagaaagaatttggagcagaacgtggtgttgatgtgatcaatactcaacctgtagctaaatcttcttctgaactgattagtcagaaagctgctgaacttaaaaaagcccagaaacaataatcttaggagattaaattaaatggctaaaggaattactttatctaactctcgccaggaattcggacacctggttctgggtggagtgtttagctctgaccttggacactgtgtacgtgaagttaacctggttaaaacagcaaccatgaaaattggttctatcctgaaagctgacaacactgaagctgctaaagctgaagctgccgatgctgctaaagttctgatttggactgatgctctgttcggtattgatgatgtagcagtaggtgacactttcaccgcagttgttggcgtacgtgatcttactctgaaccgctttgcagtatactacaaagatggctccctggtagatgacgctggcgtagcagcactggaaacacatgatctgaaactgaccgaaaaagtcgttttcacttcttaattttaataggagattaatataatgccagcagtaattttagatcaggttgtagatttcagccctatgatcgaacttcaggattcccctgatacactgattgccagcctgaatctgttcagcgttgactatcattcaactaccgctattgaaatcggtaaagaaaaagctgaagatgcgctgatctccgctcgtgagcgtggtggtgagcgtaacttcctgaccatgaaaaatccagaactgaaagcgttccgtattccgttcttccctctggataaaaacatcaaagctcaagatattcaatctttccgtagctttgcgatggcaggaatcaatgactctctgcgcacagacgctgaagttgttaaccgctatatgtcccagattctgcgtgacgtagcaaaaaccaaagagaaaatctttgcagaagcagttatgggtcgtgcctataacggcgtaggtggtgcagctaactctgcatacaactggtataccgagtggaatgctacccagaaatctgttgctgtagactttgcttctaccactgtttctccagcagccactatcgagcaagaagctcgtgcttacatcatcgatactaaacaagatggctctaccgctactcgtatcgtagctctgtgttctcgtgaatttttcgcatctctggttaactctccgtttgttcgccaggcatatcagtatttccagggaacccctaaccttctgcgtgaccgccttagcggtaacatggatgttcaggtgttcgaatggaacggtgtaacttacattgaagatatccacggtaacatccctgctggtgaagcatatgttctgcctatgggtatcgaaggtatgttccaggcgcactacgctcctgcggatactccagaactggctaacacccaggctcgtgaactgtataccttcatgatcagccagcaccgcaccattcagcttcagtctgaattctcgctgctcgcagttaacacccgtccagaactggtagttaaactgactacggcttaatagaactctgttaatattagaggctcgtccgtgatgggcgagccttttctgtttacaataagagtttacaatgaggagattgatatgtcaaacccagaattgaaacgttactttagttatcacgaaatgattcgtgatttcgaatcgctttcaccactgatcgatgctgataaaacattagtatctgcgccaccaatgtctttctatctgaaagatggtcgtattgcattaggtggaaacttcattcacttcctcacacgtttgagagaagaaacaggtattcttgtgcatccttttgcaagtgaagaacacatgggttactatcttgtaagttacgaagattatacacctgtaaaaatcaaagaagaagttttaaaagtagaagcggtagacactccagctaaaaaacgttcccttcgtaaaaaataaggtgggcttatgctgaatgcggtagagttggcaccactgatccgaattcttgtttataacccttctcaagaagtattgccagatgcaatgctgattcagatcatccagacttggattgatattatagggaatgaagataaggacaagtgtgcagtattgtggaacagtttgatttctgttttagagtatttatggaacaacgatgttcttaataacaatactcaaacaggaggagctatgtcccgcagagaaaagatgggtgaagtcgaagttgaagttaaatttaacaacggtcaagtaacttataagtctccgtgggaagatatttatcataactatttaaatggtcttatggttattcctgggtgcacggcaggacgaggagcaaccagtaaagttcttattggtggtgttgatgctcgtgagattgatcgagtaaacagcgatcctaactctgtaaatggtcttggtaatgttgcaagtgttgatcgtaatacacgcaacgttaattatttgcgaaattatggacctgtttctttttatcgtagggacaaataatggaaagtgagatcttaccaggtgatgatacggattggcaaaccattatcaaaaagatgatggaccttgaacaagttcaaatcgaagctggttttttaacaaacaaaaggcatcctgaatcagatctcactattcctgcaatagcagctattcaacaatatggtaatgaaacaaataacatacctgctcgcccttttataacagatggtgctgttatctcacagaacaatatcgctaaaaagatgaagcaggtgtttgcaaattacttaatgaataatgtcgggttagctgtttttgagcctatagcgagagcctctagagaaggaatagctcaagcgattgcaatgcaacgttatcgtcctttatctcctgtgacaattaagatacgacaagataaaggcaactattctaatcatatcttaatagatacggcatacatgataaatgcaatcgaaacaaaaatcacaaaaagcaagtctaaaaaataacttgcataaactttgtttttgatgtatactaaaaaggagatacaagtgttactagatcaatttactctccttgatctaactgaataccaaggtcgtagacgaatctacaaagaggcagttgattcagttattgctaacttagacagtagtgtagaatatgaaccatttactattgaagcggcaagcttacaaccgatatctggtaaaacactgaatgcactacctgaaggttacagatctaaggctcaatatagtttctggactaaaacagaaatgaagggattacaacaaggaacagaacagttatcagatcagatactgatagatggtaaatggtattctgtttattcccttaaagattggaccagaacatctttcttagtccatcatcactgtgttgcaatattagacgatcaaaacaactcctggtcttatggaacagaaggaggaaactttggctaatatttaccaacaaatagaagcatacgaaaatgccatctacttaaatataggtggcttccttcaagaattagtggggttgccagtctatgttatggataagccattcattaaaccggatactccttacctagcactacgtattatcacttccagcgattctggaggttggtcttaccgaagctctattcaaaatgatatgtattcctacgagatggataatacctacgagattgaacttgtagcctatcgtggaagacctaccactttgatgagctatgttctggctgctctccgtggtgcagaggaattaaaatacaaacatctctattctaaaggtcttggttttttaggagcctctaatatagctcaagccaatacgattgtagacggagataagactgaattaagagcgcgtatggttatgacgttcaacactcgtatgagtattgaagatattgctactacaccaatagaagcaatcaacatgcacatccgttcattcagagatagttacaatgatcctatccctttagatttaattctaaacagggtttatgcaattactttggttccaggcgaatactcgtcagttaatcaaaatggatcattatttaacaaccctaccgaataaactcattggaattaagtttctaacaggagcataaatggcaacttttcgtgaaaaggtagcaaccgtaactttactgtatggtgctacatcaattcgtgaaacccagttcgatattcctctgatccttacaggtcagaacgtaactggcgaagcgattcaatattactcttcttccgatgcacttttggaagcaggttatggattaaatgatccagcgtatattatggcagtcaaactgtttaacggtttgttcccaccagatcaagtcatggttggtaagcgtgaagttacaaactttactctaactccaatcgtagaagatagtgcaacttacacaattaccatcaaaaatggtaccaagaaaaaagaatttaaattcattgctgatgacactgcaactgcacaagagattgtagttggtctgactgaaatgatcaatgcagatcttgtttatggcccactgtttacagtagctaacaacggcgctgcaatgactttcactccagtagaaggtaagtttggttctattgacagcacaggtttcactcaagaaactgtctatgctaatgctattacggaagatatcgctgctctgcatgatattgatagtagctggttctggaccctttcagattcccatgaaacagaagatgttctagctttggctgcatgggtagaagagaatgataaagtttacttcttctctagctctgaacctggaattaaaacgaaagcagaagataacgttctggaacgactgaatgatctcggttataataacacttgctttgctttgtggatgaccgatgcagattctgtattcccagaagcagcagttgttggtgcaatctgttctcgtcaacctggtttaactactcttcacggtaaaacactagtaggtgtagagatcgagaaactggatcagacttcggaaaacaatattgttcaacagaacggtaacatctatcgtaaagagcatggaactctgttctatcgtgatggattgatggttagcggtttctttgttgactatgttgttcatgctttgtggtttaaagctcgcacagaagaatcactgtttacactgtttaaacaacagtctatgctgggtggtggtgttcgtgctacttcaaacggtctggctttgattcgacaagctgttctggctaacccgatccaagtaggtatcctcaacggttccatcgctaatgaagttgttacttctgaagagactggtttgcgtgtcgatctgaaacctattgtttatattccttctcgtgccgatatgaccgatgcgcaaatcaatgctcgtctggttgatgggatgaagattgaatatgtttacgctggcttcttccattacgttaaagttcaggtcaacgtcctgactaaccgtactgcaaactaatacggcgggggttaagcccccgttatcaaaataaagaggatctataatggataaaatgcttactggcgtaatggcctacgacccatctcaagttatcctttcattaggtggttgggaaccgtggggttttgcggctgatactaaaatcgttattgctaaatctaacgatattatcaacccttattcagggactgatggggacgtttcattagctttgagtcgtaaccgtttgggaacactcacaatgtctttgcaacgcacatctccagctaacgaagtacttgcaacatatgcacaaacaatgtattctactcgtcaagtagcattcagtgtttacttggaagacccacgtggctattacattagcacgattggatggattcaaagtcagcctgaagatactattggcgaaatgattacagagaaccaatgggttattggtcttaaagatgcaagccttctgcgtaatgaagttggtgtaggtttgagcacccttaactcaatctctgctctgacaattcaataataaataaagggcagaaatgccctttttatcattagagaggaaaatatgtcacaagaacaagataacacaattcaaaaatatgctcgaccagaagaagtagttgagattccgttggatggaaacagatctgttactttccgtattatgaagtggagtccatctaaagtgtttgacaggattccagaattaggtagtgttctggttgttcctatgactatgtatagcacagcaacaatgtccgcagacgaagaccttgagtcacgtattgctatggcactgatccaactttttgcaggtttggaagaaaagaatttaactgtctttttgcgtaaaattttagatgaggtttatactcaagacggttataacgttgcagaaaattttgatgaattatttatggctcacccagaactagtgttagatcttactgctaaagttctggaggtaaactacggcccttttttcaaacgaggtttcggaaaactgttcacacagcttcaggcgatgacgagtttagcagcaaattaacacctgcgattgaacatgctatcgacacagcaacgaaaacccttactttgaagtggtatgaggttattctttgcaaagtcgttaaagatacctcggaaacactgaaaacattagataactacggtgtagattatcttttaaaactatatgagtatttaacatacgaagagtatgttgaagccatgtatgttaaagacacttcaataaagagaaaacatcaaaaccagacaaataaaatgtcagatttgtttaagaaacttgtttaatccaacacgaggaacatactttgttagaaattaacgcctccagaattagtaacgtggttacgtttaaggtggacaagaacagtctcaaggaagcaaaagatgccgtgttgagtgttcagaagtttgcaaataaaatgcaacccactatgaacatgaccaagtttagacaacaaatgaaagagattgagcgtgaacttaagaaagctcaaactcaaagccaaaaacctatgcgagcacctactcccgctggagcgggtgctcctgtaggtggttctggtagacctagaactcctaaaaccccacaaggtagagaagaagaaaaagctcgtaaagcggctgaacgagaagctaaagcagcagcacgtagggaagacttaggtaatcttcgtttacagaactttaactaccgagcaagagcatttagtaaagcaagtcctggtgctatgcaagaagctagagacgttatgggtaaagctgtagagcaatacaaaaagggtgaaataactcttcaacgtatgaaccaagctcttgctcaccagttggatgctttacgcagatctcatcgtgaaaagaatgctgaaatagaagacgaggttcgcggtcgtcgccgtattcgtagagagctagaagcagaagctaaaatgcgtatacgtatgcgaaatcgtgaacttagagatatagaacgcaaccgtaagcgtgaattagctcaacaaaaacgtgatcgtgatcgtagatacggacaattaaaagaaggtgcagcaggtcttaatccacgtatgattgcatcctctttgataggtgctggtctgtttgcagggggttctgtagttggtaacacgttgatgaatactaacgaaagaattaaacttgtaagccgtggtgctgaaaacgttcagacaaacgccaacgctattttggcaatgacagcttggggtgaacagaacggtgtagactctgcaaatattattaaatcaatagataatattaaagacgttcgtgaacgtcttggtaataccgttttagctgcaaagtggaatgagaaagaagggaagtggaaaggcggtgataatggcataaatgacattatgaacttgttcggatggaatccagaacagcttaaacctttacagaacgatcctttagcttttattcaggctactgttaatgaaggtgagcgtcgaggtatgaactctgctcaaatcgggcgacttcttgaaaaccttggtgatgaccttatgcactaccaacgtatgtttagtaaaaacggcgaagggtataatgaagtattgaaaatgcttcaaagaacaggtgcaacattaactcaagaacaaatagatgcttctaaagagtttactcgttttgctgcaacagttcagcttgtaggtcaaggtatgcagaaccacttcttagagggttttgtgaaagccttacctaaagatgattcttggttggataacgttaaagtgctagatcagtttgccaaagatttaggtgaagaactcggtaagacaacagttcaattaggaggttttgctaaagaattgggagatggtttcggatcttttaccaattggcttaaagaaacattcccagataccttcggagacaacacagatcctaataaatctatggcacaaaaagcatacgaggcaacgcaaagtggagacagcaatcctgtagcagattggttgtacaatttaacaggtattgatacacaagatattggtcgtatgtggagaggagaacaaacaaggacacgtgcttttggatttggtaatcctcttgaagatttacgtgaatcagcctatacacctaacgtaagtttggctcgtaatcaacctgttgttgagaatacggtagcaataccaagtgatcttatcaaagttacgatcagcccttcttcagagtttggaaatattcttgatgcaagaattcaaaatagcggaaatagcattttccaacgtttgtctctttcaactctaagtggacaatctaacactggtggttaataaaatacctcgcttcggcggggttttttcgtttcccttgacacgaagtttctatatgtgttacaataatcaatatgggaagatcttgcatcttccttttggcattatcattactacgaggttatcatggcagcaatgactccacaacagtcggtgagagccgtctataaggcagaacaggaaatcaactctaccgagaataaaaatacctcggcatctactgtaaagggtgataatggtttctgcattttagcaagtgtttataatagttcaagtgatcaatacattcaaaactttaaagcaattactttcgattcggtccctgaagtaggtgtaactcgtgaggcagatgttacaagttttccagtagaatcaggatcggatgtaagtgaccacgttcaaataaaaaacaacagatttaaactttcaggtataatcaccgaaacaccaattcggcttatgcgagatcaattatacagtgcaggtgtaaatggggcaaggatttctcaagcaatagaatatctagatcaaatatttgagtcaagacaaccaatagttcttttgacagaacacaggacttttgaaaatgttattctgaaaggctactcttatgattataaatctgaatttgctatgcaatttgatttagagttcgaacaaattcgtctagtctctaaggccactactaacgctattgctgtaaaaacagcaccaaataagtcaactggtggtgatgtgaaaggtcaagtcgcttctaatggtcctaagtcagatattacagtaagaactgctgaagctactaataccccaacaaacaacggaggttaatagtgacaacttattctaaaacaacaaggtctacaagtaatactggctacagtgcagtttatctggaggaccattctacttattttgcatggtatctgaaaactgaagagtaccctgatcaaacatatacagttacattggatggagttgattatgacattcgtttaaggtggaacactagggacgagtcttggcaatgccagataggattatctggagatgatccaagtataagtttcaaagttacaaatggtttagatcttcttaaaccttataaatatcttgaaagtgtgccggatggtcaattgtatatagtagatacagttaagattaatggtcgtcctgggtatacaactacaggtcgagataaacgttttgtattggtttatattgataacaaacctaatcaggcgtaaggagataatatggcagaaagagagtatacaaaagctcctgcccctaatttaaacagggcatacaaattattaattggttctgccacaaacacaatacagaagagaactaagaactcggcatttaaatctacagtagatttggataccaagttagggacaacagaaaaatcctcttctaatttgtatttgttgcaagaccatcaaataaccttcagtattaagaaagataataacaaagatcctaaccaagcagagattgtagtttataacctttcggatgatactgttaactatataaaccgtggtatccgaaataacttggctgttgctttagcggtaggatacgaaggtgaagagttggttatggtcttcaaaggaactatccagtgggttagtgatacttttgactcggtagacaggaaaaccactttacactgtttggatggcggtattaacattgcagaagcaagaacaagccgcagttatccaaaaggaactaaaatcaaacgtgttgttacagatttggtaaaggatttaggaactacagaaggtaatatacacgtagataatgatcaaaccttatcttcagcaacagctatgtgtggaaacacttcacattacctagaacatatttgtaaaagtattgatcacaatgtgtcaatacaagatggatctgtttatgtcactcctcgttcacaaatgtctagtgcacgtagcgcctatattagtcctgaaactggtctgataggaagtccagaaccattccacaacgatataaaacctactaaaaaagttaccaagtcctctaagaaggcaaagaaacctacagacggtgttaaattcaaatgccaaatgaatggtgcaatattaccagaaaaaacaatctggttaaaaagccgagattatgatggtccatttaaagttgtttctgtttctcacaatggtgataaagagggtaaagagtgggttactgaagtggagtgtgtatccgtgtctgaaataatgactaaggagaaataatggatgcattgaattttgtcacagcaatgcgtggcttaatgacagagcaattagcagaagtccatacagccttgccagtccgtgtgactggcgttaattatggtgctaaaactgtcactttagaatctattgttaaaaacacacgatctagtgaagatgaaatagattatcctacttttgaagacgttccttttatggttaatggtggtgggacaggaagaatctcattccctattaaagctggcgatttaggaactgttatattttctgaaagagatccttctaatgcactgcaaactagtggggaaacctcttcgtcatccacttttatgcagccttgtggattataccctatttgttttattcccaaaatagctacaggaacagattcaacagaagctgtagattctgaaaaggtagttatttctaataacaaaaacacgtacgcttctttcgaccctacaggtaatatttcaatatggaatagtcaagggatgaaaatagatattactacctccggtattactattacagatggcacagggactttggatctaaaaggtggtaatttaactttcaaaggcggcgtagcagatattaatggtcttaaaatagatcagaacggtttgatgacagatggtaatggcatcggattccatactcacacgcacacggttcgtaacattcagagcggtaactcaagtgccgagtccttaaaaccaacaggagcctaacatgggaatcccttttgacttaaaacttgggccaaacaacgacctcatcatggatgatggagatttggtcctcactacaaccagaacagaaattgcagcacaaactcttgggataactctgaacacgtatcgtggggagtggtttttaaatactaacttcggtgttccttacttacaagagattattggtgttgctagaaagaaagatattgtagacagaatatttttagcagagattgccaaaaacgtttacatagatacaataaacagttataaatctgcttatgacatggatcaacgttattactcaatgacagttatggtcacagtaggagcagatacagtaacatctatattcaatactcaaccttctgaagagtttatttaccctgaagctggtgaagacaatgcagcgatcatttgtgaagcttacagtattgttgagaattcgaatagactttatcgctttatcaactttgttggtttgccacgtgatacctactctacttggtggaatgaatggtctacagagtcagcagtggaaagaatcatggttaacgaaaaaggtgatgcattagctacaaacaataatttcggtataacagctatgacaggagtagaagagtaatggcagatttaactacgatcaaaatttctgatcttacacaaacaacctctgtgtctgatacagatttctttgtaacagatcaggctggaataacaaagaaaacttctttgaaagtgttgttgaatggtgcaggggtaactagaaaccgtctgaatgcacggggaacagtaactagtaccttggcattagatattagttcagcagaatatttttcggcaaccttatcttctgcaacgtgcacaattagttttactaatattccagtagcaacgaatgcagttttaaactttactttatctttgcgtcaaggaagtggcgcaaataaagtcgtatggccttcttctgtaaaatggagttttggtcgttccccagttttgagttatcgtcaaggtgcaacagacacttttgagtttatcagttatgataatggtgcaacttggacaggtagcttagttttagcaggagttatttaatgtcaagagttaagcacaatattgacaacacgtttcagttgattgaagggttggttcagtttttggaaagaaatactgggcttaccatagatcctacggttcagcactacattatcaacccacaaaacgtattggcgaacaacagacactttattaactggacagcgcaggaagggcaaccaaacggtgacgctactaccgaaggtcaatctgtgcttatcactggttttgcttatgcatatttggctacaggggataaaaaatatctcgaatctgccgagaagtattggcaagcctatatagatcacttcttcgggggccaacctattcctgatcctccggctaaatatcgtcccaattggatcatcaatggtaaagaaccacgtttagcacattaccctctcacagacgatgggtatcctacgcacggtgggttcaaaggtagcatgatgacttggattaacggaagaactgttattcctaaaggtgcgccacattggggagaatatttagataaagcttggtttgctttcaatggcaatcttggttggaactccgttaacgcaacagtttatgcaattaacccagacggttcaaccaactggaaagaatatggagatcagtgggacgttgaatggattatagatcgtctaggacgtaaagttgattgggatggtaacattttatctacaggtcacagctttgcagaatatggaacagtgcaacttaaaaatgcttctgtgaacggggattataaattcaactatgctacatgcaaccctgtagaacacggtggatatctgcttaagcgtaatgagatgtggcataaccgtcctgtaaacgttccggtagagttaggttatcaagataatgcttccgatgctgaaacgtggtggtgcgatgcaaactacttgatgtatcagatcacaggggagagaaaatattggctttgctggcaatcttctttattgctgtgtcaagactactcaaacattgatatgtttgataaattcttccgtagatctacgacagcaataattccttttacagatggtatatcttatgattactcatatccatctacagcaatacctaaatactctcgtgacgaattaggatacacagtaattcgccaagatgttgcagcacaaacaactttagaacaacaggcagtttggttcagagtggatcagaattcaaaactgcgtattgagttccaaggcgtagatgatgcaggggaaggtattcttttccgtccagagttagaattaagcaagactaagagtgaaacagacacagtgacatatcgttgtggcttacctcttggtgcagctaatgtgactaagatggatatacctttatccagttttatgcgcaccgaacctcctggaggtggtgtatatattattgctgaacctagaatcattgttgactggggaagcaatactgtgatacaatataaatatgcaactggtattgctgggacaaatagtgatcagatagtttctgctaatatggattcagatggtggttttactgttgggttttggttaacaccaactaaaacagccaatttaaaatctattacgtatcgttcatacgcagatgattttaacatcactattacggattccgcaggttggagatggtgggccatgttagaaaaaacaaattctacatgggttactaaagctttaagtcctgctgatttcaaattaagtacttggcaacctaatcacgatgacacagagacaaaaccttcgtcaataaacctgactgctattgatcagatcaatattgcattggattctgaacctgcaaatggcttgacaggggcaatcgatttttattgcgttaacgatatcccatctttgtattcttcagccactggtgatgattacacaatgtatttcagggttacagtttcatctgaaaatccttatacagcaaaacttggagattgtacaatactggactacaaacttgacagtttgaattatactccaggaatcattccattttctaatattagtgatcctaacacagcattatatgacggttggcgcggtattccttacccaggttatcaatacccatccttatattgttttaaagggagagatattgattgggttcgtatgaacaacagtatagactttttatatgattcacaaatgtggttttataataagtttgcccctgtgatgcctgggccaatggcacaagcttatgtttgggatcgttgggatgctcataaatacggaaacaagaatgagttcacaatgtatcattggaacgataaagcttgggatgggtatgaagcacgagcattcttctgtgcgtgtcatacagtatacgaacttaaacaacgaggagcagaagttcctgaaaaacttttaacagtttgtaaaaactggatcaactatctgaagtggttccaagacaacaacgaaggaagaacaccaacaatattttatcccaatggagaagtggcagcgcctgtagatgactttacaagtcacatgtctgcgctatttatggcaggatgtgctataatggggatggctggatatgattcagaaattcctaacattaaaatagtagcagaccgctgttttgaacttattcaggaaaattatattgttcttggtcctaatcatgttatgaatggctgttggagttccgctcctagaccagatagtgataacggagtcttctttggcttccacgctggagagttgttacgtggttttgggttgtatgctttatacaaaaaacttaatccccaaaatgcattacctgttttggattcgagcaatattcctgcacttactgttttgacaatggcaaacattagtgtggacgttaccgagtaaggggtaaaatgaaacaagctatatttactgtcacgcgagacaagagagtaaatgcgagttcatttaactacacgactgttgatggaacagcagtcgctggtagagattatattgcaaaatcgggaacacttgtgttccctgatgatgctgattctgctaccattgtggttgaagtatttgaacgaccaaagaactcaatagatcttaacttctccctccaagtttcagggattagtcaaaataatatgatggttgaaacgaccatcaactgtattataactacgattcaagaaaatactactccaataacttggactacaaaagacgttaaaatgttctctcctatgtattggacaatagattctcaagcaacggaaagttgttctattgtatctcatggagactcttttactgcaagatttgtaaacagaacaacagcaggtttggcaggggttatctggagcacagttgacaaatatgaccataaaggtgttgggtatttaccccacacagatttaagttcagagaaactttggtttaaaatggaagttagtcaaaacatgccaggttttaaagaagaacctttggtgccaactttgactgtaactctcttggataaaagtgtccactatgttagtttaggattttatgcttcagatatttcagaagatggtaaaacagctacaatcaaactagattttggtaatatcttctctggtcctaataatgatattcctttggacatgagtgctgtagataatattttcttctctttgattacagcaaggtatgaagaaatagaagagattgtacctattgatagtcaagaggcttggtttactttcactcttcttgaacctacttctggttatagtatgatgaaagtcagtaaccttgtccagcctgaacatgatattcgcatgtgcacatcttatgacgatatgtataacctgactccagagagagttatttataatacatatgcgctaggttatcgtggaatgattaaccattacaacggaatgtctcactattatgagttctcatggaacggaacatcttgggctttaaatagatctgtcttcctaaatccagctacagaagcttggctaaatagtttccattctatagcgaacgagaagggttacacaataatgaactctttaagttttgagttgatgagcacagtttgtcctgtagaatgggtccagcatgattggaacgatgctcttgcagcaacagggtatgagcctcctagttacgtgttgtctccaactattgacgaaggtatgaaatatttgcaaaatgttattaataaaatagcatctatttcgcaagctaataatattccagttgtcattcaaattggtgagccttggtggtggtataatacagcgagtaaaatgccttgtatatacgattacactactaaactagcattcaacacagaaacaggtttatttgcacaagatgtaggaacaatagataattataaaacaggaacaccgtttgacgaatactatgcatttttgtctcgtaaactaggattaagagttgcaaagtttgcaacagatactagattagcctatcctggagctaaagttacattattaccatttgtgccatccattttaggtaacggtatgatggagtttgttaacttccctaaagattattatatcccagaaaacttcgacttttattgttcagagtgttatgactggttgttggaaggtaagatggaaaaatcttttgacgctatcacaatacctaatgaacaattaggttttagttatgataagatacattatcttgcaggttttgttccagatgctactcttgcacctttgtatggctttgatcctgaatcaaactaccgcacgtatctttggaaaatgattataggtaacatagtgttgaacgccaataagttcaatggccttacacaatatatatgggcctatcctcaaataatgcacgattctatcacggtagttaattctcaatcccaagttttctatatgggtaacgtgcctttgaacgtttatttacaggatatcactcttaaacaggtaaatgttgagattgccaccataagtggaattacattagccactaaatctggagaagatttagtaacaacacaaaaattttatatataggagtaaaaatgtcaactacaattactaatttacccgaaacatcaaaagttaatggttctgattacctggttttagaccaacctgataagactgttaaaagcacagtttccaactttcttactgacactggggtggttttagccacccagttaaaagatatttctggagctaccaagtacccagaacttcaaatgtcacgctggagagatgaaggtgatcctagaggatggggagcagtaggtgacggagcaacagacgataccaatgccataacacagcttcttgctgctatgcctgatggatggattattgatgggcgtaatctcactttcaaggttacaacactaccagatataagcaagtttaaaaacgctgcttttgtttacgagcgtattgttggacaaccccttacttatgtatctgaaggtttcttcgatggaaatctgacaaagattacggatacaccattttacaatgcttggacgcaagataagacgtttgtttatgacaatgttatatatgcaccatttatggctggcgaacgtcatggtgtacaaaacctccatgtagcgtgggttaaatcaggagatgatggacaaacttggtctatgccagaatggttaactccaattcatcctgattataatgcctcttcagcaaacaaagttaactatcattgcatgagtatgggtgtatgtggtaatcgcctatatgcagtcatcgaaacccgttacttatctaacatgcgattgaagaaagcagaactttggtcacgtccaatgccttattatagaaggccaactggaggtataacaattagttctgggtctactacggcgacgattgttttagaaaagcatggtcttaaagttggagatgctgttaacttttccaattcaggtgcaactggtgtatctggaaatatgactgttgcatctgtaattaacaaggatacatttactgttacattagcgagtgctgccacatctaatatagataatacaggaactacttggcattttggaacacgtttctgggatagcccttgggaaattacagaattaccagatgttgcctattctactaatgcagacttatgtgttacagaaacccatagttttacagttatagatgatgataattacacttttgctgtgggttatcacaatggtgatgtttccccaagaagattaggtattttgtatttcaataatgcttactctgacccaagttcttttactcgtagaacgattagtcaagaatatgctgacaatgcagcagaaccctgcattaaatattatgatggaattttatatttaactactaggggtacttcaacttctgttgctggttctacattagcaatgagtgctgaccttggagaaaactggaattacttaagatttcctaacaacgttcatcatacaaacctaccatttgcaaaagttggcaactacctttatatctttggtacagaacgttcatttggagaatgggaaggagaagaactagataatagatataaaggtacgtatcctcgaacgtttatgtgcaagattaatgtatctgtatggcctgcatctttatccgatgttcaatggtttaatatcactgatcagatgtatcaagggcatattgttaattctgcatgtggtgttggttcggtatgtgttaaagatggttggttatattatatctttggaggcgaagatttcttatctccttggtctattggggataatagtaaaaaattatggtacaagcatgatggtcatccagccgatttatatagctatagactaaagattaccgaacatgattttgtatcacgtgatttcaaatatggagctacgccaaaccgtacattgcctgtatctatgggtacggatggggtaaggcatgtctcagcccctgtaacttttgataatgatgtgcaaatacactctttaacagttactggtcttgagcatgatgggacacaacaatctgccgttagaataaaattagatggtgattatggggttgttgcaaaaaatgtcccaataaaaaatccttctgaacagcgactaatcttatgtggaggagaaactccttacgttactgatggatcgctattacaactatatggttcaaaccatacgtatccaaacagagcagttttatatgccccaggaggagcatatacccaaaataatttcatgccatatttagatggacaagttgcattaggtggtgcatctaacagatggtcagaagtgtacgcatctacaggaaccattaatacttcagatggaacattaaaaactaaacctacagagattgaagatattttactgaaagcgtgggaagatattcatgtaatctcttaccaatggctgagtgctatcgcggagaaaggagattctgcgcgtattcattttggtgttatagctcaagatgtaagagatattctgattaattatggtttaatggatgaaaatagcactgattgtaagtatgcttttctgtgttatgatgaataccctgctatgtacgatagtgttgttacaggacaaaaagaaatccctttatttgatgatgaagggaatgttgtaattgatgaagaaggtaatccagtaacaatcgtagaagatgttgtagaaactatcgaaataattccagcaggatcgcgatggggtatccgcgctgaccaaatgttttttattgagatggcttatcaacgtaaaaagttaaaagctcttgaagaaagacttgcaaccctggaaagtaaataataccgcttaggcggtatttcaatctttatatctcacttagaggtactcatggttaaagagaaaaacggttttaaaaaatttattcgcggaatgttctgcacttaccccggcaacggggtaagctctacgaaagtctggaacgctgtaggcatgtcggttatgacaggcatgtttatctttttaggaatagaaaaagaaattcctgaatggatgggttgggcttttgttttcatgataaccccttctcgcctcatgaaaaatcttattgatttacgttggggcagatcacaatctaccaaagaggatgactaatggacgaatatggtttgacagatgcgggatttgtaatcccgacttttgacgatgttttaaacaactacatgacagcagtaaaaaacacatttggtgcagatgcagccacttcggaagatactgtgatcggacaactgtttagaataattgcatacacagattacacattgtgggaaggtatgcaaggggtttataatactcaaacactggatggtgcagaaggtatttatcttgacgaaatcttttctaaacgtggtttctatcgagcaggggcagcagcaagcacaggttatgcatatgttaagagtaataacaaagcagcttggacttatgagctaggcacggatatttacttcaactctgatagcgatatgaactattatgttagcacaccaactatgttgaatgctaagattgcagcttatcaaatctctcgtgctaatgcaactgctacaggtgttccaaatattactttttatgcacaaagtgcggtggatggaggactaaacagtaaaacacttgcacctggttcttctacatttataaccgatcttgaaacttttatcaaggcgaatttaacagaagctgatcgtagtcttgtattttctgattcaggtaacttatcaattggttttacttctttaaccagtgatactccagtggggctggtaactcctattaaattttatgctagtgttccggttggaaccaagtggagtgagattccggtagttgcagcagagaaaggatacaatcctgttggtgtggagtctattacaggaatatcttctacctttacaggttatcttgacagcggtaacttctattcattttctcctggtcgagatgttgagacagacgcagaattccgctctcgtttcaatgacaatgttgatgaagctaacgcagggacacgagcagctattgtgaaagctctgctacttacagatggtgttactaaggtgaagatttacgataaccctacgttacatgatcaagaacatgctccggctatgactttccagactatagtttatggagggagtgctgaagaagttgctgaagttatttacaaaactaaaccaatcaacagtttgacacatggaacaaccaacataactgttacaacggaagacggaggacaagaaattattcgtttttctcctggtgcttctgctacgtattccgtaaaacttgtttatcaaactgtcaacggaacaactttaagtggaacagaaaaacaaaacattgtagaagctttacaaaacctgcaagcttattttgaattaggttcttcagtaacgaacgatcaaatcaaaggtgttatttatgcagcacttgcttttggacgcttgacttctcttcgtgtttatgttaaacttaatactgaggatgacagtaaatatacagagaataatatagttcctgcttataatgttgtcccttcttttgaccttgataacatttcttacgagtatggagtgtaaaaatggcagtgagtgttgaccatgtaacaacttgggccagtatcaatgaagacgttaaaaaccttctgattgaagattttaaatcttctcctaacattgtcaagctcctctacatcgtatccagtgaaaagcaaaagatagatcaggcaatgatctatcttgctaaacaccgcttgatctctacagccacaggcaaatacctagatattctaggggaagaaatggggatcgaacgtaatggctctgatgatgaagagtatagaacaatattaaaaatcagggcttaccgcgtagcctcatcggggactcgtggtgacataattgatatcttcgcccgtttcacaggaacagagcgtgaaacgcttaatacttacgtaggtttgaataaaacctttgatgtgtttttctacaacctgtgtcttcaatctgatcaagctttagagcagttgctaagtgttttccctattattagtagctaccgtcttggagcaaaagcaggatcagcttttggttttagttcttattatgctaccaaaccgcctcatggtattggtggtttaggttccctgtacatggaatctactggggatgaaacaggacgcatgtgtacgcttctcaagcaaatagattaaggagtttaaatggcgaagccaatatattatcctgactgggctacacaaactgtaacgctcccaggaactttaaacacaaacaaaattagacctaaagaaaccatccgcacagttggtatggattatggtcaaatcatgacttgcgaagaaatgaactggattcttaataatatcggtttatggattcgctatttggtggatgactttcttccaactttacctaatacctacttgcctttagtgggaactaagattacaatggcaggtgatgctactggtgaggctacttggaacggtaacaaagaagttactttatctatccaggttcaagataacagtcataatcacttgtcggcaaacattacggatgccactagttcaacagtaacaccaaacgtgttggtaaaacgtgatgcgggtggtgctatttatggtggtgatgtttatgttaacggtacttccacaacagatcctgcaacactgttcttcaaaaactttgcaggacaaacgaatggtgagatttctgccgagtatcaaagcggaggtcagctttacatctatcgtagaaatcctagcacaggtagtgtatcggcaggtgttcgtttatatgatgcaggttatgttctaatagataatccaagatcaaacagtggacaagacacttctaacggaaatgctttagttcgtttagattatctgaactctcgtttgacttcccttcagaacacattgcagacgaatattaacactgttcaaaacaacttgaataatgttaacaacaacctctcttctcgtataaacaatgtagaaagtaatcatcaaagtcagattacaaataactacaactatgctaacggaacctttgtaagagatattcgttatactagccaaggtgtgtattatccaccagggaacgaggtttcttggacttatatctgttcttctggttatgttctttctggtattatcgtacaggaaacaggacgtagctctgcggataacatcggtggggtttacttcaaacgcctccagcgcaacgttaacggaaactggtacgatattggaggctaaatgatatttacaaactttaaaaaatatattcctgaagaccctgaactaaaagaattggtagaagcagagaacattctttttcttcgttgcgatcaaggttacgactggtatgatttacgtagcacagaattcaataacgataaaatgaaagtcgtttttgatgatcaaaatcgtattgtgttttggaatactgatcctacactactttgccctgaagatctttctatagcacaagtagactttaacatagatacttttgaggatattaggaacaaggttctggatttagaaaccttaactcttaagaataaagagtattcccgtgaagagttgatgacacaagctagtgcaaaaattcgctctttacaagaaacagcggtagcacttataacacctttacagtatgctaaagatttagaaatggctactgaagacgaattagcttatcttaaaaatcttcaagtttatgtagttaaactaaatcgtgttccgcttcaaaaagactatccttacgctatagattggcctacattaccgacagaataagggatcactatggaatttcaagaagcatggggacttgcaaaggatgcaataatccctttaatcggagtcatctggttctttttcaaacaaaaaatggataaattcggctctgatcttgaggaaatggaggagaaaagtcgagagctagagaagaagttggtctttgttgaatcaacttatgcaactaaagccgaacttacccagatgctaaatcaaattaactctacattaatggcaaataataacacccttgagcaaaaaattgaaaagattatggacctcaagaatgcgactatccaaatgatgctagatgacatagttaaacgtacacagaataaggggtaattaatggcaacattcccaacatatccagcaacgtctctcgaacagggcgtagacctggttattttctcatctaaccaactccatgatgttattaatggaagtgctacagagagtattgaaacagaatcagggttgataccaaccctgagaaaagcccttgttgacaactttttctttaaaagcccattggattgggcgcaaggcacaaacgaaacagtttttaaccaacttcgttatttccagaatggagtgttgagtggttattactatgcgcctaatgctacactggtaaacccaattcctatgcaagggactccagtaggagataacaactgggtattgtggggactgaagacagaacaactagcaacagaagtcaccccttgggtatattctggtgcaactggttatgaaacagtaatcagtcctccctacatctttgatagtgctattgttacaatcaatggtgttattcaggttctgggagaagctttccgcatagaagatagtaaaatcattttatctgaacctttgggacatgatcctgcaacaggactgccaaacaagctttttgcctatattggtaaaatcgtagcttccgcagatacagatcctaacttagaaaaccgtcttgtcagtttagaaacaaaaactgaagaactgacagaaagcatggataaagtacctttacaaactattgctcgtaaatacggtttgttggatgatgaagtagcttacgcaacagcgggtcaatcattaacagggattaaagctctgtatgatccagtagcacaatcttcctacacattgcctcctaacatcacagggactttaacatctttgtctgtttctggagtaatgacttattctggcggatctgtagatctttctgcattagctgttgaacgtggacagtttgttcatttgcctacaagctttggtaataatgtaactctgacagctaaaaatcagacgattggacgtggtgctggtcgttatcgttgggctggaagtttaccaaaaagtattttggcctctgacacgttagagacaagcggtggattaggtccaaacgcatgggttctaactaatacggaaggactgttaacccctcgtggtggaacatacaacgatttattcgatgttgtctacttgtcagaatatgctaacaatacaactacctataccacaccagaagcagctttccaggcggcactgttagcagcaaaagcttcgaaaagtaagattctcgatgcttacggttgcgatatgactttcacgacaagctcttttgatattcaaggtatcactttgcgtggtggtgtgttccgtggtcaacgcgactatcgtgtgcagaatgctacagtagaaggcacaactttccgtaactctcgtgttatgtattggggtggtgctgtgcgcatgttcgattgtttgtgggacggtgctcctcgcgcaggtcaagttggtagcttggtattccaaggcaacccaatatcaggtacttttgaaattgataattgtacttttaaaaacgggttatatggcatccttcaacaagggacaggagaaccagtaacacgcggtgtcttccgtaaccttaccttcatggacatgcaaggtgatgcgatagaactgaacgtcatcaataaacattatgatgatggttgtgtgattgagaatatttacctgtctaatatcgatgggactaacgctcctattcctctgtccaactggggtatcggtatcggtgtagctggtaaaggaccatatggttacggaatccctgatgatcaatattgcaagaatattacaattcgtaacgtttttgcaaaacgttgccgtcagattgtccacgtagaagttggtcgtaatatttctatcgaaaacattcatggcgatccagatcaaaccgtatctgttgggacaggtttggcaactggcgcagttgtaatgtatggaagtaaagattttacgattgacggtgtttatggagagcctaaaacagacggtagcacacttgcaagtaatatccgtatgatttatttggagtggggaactaacgcagttctggatgaagagggtaatccggtagttccggcacagggtagaccttcaaacccatgttttaactattctgttcgtaacattcacaccaaaactgggcgtgtttttgcgggagtttccgctgggccaggttatgaaaacagagttagctttgaaaatattcgttgcgctgcattgcagttgttcggtatagcttcttggctttcaatgtctaacatcacctgtaatatcttcgattgtgttggtcaacctgaatctggtccaggaacattttatgatggattcttccgtagagaaaaatctgttcttgaaatggttaacgtaaactgttacccagatggcaagacgatggttactggtcgtccacagtggagccgttgccgttactcggatattcatcgtgtcaactgtaatgttgaagctaatatgtataccaatatcgcaggtggtattggagctattgtagggacaacgggcaaagtttattacttagagcctaatcctagtcgaaacattgatggaatgcatttcccaacagggaaagagtttgacaaaggtgatatgatagtcaaggcggataatacgttcttccttgtaacaacaagtggggcatatattccagatatcccagctttcggtattcgagctacacaagcaggagataccttcctgacacagaacttgactcctaatgggacagcaacaaatgcttcttggttgtatcattaccctctgtcagcagggacacgtatccgtattcctggtgctggcgtaggtggagcagatttggacacagttattactcgtgcaccttatcaagataatgatacgtggactaacccagttaaaatagacattgcagatccaattgtaacgcctacaagtgctggagttagaattaaaaccatacctaatgattccagtaatgtttctgtaggtaatactgcggttattcgcccaacgccagtagtagatgtgccaacaacctaatggaatagagggggattccccctcttcttccaatagaatggtctaatgataggagagataaatgaatttaacaagacctaatagtgcgatagccgatctggtagaagctacttatcgaaaacgtcgcagctttgaggcaggttttacattacgtaattcccgtgaagttttgctgttagcagcagaagggaattattaccaatggaaaggaacttttcctaaagtagttccagcaaactctacgccagccaccacaggtggtatttcttcccttgcatggcaaagtgttgggaccgctgatgatatagcaattatcaatgccaagtttacggcagtgcagcaacagatcgatgatctgtcggaaacaatacctgaagctggtaaatcagcttatcagatcgcacttgataatggttttgttggaacagaagcacaatggcttgcttctttgaaaggagatactggtgctcaacttaatattaaaggatcattagcaagcactagtgagctaccatctacaggtaacgttgcaggggacggttatatcgtaggcgatgtaatctatgcttgggatggttctgtttggaaacttatttcttctcttggaccagaagggaaatcagcttatgaggtatggttggcagatggtaatacaggatctgtttatgattttcttacctctataaaaggtgataaaggtgatgttggtcctacagggccacagggagcacctggtgttaacgccaacggttttgattatcgtggggatttgccttctacaagtaacttaccacaacctaactctgaaaacgtaagccaagcttattctatcaatggtaatctttatgtctctaatgggacagcttgggtcaacatgggtaatattgttggtcctcaaggtccacaaggtgaggcaggtaaagacggtctagatggaacagacggagatgaagggaaatctgcatatcaaagttggctggatgctggtaatgaagggacagaagtagattttgttgcctcacttaaaggtccaaaaggagacaagggtgatcaaggagagcgaggtccacaaggtgaactaggtccacaaggaccagtgggtgcaacaggatcaggcttagagattatcggggttctgaacagtgaagctgaacttcctcctactggagaagtaggtgatgcatataaaattaataatgatttgtatgtttggattcaagatgctacggaatggatgaatgttggcagtcttggaggaacatcaattacagctaaaggtcatgttccgaacagtgaagctctccctgtttataataactatggtgatgcctatttaactgaagacactagtaatctttacatctatacctacgatcaagacaccaattccgcatcttttgttgacatgggaagtattaagggcgacaaaggtgaaaaaggggataaaggagataagggtgatcctggaacaaacggaaccaacggtactgatgggaccaacggtaaggacggcgcacagtggtttgtagcaacaactaatccagtcgcaggagacggtgttatcaatgattacgccttcaatactaccactggagcagtgttcaagaaaacagattcttctacttggacacttataggaactcttcctagtataccagaagcccctcaagacggcttgacgtatggtcgttctgatgggaactggattgaaatatcaggatcagatcctacggaagctataacaccaactagagttacagcaggtttcatggaacttgaaacaactactgccaactctggagcatcttggactccttctggaacttccaatatgtatgttgttacagtaaccgatgctttaacagttggagcatggcctggtgtcactggctctacaaagcctaaagcgttttcagcaatgatttatttgattcaagatacaacgggacacacggttacactagatgcgtcttatggagcactgaatgatacagaaatagcaactactgctaacgcagtaacaattttgcaattaacgtatcctggtgtgggtaatatcgtggacatggttgttgtaacacgataacagaagccccgaaaggggctttctttttatggagggtttaaatgtttccaattccaatatttactattatgaccagcactggtgtcgttcctctgccagcaggtattgttaaaaaagtaatcactttagattacccagataacgctggtaattctaacagtagtttagcaattttgcttaatgatggtagattgtttactcaaggcgcaaacctctttggtgagattgcagatggaactcgtagtgcacgattcaataatttccacttagcttctactgtagtagcggatgtgtttaccgcagatcgttgttttgttattaaaactaacagtgggggatggcaatattcaggattgacagcagggttggtaggatctatagcagcaggtggtacggatgcatgtgtaactacctggactagctttccatctgtaataacagggactatttctttagccaatcttaaagaggttaaaggagggtataacaatactctctggttaatgaatagtggtgttctttatggatcgggtcaaaacacagtaggtagtttaggtgcaagcactactaacgaagtttctactcctcgtcagataacaagttcagcagttgcttttgatgcaggttacaaccaatgctcttatgtcaacaatgtgggaaccttgcgtgtttgtggagctagtaaaggtttagcaggtaataataacacaacaaccgcttttgtcaatgccacgatatccactactgaaacagtgtatgtcaaagattacatcaatacagtttcccagacaatagttgtaggagacacctccggtggtacgggcacggtaaactacttatatgtcaggtctaatacagaaacaacctacactaaactggatacctttgcagcaggtttctcaacatggaaatttccaccaagccgccactcttttttcgttgggatcaacaattccttgtgggctattggtaagaactacactgcaaacttaggtttggggtatgattctgcgagcggagatccactccaagtgggaaaaccagttaaacctgaaggagtgggttcctgggatataaacaagctcacaagcgttcatacgctgaatatggatgttactaaccaattaggttatcaaggaacctttttcgtttataatggagatatgtattattccggtatttggaaaaatgggaaagcctcgtatctgttcaacagtggtctaaattataataaattcacaccaatagcaagctccgtgattacaggggatgtgctggcaactggcttaactacagattctttaggaatttgtattgtaggtggaactaaacagttgacacattctgttagcccagaaggaggtaaacttttcaatattaaatacacttcttctgcccctgcaaacatgacaatatcgtctactggtttaatgactttccatgcagaaggtggttttgatgcgggtatgacagccttaaacgctgaaggaacaactttatcagatacctctggaggatatgcttcaacattaagtgtttacactcctagcttatctgcgatggatgtaggaacaacacaaataatggtagcagaaataacgccaacaggggcagcaagcttacctggtatggttgttgagtatacaactacagatcctaatgttgctacagtagatcctacaactggtgtaataactggtgttggtgatggtggttgtagaattggttgcacagctacgtatcaaggtgttgttaccgcttctgatagttcttatttaacggtgaacgctgttgcgggaaaggagttagctccatctccgagtagtagcttaacggttctaaacggatatttcaaccactcggcagatggggcgattacgttcccaactttatcgggtactgttacaccagctaactttgtagttaaggtggatgacgttgtagttccttcaagtaaagtaatatttagaaacaaagctttctctacagtggatagttatccagcaggagaatatagactggctattgaatttgcaagtgcttcggtagttaatagtgtggaagtgtctatggaagcaaacccaagtcttttagaattatggggcggcaacaggattagttattctacaagcccagcctcacaattcttaaaaggttgtgctaacttaagacgaataacctctgattgtttcagtaacacatcttacaccggaacgtctataagtggtattttctctggctgcacaagtttgacagctatccctgaaggattattcagcgatactttatttccttcgatgacaacaatgtcaagcacgtttgaaggttgtacgtctttaacatctattccttctgatttatttaaaaatttatcaaaagttacaagatattcttacacctttaaagattgcacctctcttgcagaagttccagcaggaatgtttgataatattccaacgaaagtgacctctttaacagctacattccaaggttgtttaggacttacagattttaataagatctttaatgacaacccagggttaactgtttgtggtaaacgtggagcattatcttctttctttagtggatgcacaaatcttacaggaacaggaacaacattaacaaatacattaggcggagtagctaatagttacctattcaggtattgcacaaaactttctgattataacaacattccttccggttataaataagaaaaggagccatttggctcctttcttttataaaaactctttataaatcaataagatcagaacggaatatcatcatcgaagtccatcggaggttcttcttgattacttggagttggttctggttgtggttcaggctttttaacttctttcttctcttctttcttaggttgttctgcggaaccacgaatggcagcagcaactttatcagacagagccagaactttacgagcagaatcaatcagatcttctacagatacagtcttaatggtatggtctttacaagcattgaggatagcgtgaccaacagatgccccaagatcataatcattaatatcaacgccacgagattcagcaatttcagatttcagcgtgacagttgcagattgaacaaccccagcgatatcgaaagcatcgcctttaacaccattacgaatcagttccagtgcaccatttactgcgtgaccagtttccagacctacagtatcacgttttttataggactgtttaggagcagcatcgttggaacctttattgccagaagatttgttagacttctgaacaccatcggtagacaatactgtaatacgagattttttagtattgtagtaagttttaccgcctttattatcaacgcgatcaatatcaatacttacttctacacctttttcaatagtgatccaattatcaccttctttgacttgcaggttttcataaccttctttcagttcaatgtcaccaagagaaatccaaacacctttctcatctggtttagcacctttctctttcagaacaagagaggctcggtgagttgaaacaatcgtttttccttcccaatgaaaagttttaggttcagcgaatttatccagtttaacgtagtctacgataccagttgcataagttacggttttgcctttacgatcagtttcagtattaattacggacattattatctcctctacattacattaattttgcacagaaagagcggagtctttccatatcatcttgctctaacaggtatttacctttacctattccaactccaatttcaccattaggaaaatgaactatttgcactgggaaacctccgagtttaattgtggcagctttgccttcttcgtctataacgtttcggattgtatcttgcagtgaaatgaattctttgtttgtaacagtggtttcaattatttcagatgtttcgacacgagcagttagcttcttgtttccaccttgaataaccaaaatttgaaaataaaaagagttgtcaagacctacaacatttttctcaactagtgttaaactggtataatttccataaacagtttcaacagctatcttagaacgttcagtcattgaatgctatcctatcataaaatgtttaatattgtcaagctttaattaccaaggaatatcatcttcttccaatctggtatctacttgaggtggacgtggaaccttaacctctttcacaaaacgaagatatgggaaacgtgtagcaattttaataacatgtttggcatcttctctaacatctttgtgcaagaagcagatccctgtttccaaggttgtttcaaaatctttagaataataacagtccttcccatcaaatgcagcctggcagatggacagatcgaactcatttagaaaggttgtcattacgcttggttccataatcataaggttgcaaagctgaccatcacgttcaaactcaaaaacgtgtttaagaccagtaacaccttcataattatcagaagcctctttgtttcctagtttacgaatattggttcccattaaagcagatgcaattaatccttgtatttgttcttcagtccgatgtgcaggaagagatgtatagaaatccagatcacgtccagcaatatcaagaatacgccaatcacgaacagcaccgccagccaagacagaattaggatcagcgatctttaatacggtaagaatttctttggcaatattgatttgttttgatttagtcattgatacgctccacagttacttttacaacatcgtccatattaatctcatcccccaagacctcaataacaccttcctcataaagtcgagcacattcttcccacacttcagcttccttcattccacctgcaatcttatttgcaagacctttaataacatcttcattttgttcatcaacaagaattgaaacattaaagctcactaatttacgcattgttttctccttatacttctaaacggaaagtttctttagatacaaaatcgtatccacctttttcaagccagtcattgtaaacctcatcggcttgagactctatcataaaataccgagtggtaacttcgtctccgacaatacgcacaattttatagcaaatcatgataccatttcccattaatcttcctccagatcaatttcattataacaatgtatgcagaaaccatcattgtgcatatgttgttcataggacatatctttaccacaagaccaacaacggatatccccatcgtcccattcacgttcttcttcaccttcaaattcatctggtaggtaaggcataccaaaataatctaaatcgtaactcatatcttctcctataaaggggcagaagccccttataaaacaacatgttagatcaatgacaggatgcccaggaattacccacgtcatatccggcagtaagctgaacgttaagattgtaaaattctccagccttagtaacagctaaagcagcaagctcacctgcccgactataagctgtaaaccatccacctttgggagattcatggatgttagcccaaatttgccctgtctctttttccttattatgcttccattcttcaactttagcaaggcattctttatcaattttcttttgttcttcaggatcgtctactttcttccaacctaatgattcaggtgaaaaccatttgaattctacaaggttacgagaaacttcaagctgggcttcatcgtggtatgcaatcatttgttgcacggagtctttattcttccagtcatctttaaagaagtcaacacttagtccttcttcttcgatcatatcgtcataaataaccattgcacgtttagcacagataaccccaccactttggaacagagagttaagaatcgcgtgagcagaacgagtaggaaccttacgaccgtcaatacccaaaacatattgtttaccagtcttaacccaaaaatcgtttaaacgttctttaagacgcgccaatgggaatgcagcttcccagaaagcatcaaacaccaattgacctgtaaacttatcgctaccaattgttttagcaaccttgtcggcttgtgcaccataggtaataccatacttaacagatttagcaggactacgttcaaatttacgtccaatagtttcagtgatacgttttgccatcattgtgtgaacatcgttaggtttctctaacaacagagcgttacaatattcatgaggctccggttcgtagcgccaacagtttcctgtgatggtaatgcagtctttctgacgcatgacccacgtaccaagttctgtttgtggacaccaaacatcctctacaccccactcttcaatagtcaaactttgaacaggaatgtgagagcggttagccaatgttaccacttttactttctgctcttttgtattgaaagctacagagatattgcctccatgcaccaggtacgaggcagttaaagctgcttcaaaaagttcacctgggttctgcgcccaacgccaaacaggtttttgtttatgttcatgccagtaaccatctgcaatcaagaaaccttccaagaaagctacacgctcggcatgagacatattaactacacgctctacccacggaacatcccatttaccttgttgaacagaagttaaactatttacctgatcttgttccatgttaaatggagcattacaaataatattatctcctgtgcaaagctcggcagttgttctgactttaggcacataagtattccctttactacgggtattaacataccaacggtgatctgctgttgcacggtaagtgtgtgatttccctttaatctcaaacgtcttactatttttatagaagaccttaccttttactttagtccattctttcagacctgtttcagcattgtaccctaaaatctcatccccttccttcaggtcgtgatatcctacccaacctttacgagtcaaagcttgagcatccatcggcacacagtaatgcgactcaatctttgcttccaaagagtcgaagtcataaccgatctggaagtatttaggaacttctacaccaaacaagttacgcatctcccatccaaacaaagatgtgacacgagggatattggctacagatctatgcttcatacgagaggttgcagcatcacatgtagcggctggtgtaggaatacgcccatccgcccttactgcggctaagaaacctttatcgtattcttgatcttcttcatcttcttcccaatcagcaccgccacctaaaatagagttcctacgatgcttatacgttaagtattctacaatctgagtagcataaggaaatttctcacccaaagcttgcaggttaggacagatttctttttcctgacctttggtaaaacatgggttagtcaatactttaagaccgcgacctttaccttttgctatacgctcttgaatcttcctttccaaggtttccggtgtgcactccagatgatcacaacgatcctgacaaaaattagaagatagagtttgctcaacgtaagctcgaatacctttctgaagttcttcctcgctctttttaatcttggtgccagatttaagagttaagtctttatctttatattcagacggtacccaacctaatcctacaagccagtttttaatatgggttgtatcgtttaatgttgcagggatgtgaggatcacataaaggctcatctgctgcaactggcagtttccactctttccccaacataactaaccaccaatctccatccctctcttccaaatgaccatcatgtttcttagcaaaattgatcatatggttagttggctctaagttctttttaatttgcaacttaggtggaataaaagccttaagatagccttttgttgctggtttaggtggcaaaataggctcaacgagtaaacgaagacgctccatttctgcatccaaaaaagcaaggttctcttctgcttgcttcatgttaaaagcaaacccacggtgttcctggcgtgtgataatgtctgctacacgttgttcaagttcaaatggaccttcccatttatcataatcaccccattcttccataaggtagttatatacgctcgtattggctttgttgtcatagatacagtaataaagcatatccgcagcaaaagtcttaaatcgatcttcttctggaatctctttacggaaatctatttttacatcaccacctgcttttcgagaaagtgctgccaagctatgtcctgatttgccctcaatctttcgatctgggtttaacactttactcaaaatcaaggagtcaataagttttaccttatttttgccccacgtattatatttaacactgtaatctaatccataaaacagttttgtagccaaccagtcgtagttgataccgttgtgagccacagccatttcaaccagatattcaggcttctctttaaaataaccttcatgattaataaagtctgggaaatcttttagttgaaaatgcgtgtaatcttgcgccacatactctttaagaacatatgtgtatttaccatctgactcttcataaggacgcccatcaaagatgtatttagggccatcgtggaaagctactatttctcctgtttcatggttctctaagacaatacagtgcatttgaaatgtgtctttgagacgataaggactagctaaataatcaatagtgtcattattcaacaatccgtttgcttcaatatcccatgtaaacttactcactattcctcctttctaatgttctccagaacccactgaagttcttttaaacttaaacttcttactcccgcagttttactagcttcagctttaagtaacgggtaagcctcaatgatacgcgttttaagatcagaagtcaaggcttttaaaaaataggtagatgcttcagataaagaatcttcttctgataacactttacctgcacttgctcccgctctcctaacggctatatcgtagtctttactgttacctaatacgaatagttgattctctcctaaaacaacgggagaacgcttctcgttgcgtttaatccatatctggaatacacaaggaacatcccaaggttctccatgaagaataaaagatccttttggacattcttcttcgtaaagaagatgcatgtggggatttagtttgtgtgcaaaaaagattttttgaaatgtgcgaggcaagataaaacaaataccaccttcgttatccaacatttcagcacaatggttaaagaacttaatggcaagactagcattttttccaaatggaggattaccgacaaaagcagttacactaccaacagactcaacagattgagctaaaaaatctgcctcaatacaatcttcaaacttagggtcaatatcaaaagaagttatgtttttaaaacaagaagagaaagctccttctcccgcagatggttctacgtagttagcttcctctccaaaaatttctttgatcttatcacataagaaccccgcataagcggggttagtgtaatattgatcaagtgtgttcaacttgctcaatagtcctccttagttgttagcgaactcaatagtgaggtcaactttaccatcatcagaaataaccatgtttttggtatttttaaagatgatatctactttaccttcgcttacacgacagaatgcaacaccatctgcaactttatcaatataatatttgtaagaaagaatacccactttactacgaccagcaccttttgtgaaagaagggcttacatcgaaacggaaacctttagaagaaacaacacggtaagaacgtccagttggaagatgttcaataacagagacattgttctcaacaacttttacagcaaactcttcaggatgatcctcaacaatcatatgtgggatggcaaatgccaacgcttgtttgtgtttaataacaccagcacccagagcaccagcagctttaacttttgcattcagatcgattgtcatacgcatttttacttctcctcttgtttggttgatgagacaagtataagtcccttccgcaaagttgtcaacaggtatttttaataaaagggccgaagcccttagtagttgctatccgtaggtaagttagcagggttgttaaaatactgctctttgtcgtgaagagttgcagttctaatgtcatagtaaaactgccctgctggaccagtcttggataaagcaatgagttgtattacgttctacaggatcttcagcagccttatctcgttccaaagccaaggtaataccagcacctttagccaagaaactactacccattgcatcgtcctctgttaagtgctcattgccaccattagctgacttcttaacgtgtgagatgacgataatagttatagcatactctttcatgattcgcttcaaccatgttgctaactcttcctgggcttgaacatccataccagaaagcaaatcagaataagggtcgataacaagaattgttactccaaaatagatgatcatctccaaaactttttctttgatagactccacatctgctccacgatcatcacacacgtaaaaacgtggtgatccatcttctctttcgtaaaaatctaggattttttctttattctcttccaagatttgaaatttctcttccggtgttttcctgtgtagaggaatgtgtaggaaagaggataacaggttacgagaatactttttataagtcgcttccaaggacagaatacctagggtatgttctgggtgtgcaacaataatatgtttggtgatctcgttcaccatcaaagttttaccgatactggtctttgccaggatgactgtaatctcttcctctactaaaccaccacccaacatgtttgcagcaacacgcataaaaggaggcaaggtaatcatcttggattccaagcattccaatgcagcttcatacaagacattagaagcataaacacctgctggggtgtatagacgagcactccaaaaagcttttacgaaatcttttgcacggccttcttccagatactgattggcatccttaagatccatctgcatacggtagactttgttacgaggtagcaccttaacaatattttcaaatgcctcattacctgctttgtcgttatccatgcaaacaataatcttcttaaatttttcaaagaaaggatattgtgcctgaacttgtttatacatactggtttcaccagttgtgccacttactacggctggaagctcatatttactgtccaagttttcagatagcatttgataagctgccagagcatcgtgttcaccacctgtaattacaacagtatgagaacggtctgcaaaacgaatttgtccaaaaagatctacatctttacctacttgaccaataggtttactgaaatctttaggatgaatacgacgcttaaaaccaaccaattctttaccgatggtagtcggatataaacaactttctactaccatctgatctccttcctgacggtattcataacgaacaccatagaaagatgaaactttttctttaatgcctcgataaccacgtgggttggttgatgtttcttgaacaattttacgatgaatctgtttattaaattccgaacccacaatctcctcctcttcttctaaaacttcaccattttctcgtaaccattctacgctaggaatagtgtattcacacgcaaagcacttagcacctttatgctctccattagaatctaatccataaaccatcaggttattacgagagcgatccttgccatttttcatgcagcgcggacaacctgtatgcccttccttgctaagatcaacatcaaatccatatttagttataatgtgcgacactttgttctcctgttaaaatggttcgttagtctccatcatatattctgcttctagttcttccatgtgctttctaaattggaaagcaatttctgctacagttacatttaaatctttttcaaaaacttctgtagatccttcataaaaacgaataccgtcaattaaaagccctccgtggtaatcccaatcactttcacgagaaagcggattaggttcttcataatagtaatccacctccacaaccaaggctttcccgttacgagtggtgtattcaaaatcaaaagtgttaatcattatagctcctcaaataaaagtctacgacgctcattcaacacatcaatgtgataatgagtcctgacatacttagctaatgctaatcctttctccatgcaaacatcgggagcacttaataagtattccgtaatatctttccactcggaaggtgtttcagcaaagaataacaaatctttaaactcttgtgtatgataattctcacgaggagagcagattaaaggtaaacccttagcacctgcctcaagaattttaagattgctttttgcattattaaacacgttatcgatcaatggtgcaagactgatttgatgaccatcgtaagattccatgtagttggcatatggtcttacaccttcataaacacaagttggtgctacattttccctgattaaagaccattcacgactacttaaaacttcagaatccctacgaaaaccacatattgtaagatctttaccaaaatcgggcaagatagccaaatcttgtttatgtgtttcacttccagcccagactaatggagttttggagtagcgatcacgggtcaacacaaattgaccttcatcgtaaggaagtccattagggattatgtgcacattatcattgtattgtgaaagttcaacttgcaaggcaggtgtcgtagttgtaacaagatcactgtgctctaaaaaccattttaaatgttcacgaatacctgattcaaaaataccttctaacatgtgtccttttggaataactaaagagtcatccaaatccataaccattttaaagcccaggtttttaagggctaaaaagccctctttaccttttgttggcactccgttaaaaacgaaaacgttgtgtttaggttgtgaagagaactgccttgagtaaggcagcactaccctatggaaatcgcagacactataattgattccgttacgattgtcaagaattatttgtcccatacttcacctacaaactttcaataacctggcgtcgcaattcgtttgcatctgccagattataatgtgttcgaacatgttccgctaagaacaagccgcgatcttcccgatagttcggattgcgaagaagcttaacaatttcgtaatgccattctgctttattctctgcgtaagcaacagcgcgagcatctacagggttaaaataaggtaataccttagaacaaacaatcggaataccttttgccccagcttcaaggattttgagattacttttacaattattaaaatcattatctaccaaaggagctatagcaatagcatgactttcgtaaacactcatgtaattatctaaatcttttacagcagctttatatttggcgtttggtaaatttctacggatcttaatccactcttgccctgtgatactctgcgatgcttcatatcctgcaatagtaagaagttcatcatcgaaagtattagagactagtcgtaaatcgggttcgtgactagcaccgccagcccatacaacaggggtaccggatgaacgatcatttgacaaagtgaattgtccgctatcaaaaggaagtgcatttcggatcacaacaacattcctatttaagtgacggatcttatatgccaaatattccgtagtcacaatgaccacatcggcaagcttaaccatagctacaatagcatgagtgtttgactcatataaacttgctaaataatgttctggattaagttggtagaaatcatctaaatctacaacaatcttaacaccttgacgtttcagggacagaacatattctgcccctttagaatgaatacggttaaacacgacaacatctttcttaggctgaaaattattgttgttaaatggtataacaatacgatgataatcacaaccactgtgaggttttgcatcaattttcagtttagtccattttttatttgacatgtgccagtgcctcctcataagaaattcggattttcccatttttaatatcttctaaagacgctttatattcttcccagttaatgccaatagcaacttctttctcttcttttgtcagattagcaaaaggcataggattgtttccaaaaacatcgtctgggtggatataagccatgatacgaagtggacaaggtattgcctgaataccctgattcaaaccagcagctttcaaacggtgtacccattcagcatcttcaaaaccatagccgtgagtgtaagggcggaaataacccatcttctcaacaacggcacgagaatacattgcaaattgacacattgcaagttcccagagaataacttctcctttactcccaacaactttatctttgaaatactccggcataccaaagaaatcccatcctccagagacagcttgatctacaaaatatgtttcccatccctccatgattgggtagcaatcgtcgtcaaaaataaaccaataatcataaccttcttcataaaactggtgcataagttcattcctggcgtaagctacacctttacgatctggatcgttgaatactcgaaaatctgcatgtggatctgttacaaggtagtctttaagtggacggacacctacagtgataacacccactccgattttaatattttccattttctctcctaaatagttttactgtgatcgtgacagtgtaataaatgatgtatagaccgttgaggatctgtttgacctaatctgtaaatgtgaaacagatacattccccgcatcaatcctaacctctttcctttttcatgtaaagtgcgagagaaaattaagtcgaattggatagatttttcttcgaaaggaatttcattccacaatgattttctaaaaagcaaaaagaaacctgccagaggtgttccgaaaggaacttcttcaacactcactttatgatattctcttgcaatcttagcatattctatatggtttagaatatctggatcatcgttaatttggttagagaaaagctgataaccactacctaacctgttacaagttgcacctattacatcaaaaggtgggtttgacataacaaactcttcaagcatagatggttgatcaggcaggaggaacatcgtatcggtatctcttaaacacacccaactatcatctggaagaacggcaatagcttcattgatagccttgccgatatttcctgtcagatagggagtaatataataaatcattctcccctccgttatattaactgtcggctacaatcccgcgtttaatcatttcctgttggatttggatgacacgatctcgtgcttccatgtattctttaaaagattcttgaagatggtcacgagctacgtctcgtagcttaatcagtttgtcgtttgtcacttcttgaagagagatttcgccagtttcattggtcccaagcgttttcatttacaacctccttaatagctactgcacagttcttacaaatacattgacctttgttcttagaaatttcaatgtaaggttcattttcgttttctccgcgtcgtgagtcgtatattactgtattgaagcagacaacgcaaatgtttttaataacgacatatttttgcactttctgtttagtgcgaaaattgacttcaatgacttctcccatcaatgaatctcccctaaaatgttgttttgagacattactgcggagcattctacagcatcatgagtccttgcaaaacgctcccacaacacagcatctactttaagaaccatacaaggataaatactgtcgttgatcatgtcaatgctatatttatctacatccttttcatcttccataaacaaagtagcgtatgcttctaaatgcttacgggtgtagtatacatcctcttcagtaagaccgacaaccaggtaacttgctacaacaacagtattatcttcttgcattttaactcccctttggtagatagaaaccatgcactttatctcgataaacaagacgcatatcacgttcccagtgtgtccttatattccgtttcttgaaatatagagcacctttagtaacatctaaaacagaccgcaattcaggaaaatgtttctctaaataaagtaaacgctccgctattgcttttgcttcctgccacttatctttctctgttacgttaaaagttttcgcatatgagaattgccctttctggaacaagactcctctgactgtgttagggaagtaggtatcatttcttctgttgattaccacattcccaacggcattcattccttttttacccagaccgcgaccttctgcgtaaattgcacaagctaatagaattttatcattatattgctttgtacatttgtgaactactttagcggtttttacgtttgcagcttcggctttcgccacaacaggtgtaaatgtaaaagcagttaaggatagtaacgcaactgttacaaagttttttatcagcaaattttgcctcctttttaagttaacgaatttctagtataacacgatagaggctttattgcaagagggggatttctccccctcaaaatcatttgttagttattatggacattcataccattcttttttaccaccgaaggccatcaccacatcacaaatatccagaccagctttacctacaccatatgctttcagcttccattccccatcttcacgaaccaaggaagccacgtggcagattgtgttgccagctacttcaggagccaggaagtcaaaatccagaatttccacattgcgctcggagtcgaagattttaagcataccttcagaagcatgaccaaaacgtttcagacctgtatcatcatcaatggtcagaacaaaggcaatctcttgtgcatcaggagagattttagccagagtaatatcaatctgctccatgctgccagttccatcacgaacatcgtcaccagcgaaggtagaacgttcaggatcaaacttgttagcatagcaaactagatgacgtgcagacagcatttcaggattgccagcggcattatgacgacaaaccagtgcacttacatccagatccagtttagaatcagatttccaagagaattctaggcgcagttctttcagagccggagcaactttcttcagggaaattttttcgctagagccttttttcagggaaattttatcagtcatcttttgtctcctctattatttaagtgtaataccagttacagtcaattctacttccaaaagcttagatgtgttttggattgatactaattgtgcatgatggtttagttctacagcagaataatcattttccccatcatctacttttaaataaacaatgatttcactaaggtctaaaccattttcgtcaaatgcattttcatagacgaaagtatctcctacatccaaatctttaatggtaaggcatcgtttatttactttttgctcatcaatttcgaagtttaacacttcttcctcctaatgttatctccggtttgtatatacgaagaattatagcattttcattttctttgtcaacccattcttcataatcaggccatacatgaatctctactctacttacaatatcttccattcgcacagtcccaatgaaatactctttgagactgcgcataatgaaagcttctctctcgcgccaataattttctatgacttgagaggcaagctcgtcgatcattttttagcacctactttaacaacccactctccgaactcttcagataagagtttgtcataaagctctgaatctgtcaagtctaaatctttaataccaataaaaccaacattatcataagcatttgccagttctttcaggaagccaaacttctcattaccaacgccaaccatgaaccaataaataggtttattcttattctcttcgataagacgacgaacagcactaggatcaccattctcaccatccgtttggaagaatacaacaccaggggtaacgtcagcacctggttcagatacagctacaaccttttcacgctctacagatactgtttcagttttaccaagtagacgattaaagaaacctttctttggagcctcctcttgtaccacttgtttagtggtaatatatttggtaacagtgccaaaatactcatcgtagatatctgccattacaggggcgtaatttgttccacctccgatacgaacattacgcatacatttaccaacatagtcatcgtaaacgtctgctgttgctggagtaagctcttgggaactcgtattgaaggcccacatatcaatttgttgattatcgtcgaacagcataccaaaaggaagcagtttacctacaaaatcactcactaccccactagaatatagaccatgcatactaccagaaatatctagagcacatgctacacgaagaacaatcttaccttcattcaggttcttattctttttcagagagaaagcaaggttttcttgacgttttttcaggctgattttctcggacatattatttctccttcttaagtgtaatattggtaacttctaaatctacttccaccatatttgtatctggtgggatgcaatgagtatagcctcgttgtgctagtgatccattaatacaaatcgcactgtttgtggaatttttaatgaacaccaagttacggtaggtatccaaccctgcgtcttcataggcatcataatacatgaatgttgcccctacgtcaagatcttcgaaagcaataggtaaatcttgacttttttcttcttgaatattgaatctaaacacgcatacctcctctaccaattttgaagcccaaatcgtaagcttccttagtgatcttttgtaactcacttgtaggaagtgttacaagaggatcatcttcttcaatttccatcttgtcatcttctgtttcaatgagagtattatgcactttgtgataagggttgtcaacacgtttaaacttattcttttctgtgctgaaaaaacaatctggatcttcttcaccatcaccccaaccttggttaggatctccgtcagattgttctgtagggatttcacctgtaaagtactcttccagcaccatagcgataccgtcccttggatttgaggaatgcatcaaatcacaaaccttactccaatccatagcccattcaaatcgttcacgaacaccattttcatcctcctttccagagaaaacacaaccataactatcatagttgccatacatctcttcaataacaacaccgtccttcaaaagaaagaggtagcaaggtgatccgtcgaaagaagtagaaagggcagctttgcccgattctttgcacaaaaagctaaaacaacccattacaaaccctccttcagattatcaagagctacagtggtttcacaaaattctccataagctttatgatgttccagaaaagcttcgggtccaccccagtcattatcttgtgtattccagccatcaataaaagcatcttcaatgattgtgatcagttcctgtcgagtcaacgtaatggtatcaggtttctgcgtagtttccacacggaaccctggttcttcataaaaacctttagttacaatggattctaactcttctgcatcacagaggaagtagccacaaagataacaccaaccgtcatcatctttcattacttcataaacttcaccacttgctaacttagtgaaaagagtagggtctgttactgtaagttttaaaagaatacctgttggattatacatcttcttcctcctctaaaatatggaacccgtaattacaataatcctgaaaggtttcgtgtgcaagatcttctatatcctcttgagacatatcatcttcaatttcgatatccacaacctcattgcatccacaccaagcagtttcaatattcactcgtaatattttcattactcctcctcctcattgaagtcaatatctgcaaggagttcgaatttacggaagttacgacaaccttcataaatataacaatcacgacaaactgctagaacacttgggggatatatacctcccatcggtgcgaatcgtttttcgtcatcataacggacaccaatgtcttcatcaattatatagatacggattctcatttaccaagccctcgtttcacagcagctaccatcccgtcttccagagattgaacttcattaatataatcaacacgagcagcacgggcttccgtattgatgcggttagtttcttccaacatcttaaccaagttttcctgatcgtgacgcagagtttcaatatccaacacttgacggttagccagtgctgctgcttcgatctgattctgtgtggcaagatcgctacccagtttaattgccaggttaaattcatcaagaacgttattctgcgtctctgctgctttcatttgacgtaagctctcgatatacattgagaagttagcagagtaagcaggaataacattatttactatgttacgcgcagatcgcattaagcttgcagaaactttttgcataccttgtacacgcggtcccatttggacacacagtaggcgcaatgcttttaaatctgcaatacgaatctccagaagatccaaagtatctcggatcacttgtcgctgttctactgcatcttctggaagagcagccaaagcttgttcttctttttcataggttgctgttagaagctgcatatctcggttcaaacttgcagcatattgtccaatagcttgatgtagcttttcaagatataccaaggaatcttcttctttgcgaatatccatttgaaggttctttaccaactcttcaatacggttattaacattatcaaactccccaaacaggtcttctttcatacccataacttttttaatgagtttagtaatacccttgctttgtttaatagagtttggatcaagttgttttgcctgtttaatcaaagctgtgagtcgttcactcatctgatcgccttgattactacgttgatgttttaatacctcggcatttaaggaacgcaaggttgttcctgcctctgccccaatctcttcgatctcttgtcgggtcatagaaggcaaaaccggaacttcttgcggtgcggctggtgcataaacaggactggcatctaacacgcttggagcgaatacagatttacttgcatctgttgttgcagcaaatacgctcatttcaggcttcttctgaccgccagtagctgcttttaaaaatggacttgtcattcttcattctcctcttctgcatctcttatatatggtgaaacaccgtactctttagctactttaacccaatcgtcccatttatacaaccataattttccttcggtcccttctttatctgatttcaaccacatattaggttgcttacctgggtacatgcgattaggtttacgattataacctctaacacatcttgtcgcaaacctatctaccagaacaagaacatatttatattcgtggttcaacggctctttggaagtggctttaggattagcccctaactctgctgccagtttttgccaatgagcaccgtgtctactaaacttacccatacaaccatcaatagcatgagcaatttcgtgcttcattgtatccacgatcatatctcttgtggagttcttatgcaagtgccaatttacaacaacaattttatctcggtagttgcaccaaccgaaagagttattcactttgtttctaacacaagctttatatcctgcttcatgtaacatgttgtagtaaacaggaaaatcttcttttatttcctgcatcacttcccaccacaagagttgcaagtctctctcggtatgcataacttacaccttaaaagcgaaatgcgtggtcgtggcttcaaaatcagggccagataaacttgcactgaaatctgaaatatttgtaattaaaaagcttttatgcatacctaacacagccacgctttcaatatcttctactaacatttcaatcatgttagaaacatggctgaacgtagagttttgttttttgatggtgtagaaagaaagattcccacctgctgtataagatacctcttcaaaatctttaatcgtatattgtgtgccatcagtaaagaaaatggtagctttattagtagcacgtttcttgttttttggtccttttttacgtttactgcgagtaggcaaaccgtttgggaacaccatagctacaaattcttcagcagaaacctccttaccgaaatcataaccataagaaacagcgtctataaactcgtcatcttcatttttaaaataatggaaatagggccaatttgaaagattatcaagcatcttatgctcgtccacagcagagaatgtatccctcaaagcgcgtgtgatttgcaaagcattaggcaaccttttaacacctacgatggaagtacgaatagaaattgtcattgtttttctccttattaacgtcgcttgctacgagatgaactctttttacttaaagggctattgtaagatttacgagttgtatagctactatttgttttaaaagtttgtctcggcttttcataagtttttatctcttgtttaggcttaccataaaaattagttttcggtttaggtgtattataatgcttattaataatcgttctgttatcgttataatccccactgctacgattactaccgccactcatcatatgccctaacaacatacctgtagcaaactcaccaacaccgctactactagaaccgccaccattgttgataatagttgtatctccgtcagatccttgttgagcgtattgttgaggaggttgttggtattgtgcaggatttgtttcatcctcgcaagctgttaaaaagatacaaccaattaaaatcagggctagttttttcatatttgctttcctcgttttggctattaatacatctgtgtttgaaatctccagagaagcaataaagttgctctccatctcggtataaactcactttactgccgttgattacgcttgtcaatacaaaaattacaacaaacaaccctattgcaaaacaaatattttcaaacacaaccaacaagtatttcattttaaaaatacctcatcatcagtttcattatcccagaagaacaaatcccaaccattcggatcattccatttggctgctggagaagtccatatttgttcgatatcaatattcaaaacttcaccgtttcgttttgaaacagctttagttaattcccaacgagatacaggctctacttcccctgaaccactcccacaacaagctaccacgttaggaggcaaattaattggatctttggtcacaatcataacgcttaccccagggtaaacttttgaaagataatctgaaacgtaatcaacatccccaggtaaatcccaaacaagtttttgaatttcatcaaaattactcataagtctctcctataaaatagcctcccgaaggaggctcatctattaaacagtagcttcttctttttcagggaagataaagcttgcaataacaccaagagctaatgtgcccagaacaatcatcagacttacgttaggggaaatatcatgcgggaggaatgaccacttggcatgaagtgtttcaccgaacggatgatacataagtttagcaccaacaaacaccagaaccacagcaacagctttctctaagtgaaccaaatatttcacagctacacttaacacaaagaaaagtgcacgtaaaccaagaacagccatcagcattgcagaataaactaacagaggttcttgtgtcacaccgatcacagccggaactgaatcaaaagagaagacaatatctgtaagctcaataacaaacacacaaagaagagcaggagttgcatatttaataccattcttaatggtgatgaacttttcaccatccagtgcattgtgcacaggcagaactttacctactaaacgaacagcccaatgcttagagtaatcaatatcctcttcttcgtcaccgcctttgatgatagccacggcagaccaagctacaatcaaaccgaacaacacttggaccgaccaatgcaggttaaacaaagctgttcctgctgcaacaaaaatacctcggaagacaatggctcctgcaatcccccaaagtaaaatcttatgttggagatgtgtgctcttaattccaaagcttgcaaaaattgccatgaacaccattaggttatctacagaaagactcttttccaacacatagccacttaggaaaagcgcggcaaactctttaccatgttctacccaaatgaatgcgtaatatcctaaagctaaagcaatccaaaaaacagaccaaagcaaagcagatttaattccaatttctttattctctttatgaccaaagaaatcgataccaatagacaatgctaaaataccaactaaaacaactacatcaatgattgggaaaccaagttgcattattttctcctttctctttgcggggaaccactccccgcctcatgtgatacatcttactcttttttaaaaccttgtcaacacttattttgaagaactggaggaaaagattccacgcagcactgccataatgaacgctacgcacaccacggtccagaatgtaacaggaacagtgatatctgtgtgacccatcatttcaacaacgtagttgtaagccagcagcagaagccacgctggaatcatactgatcaggaaagccagaacaaacacgataactactgccagaacacctgcaacaacacccatattatttctcctcttaaagtttataaatagtcacatcgtgacctgcttttactaaagtttcttcaatcatcacttcgatgatagcccaattacctcctgccaaccctgctccaatcataggtaaaccaatcttatgttcggcagatgtgttcacccatttgtggagatcctttgccatagcctcaagagcatcatacagggcatcatagtccaactgacgacctttaccgttatacccgtaacggtactgtccgtataggttataaaccagtgggtcagacacctcctccggcacccctaaactaaaagaacccagcttactttgatcacctgcggctgtgtccaagtcggctgcatatgcataaggaaatgctcgtttaatttgcggagcaatccctgcacccatattacacatacagttacaacagtgggctataacgttcacttccccattcttcgctgcatcgatcagattcccagtaacaaccttcaacatttttcctccttacagaatatgttgttttgtgtaacgatccaagaactcaaagttttcagcatactttgcaattcgattgtagccttcagctaaacagccgaagaaaagttgttccacatagtagtgtggcaattggctaagaatgattttgaagtcttcgtgattttggcccataagatacttaataggacgaacaaggcactgtgcatcacgttcttcattaatcattttaacaaacgcttctggtgtattaatataattaaaattcagtttagcttcggtatctgcttgattaccttcatattttgcaaaatacaagaagtaaacatcatttttaacttgattttcatcaaggatctcaatcagtttgtcttcatgagttccagtgatatttacatcatcaataaacacaagcttcttatcaccccagaattctttgttgcagtagaatgtatccccatcaataagtttcttacgactagctttatccaagaaaccataatcgttgatatagctaactttacgatgaataatatccagttctgctgaacgaccttgatcatattgtgcttgcaacatattaaagtaattaataaaatgatctgtcatcattgttgcagcattatgcacatggttgtaaggagaagggatgataacaaattgttccccaatatgtttcattgccacttgagcaaaaaactgaagtgccaattctttacccatacgacgcgcagcttggttactaccaaatttcaattttgaatagtctttgatatcaaaagtagcagtttccaggtcatcaaatttatttgcaaaaatttgagtttgattacgcatttacaatttctcctcttttaagtttctctagtaagtcgttagggttcttaatatgacagaagttaatccctatgtcaacacatttaccatcaaattcttcgctgtccccaacatgtaaaatctcttcagccttcaaaggaatgcttgaatatgtggcggtcctaacaaaaaatctaggatctggtttacataacagatgttcgtctgaaaaatgcataaattcaaaacaattccaactgtcgaacatacaagcacgacgcaaaatatccccagatataaaattagtattgcttttaatactaagatcatatttaccagacaagtatagcaaacaaactggcaaatctaaagcgatatgtggaggaaatttaagaaaccattgctcacactcaaaacgcatttgtgcagattctacaggggttaaacctatctttcttcccaacatattccatgcatatgctacaccttctgcacacccatttagtgcagcattatccataatttctttggcatctttatatgcttcttttgccgcacgttcagacattctaccatatgtagcaatagtgtgcgtacgtgcatctgcatagttttgattggcagaaataagagtattccatacatcaaaagagatatgttttattgtcatactaggcccaccacgcatcaagatttaagttactgtctaccacaacttgttctatgtggtagccttttatctgtatcccactgttcaagagcatatcatacgcttcattgaaacgcaacttatcttctgcggaatataagcgagcattataaaatcggtaatcaatttcttcagcattagaagaaatacggaagaagtttgtttctacttcgggatcacttgctgaagtcttaatgtgaacttctccataattttctttacttagatccatgaaaagaacacaggcaacatgtttaaacattcgttccagtttgtaacgaacaacattgaaacctgcattctcaagtttttctacacactgcaacattaaagtagtgtcgagatcgctttgatactttgttaacatacgatcacgttgagactttgtatcccgatgtaaatcaattgttgtgcatttggcaccaataatcttagctgctttcatcaactcttcagaactaacgttagataaagtaagatgaaaatgggctttccacacttttttagcaggaacaccaaaagatttatccccactattcggcatgttgactactacactatgttgcattacttatctcctcacttaaaatggaagtctttgaagttcatctcctccgatatcaagtaatttagcaacatctcgatcagaaagcaactcttttctttgtaaaatatccacaagggttgcaagaatgtccttaacgtcccgatcactgttcttcaaaagttctcctgccgtccctactttatcccctacagcaaaatatgtaaccatgaaacctcctaagttaatctgattgccaaccacttgccgttttggtccataatctttgattatctgaccctctgaaaggttttgtagttggattgtttatttcatactttccgtctacaataatgtcaacaagatttttaatatacaaaggcacttcctcaaaagtatatcctgtatacaccattatatctttgcttgacccataaacgtctctaaccttttctataaggtttttaacattgtaaatattctgcggatctaatggctctcctcctaaaattgttaaaccttttacaaacggtcttgacaaatcttttaaaacttgctctacattttcgtgagtgaacggtttcccataagaataagaccaggctttttggttaaaacagccacgacaaccgtggctacaaccactaacccagagggagcacctaactccctcaccattaataagatctacaggttcatatcctgcaaaattcaaagatgtttctccctttgcaaaacttcctgcattttacctttgttgtaaggccgtgaattaggggcagaaagataccctgatacacgtctaactacagaaatagtttcttcttcatggttgccacaatcaggacactcaaaccctttagccgttgccttaaattctccatgaaaaccacacttaaagcattgatccacgggctgattaataccaaaatagtgaatatgttcataagcgtagtctactaaagtctccaaagcttctaagttattctttaagtttggtgtttcgacataacttatgttaccaccattgctaatctgtgcaaaacctgcttcataatcccatttttcaaaaggatttgttaccaaccatacaggttggtgaaaagagttggtaagatagtctctttctaccaaacctgggtatttttcatttaaagctgttgcaaacttatagcacaaggattctgctggagttccatagagactaaacgccagcttagatcgttctttaaacacagcacacacatctttcatatgttgcagaatgcttttaccaagttcctttttatctttttcttctggataaaggatttccaaagcttcggcaagacctacataaccaatactaatagaagcatagccaccttcaaacaaaacaccaatttcatcattggcatttaaacgcgctaaagccccttccatgaaaagaatagggttttcagatgctttggtatgcctaatacggtttacacgtaacatgtgagcatcgtaggctatctccatatgtttattaaggaggtcggtgaaagattctcctttacttctcgcttccgcagcaatcagaggtaaattgatagaaactactccaaggttgaatcgtccatcatatttttctccttgttcggtggcatagtacgacaaaaaggaacgacaacccatactcgtaacagtaccatctgctgatcccgtaacttctttgttcaaaggaacagaaataaaatctggataaatacgatcagcacaacatgccaaagcttgttgcttaagatcatagttaggatcactaggtttcatgttaacaccttcttgtaaaaagaaaataactttagggaatacaggtgttacatgatctttgcctagaccgttactatgcactttaagatagttagctgtgatcattctgccaaaaacagaggtatccagacccatactgattgtaataaaaggagattgtccattaacactcattaaagtattaacctgatacaagagagtttgcatagcatcatatacatcttgttcggtcatttctagggcttctttccttgcataacaaccgtagcgacgtttggttatctccatgtttttaaggaaactagcttcaacataaggactaagacctttatcaatgtgcgcacacgtctgacctccatactgactggaggcaacagcttggatgatttgagttagcactgtagtagctaccccaatagattttggtttttctatctgtgcggctccgatcttaaaaccattctctaacatatcttgataattaacaagacaacagtttgtaagaggagagagtagataatccaagtcgtgaatatgtccaaaaccttctgtatgccattctgacaagttttttggcagtatctgtgtcattgccatatgtttgcttaaaatccccgccaagagatccctgtgcgtgttaacgaggtgggaaggtttgtttgcattctctctagtgtatgtttctgaagtgcgatctaaaaaagaaaaaacatcttggtacaaatctttcattattaatccttattttgtgagtagaactattattctacctcttccaaccgaaaaaagctttgaggaaaatcaaaaaaggcgcaaagtgcgcctttaagttttatcatttggagaggaattgtcttcccatgatcttaccgttcttcacagcggtcccatcgtgtccattgtaatcccaagttccatcgatattacgcaagaagctatcacgaacagcataggctttaccgttctctactttactttcttccacaatgattgccataacaagcttattttcaatttcggtagtaaccgattctttgataccctctgtaacttcacgatcatattggatataaactcgctcctcggttacttgcacgtctaccacatttttaaatgtgtaggtctgttgcgtagtgtagaggacacgaacgacactcttcttacctaccggaggcttcttacgaggcttacggtaacgtggtttagggttgttagttggaagccaaccaacaatatcccgatcatatccaacatgaccccaagtgaaatgcgtagccgatccactatccgtagttccgtcacgaaagagaacttctacgtgaccaccacaagggcggtgtccaccattattatagttgtattttgccgtgcgcgggagaatgaagtattctttaatcgcccactcttccagattgtcgatattccaagtgaatactgttcccttagcaacatctgtttgaccattgttgaagcgaacctgcacgaaatcttctgaaggcataacacctgtattcggcagatattcaaatgcagtatcttccgctacaaactgttcttcctcttgctcctcaatacttggcacaggcgcagcttcatcgtatttcgcagcaaacatatttttaaattcttgagccgtgacttctacaaagccgcgatcaccagtagcagcagagtgtgggcgtggtaaatccccaacttcaatatgcattgcatctaagcctgcttgacgatcaaagaagataaccttgcggaattgtttatctttatattgtggcagttcatacatacttggatcgattgtcttcaaacgttcagcatcttctggcttccagaagcttttacctgttgcaaatctaaagtctaccagtagtttaacaacatctcctaatgataaactatctgcatctacgaaaacgtcttcgattcccaataaccctgatttcttaagaatcagatctaacatgtaacctcctgtggtttgttctgcgtctggataacgatcaacactggtgctggttacaccgtttatttcaccagtggaggcattgtaggaaatatatgggaaggtcatatcgttcattgcaaaatcacctgaacaggttggatcatcttctccctcccagccatacaccttcacaataccttcacacaatttgtcatacacaccagcgcgacgtgctgcttcagcaacttcctgtttacgggcaaatttattaatcatgattcctcctgttaattgccatagatgcacgaggttcggctatggctgttgcataaatatatggatgaccttgtggggacaatcttgttccgaatgaccctaattctaaaccattcatgtcttccacgtcaagccctatttctgtttctacaattcttgtttggactttgtagtaggtccagaagaagtatcgcatttcttcggcatactctttcacttcaccaaagctgggatagaactcaatcaactccagcttcaagaagatgttgaagtgagaatcatccaacacttcctctgtgcggtaacatggtgtcagggccatgtagggatgaccagcgataaactcgtagccatccttttccatttgcaagaatgattgctcggcactggcaacataaaacttcccattaggatgccccaaaggagcatcttctttgccaggtggcagtgtgaatgccaaaatatctgcatctactaaataaggaacatctaacatttcagcaaagcgtccataactctggatggcttcggcaatcacacctgtgttcatgaccttcctcctgtgcggaaagcgcgtttagtaatgttggacataatgattaaatcttgtaaagtcatatctgggaactgttgttctaaaactccctcgacagcccctataatatctgacaattcaacaagttgcattattttgcaatcctgctcaacagcatcaaaaagttcttctacttcctctttaatcttttctatgctgccataaggttgtttcttaatgtctgttatgtgataccctgccatttaacgatcctctctgatttgattaatcttacgagcaagggcagctataagcttatcttcttcagatacaggagccgtgctcttacctaaacgatgcatgtctaaaatctcttgaacagtccggttccattgcagacatttaatacaacgtgtatgtgcaacatacagaagatttcgttctgattcttcaagacctacccactcacccttcttatcataattagaaggaaagtcatttgcaacaataacctgatcccattccaaaccttttgatttgtgggctgtagttaaagtaactttagccgttggagagttacggtgcatacgtaaagtgtatgcaatattattagctttaccagaaacaacaatgtttaaaagtcgttttgcatcaggatctgattctgcacactctacaaattcttcccaagaagtgtaaggtagaactgtctcatgcttaactttgtccaaatcacctctacgtaaagcattaacactatcaaccatagaaatgaaatctttggtatctacgttaataataatctcttctccgttagcgattcggtccatagcttcgagcaacagagtcaaattcttacggaaaataatggtgtaaggtttactataatctactacatcagaatgaaaacttccagtgacagtatcataacctttgcctaccagcggatgcttcagaggtgagcgatcagaaaggatcgcattggcaatgtccgcaactttaggaccaaagcgaaaacaagctgtcagaggcaactcaaccccatatgtagccgtttgcttcatcatgttctggcttccacggaactgataaatactctgaaattcatcacccacaacaacaatacgtttagccgatttagcattgcgaaggatagacaggaatgcagggttaacatcctggaattcatctccaaaaataatatcgtatcctaaatcttctttacttaattcaaagagtttcacataggtgtcatgagtcataatggtttctgatttaggatcaatacgctcacgccaaagttgcttcgcatatttaacaacttcattaataagtttttgttcgttgatgttcttacgtttaagatctgacatatgcactttaggaaaatgtttatgtccaatatgttcatcgtcagaaaactcatatttagctaaagtttgttttaccattaacccgatcattgcacgagtcagtagcactttaccattcttatcaatcaaattctgaatcttgaattttttggcaatctcactaccagttccagctacgttaacatattgaccttctggacgagacaatttgtgtcgaaggttttgtggaagacgttggtaacagattgaatgtagcgttcggcacataacgttaggcggcattttacgtcgagcttcctctgccatacttttgttaaacgccaagtatagaatactatcatttgtgccattagccaacatatatagtgttgacgttttacctgatccagatttagcttgaattgtaacgaaacgattttctttatacccgctttcaatagcgtattgttcctcggtaggtgtaaaactcaattgtgtagacacgtatttctcctctcttaataaaaactcttgacaatcctcatcatttccttagctctgctggcataaggttcttttagattaggtggcaaatgtgcattaatgtaccccatttgtttttcccatgtccacttatctttaaatcttggcatggtgtctcctgctaaactgttttcttttcgtgtttgaataatccaattacatggaaaatgcacaccacctttacggaagggaatataatgtcccaatgtgaatgccttattgttctttaaacgtccagctaaattaagattaacaataagactacgaaacacgtagtattgataaagattgtcaacagtatatacagagtagtatgctctaagtgcattatctctactaagattaccaacatccaaactgcaccagtttaaattacttggatcgtagttgtgattatcaatccattcttctctttcctcaaattctgcattaacagcagactgccctgctgtagatacaaaaagagaatttgcatcaaagaacatactcactccccctttagtttacatcgtttagagcattaccaatctttaagataataacatcattaagagcgtcttctccattaaggccagagaaagcaggagtaacgaaagttaccatatagtaatggtcttcttgtaggattgcgataacgccgtctagtttaacatctcctgtgaaacgaaaaactttcaacttttgttctaaaggaagatctccttcaacatttaaaaccatatctccgacaccaaacttttctgccccgatgtagatgtaagcttggtcctcttttttatgataatacagtgttgcttgtttgtcttgtagtgttgtgataccaaacacatctacatcaataatatttttcaaaaaattctcctcttattttgtgttgaccttatttcgcattaacctgtgggatacagagttgcgagatctgtttagaaccttaccaatccctgcatgactatacccttcactatttaacttttcaagaatctggtcttcttcctctgtccagtagcggcgtttagcttgtctatcatccacaccatacatgataggttgctttacatccatcacttttagcaatctgacagcctcttccgctttctcttttttgaaacggagataagggattaaattctcaagcaatcttatcacactttctctgctgctaacattgatattatacatcaaattatcatatttttcagcccaagctacgcgcgatgtgaaagagacagtatatccataactttccaactctttagccaaatcggtcatttcttctgccgatctctcgtgttgtgtaaggtttactgtgtaggagtctgaagtctccctgtttctgcttataatagacccatcacaatctatgcaacctgcgtagtaagcataaaacagttgttcttttatgtccacaatattaacctaaacacatacgtgcgatcagaccttgaattagtttatctgcttcttcccgatcatagtcggtatcttctataccaccatcttcgtcacgataaactttaccttccaggtacccagcatcgatcaaaccaataatcaaatcgaactgccagcaagagttaccgaaagggcgttttccactgaaactatcttcttcttcccaaagtgtagagagcagtcgtctgaaatattcacgcacagtaacagtgccaagatcatcgtcttcaaaaacaacatctaaagcatctggttcagctttctctacaacaggcacataacgttgaccattaataacaacatctacgattgtttctctcatttttcctcctttttgtattcaatgaacatatctgcatagtaagctttacgttcttcaaatttagcagggtttaccacaatgaacaacacctttctattgtcttgtggttctttgactgtaatatataaatcttttgtgcaatagaaacctgtggctttgtaagcgtcaccccaattatccactccacgatctatacgatcaaacttgcagttatactttttatcatccacctggtagacagcttcaccaccataccaagtgaagaattggctaccttccaccccaatcttgaaaccatcacgggcggctgtagcattggtggcaatcatcaacatcaggacacaaagtagccttttcatttagaattcctcttcagtcttctgtcggtttttgaagaatactacgtcatatacctctccgtaaccatcatttacacagaacataataaaacgatcatcttctgctgttggtgcgcgatgttcaagttcaaaactttcaataaaacctcgtgaatttacgtagtagatttcatcctcaccagagaacatccaatccctgtctatcagatagaaagctaaactcacaggcgacaactcatccttcacagaatcattgtacagcatgtgggctgcaactgccaagcttaaagtcggattatacaacattacacctcctcgtcagactcatctgctttagagaatacaacattaaacgtttcaccgcaaccattatttacgaaatacatgataaagttttcatcttcgtctacagggccacggtattccagttcgtagctatacagagaactatcgcttgtggctccctgcggataccagaaatagatctcatcgaaagatttaacccacttcaaacctgtacgatcctcaaacactaatgaggaaggattgtcagcatctttgacagcttcttcataatcctggtggaacttgactgctgttgataatgtgctcattatgcctcctcgtaatgtttgcaaacaacgtgtctccacgtcttcttataatgttctcgcttcgtcatagcttcttgataagagggaatacgctgtaacagaagtctccattcacagtctacgcccatacgtccgtacaaagcataacgaacattgtttttcttgtcttgcatactccctccgatcagttaattaaactttttcccaagtaccaaaagcacaggaagggtagattccaacttgagggtttccgttatcatctttgaaagtaaaactgttgttgtctttatcaagaactgtagaataaatcttaccaacagtaacgcagttggaagcttgacccagttcagtgagagtaagacatttcattttctgtttctttgtagccatttataaaatctccttagtaagtgaatctttattctacacaaagagctttacacatgtcaagtaactctttgtcagattagtcttaatgattggtgatgttgatgacaatcttagtttcaaccttagcccaacaggagtctgcttcattaaaacgactattcacaatgtattctcctgcacgagaacctgttaagcacactgcacctgtatctgtagccaaatagtattcccgttcttgttcatctacttctgcaatgtaatagtagaaaacagacataggttcaatttcagataaacggtataactttggaacaggggatttctcgataaactcaacagaagttttactcatttgttttctcctagatctaaactaattaagaagtcacgaaggatgatcatttgttctgtagacaatgataatacaccttctccataaatatcaccagaccattcagcagttagatctagtgtaccagtaccaggaaaccaatcaacagtgatctgattaccattagagtcaggtagtatttcactgactaacataacacactctcctattattgttcttgatcttacgatcatctaccgataagaacaagtacttaaatctctgttcttcgaacatctaacgatagagattaatctattacataatctatactcgctatcgctcgacccttcgggggttagggtagcatattttttgaaaaaagtcaacacttattttttggtaagtagataaatcaattattcacctgcttctggtgcatatagtgctttagtatcgaagtcaaagaagtgagtgactcctgttactttggatgcatgaatagataatcgtgcaagcttaagcagattatccatttccgcaatctttgcacgaaatactgcacgtgtagcgtcaaaagctgcatgtggcatgtatttacgatttagactactacgtttaaatttacgataatctgcaatgatcctgttacgttctttgttcaagtgcttgaccagtgcagtatatacatgtggttctttgttagccattgttaatctcctcttcatatgttggtagtgcatggtatgcgatcacaggtgccaagtcaaaataaaaatgaccattgataacagctatcgtgccattgcgtgttttgttaacttcacagaatcccttcttgccgtttgccatgattacaagccactctccgataggaacatcctcggtgccagatactttaatccatccactcactttacttcccctttgtaatcggacactataccaggtcttacttttgccttaagatgtttcaactctgccataggagttgccacttgtataaggttaataatttcaacctcgtagatagtatactcataacccgcatacttcccgatggaatgcaggtatttgatagcatgttcaggtgaatctgcttcaacataccccaaatcttttgtagtgcggccttcacagtcgccttctgtagttacgtgataaagtgtcataaaacctcctcatagtaaggtaaagccttgatcagttgttctgaagtgccattttgcacccacgtaacacccttgtcaagagaaacataccctttcttattgataaatttacggagacaaccagtgaacttgtttttgtagatcatttcttctttcctttctttaatttgttgtgacctttacccttataaagcttgtgattacgagcagacgggttattttggttctccagtcggctaacaggtatattccaaaggtttcctgctacaaaagatgctgccacaagttcttccaggtatacaaaatccaaagcaggtatctttgtttccctcatctcgcgttctacattagacaacacgccttcttccttactgtcttctttttcaattacagaccaaccctcttcctgccaagcttcccctctgaaccaagtttccatgttataaccttgttcgtcgagaataacaccatctcgcatctcaaaccattcgccaccacaaaaatggcggtgctcaacacgtctaccttccttcattgcttctttagcttcgggccaagtcagtttgatgttttggatgttttgcatttgttttctccttttgtttggtaggagttgatcttaacaagattaaaaagtatgtcaatacttgatctgaaattattttcaggtatcatgtatgaacattaacaagagaggtagatgatgaacattactttagcaactaagaatatttctgaaacaattaacggttttggtgtgattgtagccttgcacggtaacaatgagaaatggttggcttcttttgaagaggatcgtcaacacaacattattttagatgcccctataaaagttatgcatatcgttggtgaaagcaaagtgctcacttcctcccgttcaaaagaacaaattacaaatgaattagtaaaactgcttgacaatgttcttaacatgtttgataatgcacccatcgatacaaaacgtgtcttaatgtgagaggagaacaaaatgtactattcacaagacgaagtagcaaacattaaactggcagtgggagatcttattgtgtcacctaactactattgggataacagagatttggttgaagtagtaacccatgttggagttgaaggtattgtgctctacacactaggtggaggtgttgttggggaaatggaacgttatacgacaacgaagaaactggtaagctcttatcacatgtttttacaccaaggttcggaagagtatacagctttcttgttgaaattagatgcagatcgggagaaggcacgatgaaaattgtacacgatgaaattcaaatagaagaaagtgacctgatggatttggatgcagttttggggaaggtaatctatgcaggaattaaagccttccgtgagaaggcaaacaatagcacgtttgtcatgatccccactaaactgatgcgtgttttgtatccaaatagaagtgcgccgtatacagatgaagaagaggagacaggtagaagagagtggttaaatattttagaaaagatggagaatgcttttattgatagtggtaatccagaaatcgtgtatgctgaagatcaaaggaaggcacgattagaaggccgtcttttattcactagttattttgataatctttggagctaaatatgtctgaattcttcacaatggctttcttagggatctatttgattattagtgctgttggcttaatcatgtctctaatagaggaaatgggaattaagtggaattgtgcattcggtatagctcttatgctcactccagtttggatttacatttgcaaatcggttgaactaattggttaatggaggtaatatgtttagtaaagagatgagagaggtgatcgctactctagtagttgatcatggtgttgaagttgagcgtcacgtttggaaagatgagcctcctttctttgatttggcatcacgggctaaaagtcacatgtatctccttgaagatgataaggattttattctgcgtatgcgttatgatcgagagtttagaattcctcttgacacagatcctgatgatgtagtattgtggttggcagagcatttcgcatttaacgctctacatggaagaagttttggtaatgaacgttgggatactatttgtcgtaaacataatattgaaccagaatacgggagtatgtaatgttaagcgttaagcctaagatgatcagtgaagaccagaaagacttcatttacaagtgtggacgaatctggagagagtataccaagggtaacgaggtcgtggtggttactgaacaccagattgaaatctctaatcttttcggtgattatttgcaagtgatcaaattaggcattgacagaggtttggtgcaggtgttaacattatcccaagttgaagcagaacacttagacaaaatcattgtcgagttctaagaggagaaagaatatgatctctttagaatcaatagcttttaagaaggggtataccgcagggttcaagtttggtatgtttaataaagtaaatccatattgtccaaagacacacaaaaaggaattcgaagaatgggaagatggattttctaaaggctatcaggcaaaaggttggttgtaaggagagaatatgattttaaacttcatcatcaacttgtgtttgacattgggattactctgtgcaatagtatcccctctggttggtgaatattgttctgaactggcgatgtttatagttcttggcgcggctattgctaatatgtttgtcgctgcgatttgtatgttgtgggaataggagggaagtttatgaaaaaactaatcttagccatattgctggctaccgtaagcttcaccacttacgctcaaaaatttgtagcagttaaaacagatattggtaaagatgttgtgatcacaggcaacaagttttactatacacctgggaatggtgttctagaagagtgcaaagatgttgaggcatatacaggaaaagaagataacacggaacgtcctttttattcgattatagctacttgcaaaaatgaaatagtagctattaaacaatacaaagatgcacctggaggagagtacttattaatcaagaatattaagagtgaaaaactgcaaagtttacagtaattattttaaaaggagaaacgttctaatgaaatacactatttttggagatgtggctgttgtaaataaggaatatggtgttgaagctaataaacttcctgctggagtttgggttgtcaactgcgatccgcacggtaactactctttagtgcgtggcgaaagtttctctcttccaaacactctttatggggaaactaaagaccgcgccgcacatgttattaaaacatttgctcgtcgtagtaaagaaggtaaaaatactggggtgttactgacagggacaaagggcagtggtaagacgatgttagctaaactgattagcatgtccctaatgtccacagaaggtttaggtattccaaccattttggtgacacagccttacacagatgctggattcttagaatttatgagtaaaattacagatcgtgctgttgttttatttgacgagtttgataaagtgtacgctaagaaagaagatcaggaagcactgttgaccttgttggatggaacaggaagtggaaataaactttacatcctcactaaaaatagtggctatatctcggaatattttgtaaaccgtcctagtcgtatctactacagtttcaattacgataaactgtctagtgaaactatgttagattacttggataagaacttggtaaataaaaaacacgtagataacttccaacgtttatgggatgttagcacagagttgtctttcgatgttattcaaggcattgtagaagaattgaatttctatccaaaaatgacttttaaagaatgtcttgaaatgatgggtatttctttaggcaatgatgctaaatggaatgtggcctctattgtagctaatggcaaaaccttgaaggtgaattggatcaataactggcacgactttacccctactaagtttttgtcgggtgcttgttccttgaacatctatctacaaagcttgaaagatgatgaagtggaagcaatggaaaccaacagttatgttatcctagacgaagatggcgatccacatattgatctatgtgcaactgctgatggtctaacttgtgatctgattgaaggtggtaagatcctggtgatgagcactacaccaggaaacactctgcgagtggtgctggagcctgtaacacaacgttccaccacattaggtagcgtgttctaataagttgagatttattaaacccgcttcggcgggttttctcttgtatggatatcagattaataagaggagcaacagatggcagcaccaaaatcatgggaacaatataaagaagagtgtcaaccaatagcagagagtaagcaaatccaaatcttaggatggacgggagaatggaaaggggttaatacaaaacttgatttgttgtgtcattgtggttataaatgggatactacaagtattaacagttttaaacgtggtagtggttgtcctatgtgtgcaggtcaaattaaagatttaaaaacataccttactgaatgtaaaccaatagcggaagctaaggggattaccatcataggtatcgtagaaccgtttaaaggtgcgcgtacgaaaatgatgctacgttgtaggtatggtcatgaatggaatacatgtagttttgatagttttaaacatggcagtggttgtcttatatgtaggtatgagaacacaaggaggtcacaaacaatacccgacgatcaacatattgcagatttcttttctacagggaagtttaaggaaggcactattttcaccaacacgggggaacgtaaagggtgtgatccagtatggatggttcagtgtcctgtttgttctcatgatgaatatgttaaagctggactatgtgatggtaagttttatatgacgcgtagcaatcttaaatatggacacttaccctgccgttgctctgcatcttataggtatacagcggaacagattacgtataaagtaagaaagaaaatagaaaagaaagggtatgtttggataggatggattaccaaaccatcttctataggtaagtttaaatatgtatgtaagagtcatggggaacaaaaaggaactgcaaacaaccttttaaacataggacaaggttgtccgcagtgtgctaacaaaaatcaacaacaagcctacattaattatatttacgatgagcaagatattatctgtgcactgaagtttggtattgctaataatagtaatcgccgtatcaaagaacaaaatagtcgtaatgtgtttactatgaaacagggccaagtgtggcacttccctactgtgaagcaatgcaaagatgcagaaaagcgttgtaagcgtgtccttcacacggaagcagtgagcaaatatgctatgccagatggctacacagagacagcggagttatcttgcatggcatcaatacaaaacatttataaactttatggtggaacattacaggaggaaacatgttagttgacgttcaaattatgcgcaacgaaaggatggatttctttgaagcagtagagaaacatctgatccgatgggactatgaatttgttcctgctggatgtggaccagtagagcatttagcggaagacgacgatgtatacatgatcattcgtcaagtgtaccagacagaccagtgtgaagaaactcccgaactgattttgtttgagtgtaaagatcttgcaaaatattttgactatggcggaaaagagggtcataatctctccagatacaataaacgtctacttatcttagactacatgcggaacaacaaacacaaactcatcgacgcagacgcagtttatggctactggtggatggattaacaaaggagaaactatggcacgtttagcagataaccctgtattctaccccgttcttgatctttatgatgaattgacatatgttgtggagcggtataattacaatgaagacctcttggagacaaaccttaaagtagttctgatgaaagcctatcagcaagggcaacgtgaaattttggagagtatgaaaaatgcgaataactgatgaatatgtattcttcttttcacataaagatgtgtttagtaattggtatattgcaccctttacagaaaccgaaccaggttacaatcagacatttaattgtgtcgaacaatacatgatgtggcgtaaagctttgctttttaatgatcacaacactgcacaggctattctgactcatagttcgatacggaaagatgagaagatccaagcttattacaaacgtatgggtagggcagtgtcggattttgataacaacgtatgggaagagaaccgtgagcgtattgttatgcgaggtttatgcttgaaatatgtacagaatccagatttgtatgcagacttacacctttaccaatacaaaacgtttgttgaagcaagtccttacgataaggtttacggaattggaatggggatgtatgaaccaggggggctaaaccctgctacctggaaagggcagaatcttttaggtaaatatcataacaaactgatcgaaatacttttcccagacaaaataccgcaaagacgatatttgtgatattttaacttttttcatttttagaacaaaggtgtcactttgtagcacagaaataaggctcctacagcaccgtagagagcctattattttgtcctatacaaacccttgtctttttcagtttgcatcactaagattcgatctaggtgggttcctgaaggtctactaataagattaaaggttatatcaaattcccactatccattatctcaaaaatccctcaaattatttaaactttttaagaatttacaaaagtgaaagttgaaaaccaaaatttaaagtttaggaaaattatcttaaaatgttagatacaaaacaaaactcaaaaatcaaggaaaattttaaaaattttgcgcgcccacagtatttaaagtttttttgcttttacaaaaatgaaagtacaaaagcaaaatttaaagtttacaaaaatttttatgcagatgagaatgagaagagttctcatatggaaatgcaaatgataatgattcgcatttaagtttataaatgagattgattcttatttaataaggtaaatggtaatcattctcatttagagaatgacgcgcaggggtggtgtttgtctcgcgctcccgtgtcccctcgccatgtaataagaataacagatccagccaagaaagcaagcgattattttatctttacatttctttacaaatatatagcgcccagcctaccggcgatcaaccttccaaccagtgcccctggtatgttagccccgcctttacgccgtgggggtggcgtttcctcttctgtatgttaggcattataagcccaatccctgggcttgtcaaacattttcatctatttattttcttgccaggttaggacacctaaccagaaatggcagtcacctttcgcccattgtggtatattgctttctttcccaccttctcgcgcccaggaataaccgcccgtgtaactttgcaattgataactatcctcgaccttataatctgacaggttgagaactgtttctacctttaagcccgttgcgctcgctacctggtgcaccgtgccgccttgccagcccaatgagtgcataaggtgtaatgtagtatttgtcatggtatcgccctttctttgatgtgcgccctggttggcgcggtagaaagatgatagccctttcttttatatatagcaagcaaaaagaaaataaaaaagattgaaaaagtgattgacgttcgccaggtggcggcataatatttaccacgtagggcggcaatggtgccgctcattatttggagttaaaatcatggcaacattgcacattgtggcgaaagctggacaaataaacgtggtagtaaacggttttactgagttcagtcatccccaggatgatcatgaaacggttttatctttcattgattcactgttagaaatgggagtaattacagaagaccagcacgctacaaaatgcaaacgcgttaatcagattgcaggaatagaataaaaagtattgacaacaaacaacaacctgataagatgtatcacatagggcggcggaatggtccagccgccaaaacagaagagagattataatcatggcatcatatagcgcaacaatgatcgtagctggcaccactggtaaacctatgagcggtggcggatctttcgcaaatatcaacattgacgggcgtttatccctggacgcagcgatcaccgtggcgcgggaaacatttaagaaagaatgtaatttcaacaagcaagattatctcggtttcgctattgaaaaaaccgcgcgctttgttgattataaaagcccgaaaatggttgatactacactaaaagcgcaagatgtagcgtttttgctttaaggcttgacattaacgaataatttgttaatatgttacataaagcgggaatagttcccgctatttgtaaggtggtagaatgttttacatcaaattaaaaggtcacgtgatcgcgttcaaagataacgctttttacagattagcaaaatatgcgttaatacatccccactatgtttatataagggggcgtgatgaaataaatatctttgatcaaacaacatgcgagaacatcgagatccgcaaggttggcgtacgtgattatcgtacatctttctacccttgcaaggattcagcaagtctttttaaagtatgccaattgttgaaaaaaggtggttaatatgggccgcgaatatgtgatccagtcttgggtaaaacatgaagcagatgatccgcgcatcattcccgatcatcttatcgatgaatccacgggatatagcggtgagcaaataggtaacagattagcatgtagtaacggcaacgtaaaagcgcgttatgtgcgccctggctggctggcaaatggtaacgctgatttatccagtgcggaagatgcgagcgacggcgcgaaagataatcctttgtacaaaattgatccggcttttcgtgtcctggatgaataccccagcaagatagcggcgctcgatcaggccctggaaagtaagcgcatcacctggaccgcttacaacatggcaaaaaacgtacttgatggtaaattgattcaagccgaaagaaaattagccaaaattgcagccatagcccaggaggaagacgaggagacaacggaagaggaagagtacgaagagatcccgccgttgttgtgtgttgatgcttttcctgattatcagccgacagaggaagaaaaaaggatcgcactagaaaactttgaaaatagtctttgacatatcgccgccactggcataatatttaccacgtagggcggcaatggtgccgctcatagtgaaattatgcaagaggcttacaatgattaataaagaaaatagcttgacggttggaacgattaacgctatcattctagccgttccattttgggttgtagtagcggctattattttctaaaaatattcttgacaacgttttttaatctgataagatgtatcacatagggcggcggaatacttccccgccaaaacaaaaaagggtaacacaatgagcaagcaaatcaatactatcatgtttaatctggtatctttccgcgatgatatgaaaaatttaccacgtgaaacggttgatattcatgtttcagcttatcgcgcccttattgatatgttaccgctaaaacgtgatcaacatgccgctaatatgatgcttaatgctatgcttaaaaagatgattcaaacggatcttactctggcgtatgagtatcaagggcgcttatatgcgacttacaacaaagcggtacctggtctgggaagtaccgaagagttgcacggcttaaacctggatcaaaacacttgggatagtatgcgccgcgttatggtatgggccgaaagcggtaaaatttacgaataaaaacggttgacactgtttaaacttctggtatagtttatcacgtagggcggcaatggtgccgccaacaataaaaggttaacatcatggctatcattgcaaaaactgagattataggtttagattcgatcctcctggcttatgaggaaactttaaaaatgtatgtagtgacctatggtgattatgtgcgtgaatacgaatacattgatcttgcttttgaatgttacattcgccaggtcaataaagcctataatgattatcgttaaaagttttagtcttatactattgacaatgagtgatagtataagcataataacttttatcgggaatacttcccactaaccaaaaagagagagtgacaccatggctattaatatcaatgtttccgcttatgctaccctggctaacacggctaaaattgaattatccagcattgaggcggtgcatattagcgcccgtcgctggtttcaacagtcctacggtaacacatatttttctttaatggttgacgttgagatcggcggtaaactgatcgaggtggttaacgttccgtttcaatatggctatggtgatcattttgataccgtcgccctggaagaatttagcaaggttatcaaccttgagggcaaggaattttcacgcggcgcgtatctttcccgtttttgccgtgacaatgggatcactgtatacagtcatgcaagcgatgtaaaacgtaaaaaagatttataaaaagcattgacagcacgaataaaaagagtaaactgtattacatagagagcgggaacacttcccgcctcactgaaaaagagagaaaaatcatggctaaatctaaaatgtacaacggtcacaaaaacaaaactcattggaatgtaagcctgtggattaataacgatgagggattgtatcggtttgcattgggattgatcaatgagtgcggtaataaagatcaggcggctgatttaatgtgttaccgtttgaaacaggatggaatcactacaacgccagacggctttaagtatagtaaaactgcaatccgcgccgctatggttggaatgtaataaaaacagttgacaacgtttaaaattagtgtaagatgtatgacatagggcgggaagtggtttcccgccaacaacagagagattaaagattatggctatcaatattgttcgtgtatccggcaccgttggcagttcccaggttgtagcagttgtaacaaacaaaaagattaatgatgtatgtgagatcttgaataagtgggctattgctaattttggggaatatgcaagcgttgagtacatcgaatcctaccaggtgccgaccatcagcctaaccgatctcaacgttgatcgcctgttatgcctggatgaattaatctgaaaagattgttgacaccggaaagaaaaagagtaaactgtattacgtagggcggcaatagcgccgccacatcaaagagagaaatcaaaatggctaatatccgcactttactgaaaaatgcaagtcaagttttattttcagatgatgagtatttcaataaagacattacaggcgtgaaaaatttaaaagacgtgaaggatgttatcggtattcgtggatctttacgtaaaggtgactactatggtaacaaggtgcaatataaactgtcaaaatattatgattttactttgacaattatttcataaaaccgcttgcaatcttaacaaaataaagtaaactgtattacatcaaggctgcggaatggtccaccgcctaacaaagagaagaggaaaacatcatgatcacttttactacccgtgaagccgctcgcaacgttgcccgtaaagttaacgccgccaacctgggcgctacgcttaaagccccggtaaaagatgcatcaggcgcgtggatcttccctggtctgcgtcacgctgacaagttaggtactttaagccttaaaaaataatcgttgacttttcgttatagcgccttataatgggcgctatagagaagagaaaccactactaacaaggaaacatcatgatcactttcgctattgtcgccgttgtcgctggtcaggtttacgtaaacgatacattcaccacagaagacaaggccgcaggagacataaccgccgtttacaatgagtgcaaggcagtagaaaggatgttagcgccttgtatgttaatgagtgaacgccaggacgggataacagtgtttactaacattgaaacagggtaccaaatggtagtaacaaaataaagcttgacacggatttaattttcagtaaactgttacatgtagggcgggaatagttcccgctaaaaagagagaaagaccatgaaagcacaaaatgcaattaaagagtacatccttgccgctatcgattttaatgattacggtattacaaccgaaaaagagaagatcgcggaattgatgcgccgttttaattccgagtactggtaccctgataaccaatcacgttttaattatagtattgttaaagcacttgcatcatggttacaaggtttgccatcagatatcaatatcgctttcgaatattgggaaattgatcgcttgttaacatcctggggatacattaaagagaatagcaacgatgataaaatccaacgagaaagggaaaattattggctttatattgcaggcgtgatccttgcttgctcttatgaatgataaaccttgacaattttacaaaacagtttaaattaacaatatagcggcaatggtgccgctcatatgaagaggaaacaaaatgaatacatctaatcgcgcagaaaaaattcaatcttccaagatccgcaaggcctggaacgaggaagtgatccgcaaaggcgacaagcgcaataaaacaaagcgcgggaagagtgacaaatataattggatggatttagaggattaacataacaagggcgcaccaagcgccctttctttttatatgtagaggataaacaaagatgactttaagcgagcttaaaacagcctacaacgcaacgttaaaaatagccgtgcgttaccgtgatgcgtacggttttatcgcgcagggcgtgatcctgggcttttctgacgatggtttgatctatgttgatgcacatcataacaaggtaaaacctgaaaacgtcattagcataaaatatctttaaaagtggttgacaccataaccggacctgttaaactgtattacatcaagcggggaatagttcccaccatacaaaaaggtaaatattatgatcaccgcaaaacaagaaaaaatcattatcgacgttgcagccgttgccgctattgctattattggatcttattatgacaccgcgcgtccttcctccttgcatgaggtcgccgccgttgcatcagttggcgtactgttttacgttggtaaacgctatttatcaccaatgattaacaagctgacaccgtggaaaaataaaggttgatcctgttttatattgtgttatagttatcgtgtagggcggcaatggtgccgcgcccctttgaggatgcaatcatgagtaaagctaacaccgtgctaatgttttccctgattaatgatcccgcttacttgtccaacatggcgcaggagggtaacacattaacggcaacattcaccaataagcttgaccgagtgatcatcatctcactgaaaacagttagtaaaggcttttactcgttagcttatcattggatcactgataccgatgagacaagccaggattatagcgcccctttccctgaatcaatggcacgggagatcatcgcagccgttgtaaatgatggtttgtttactgcataaaaatttagaaaaaggcttgcaatcattttgagatagtgtatatttaattcatagggcggcgggaatagttcccaaagcaaacgagaggattacacgatgagcaagtacacagtagaatacacggtagagaatccggcagtatccgaaggtaaaaagatgacatttgccatcagtataatcgctttcgttgtcactatcttatcaatcatcttataaggtgcacaccatgaaaacaacagatattatcaaagagatcgcccttgccgctgacgttgagatcgaggaagtgatcgcgctcaatcttacagaaaacgatctgcgcaactatgaagcggaaagcgtgaaagcaagtggcgcggtcctggcatataatccggctaacaaatagtttgacaagctgaatcaacctgataagatgtatcacataggggcgacaagcgccccgcctaacagaagagagaaaaaatcatgaccatcgttaaattaacaaccgaagaaatgaaaacaatgttaaccactaatttacaaaattggaaaattggtgttgacgttgaaacagtgtgcaagttgaacgacaaactaacaccggacgacattgaaacgatcatccgtgcagatttctatgatgctttatacgatgattccacagtccttgaaacgatgttggataacgcttggatcaatcccgatttggcggcttatggtcatcttgcctttgaagccatccataatgtttataatcgttaagggggataacatgaatccgaaagatatgcaagcatggaaagggtacgacgatctaagcgccttgcgcaataagtcaagccgtaaccttagacggttggaagcaaagaaaaagaaaaaatagtttgacaagtccgcctagtctgataatatgtatcttgtagggcggcaatggtgccgctcacaagaagagagaaaaatcatgaaaattacaaaaagcctaactaattatgcagcacgtcgcggattatgtttaaccgttgaaaacttagggaaagaagactttttgtgtttttgggagcttgaaaatgattgcgagtggatgttttcttattctatctgcgaagatcaaaacggttgtttgttaacctggcgcggtaatatctatttaccggaagaaattaaagaagagttaccaggtacgatcatgacagagagacagcttaaggaagtgatcaattttgtagggcaaaacattaaaaaataatttgacagtaggcaaacaacgtagtaaagtttattacatagagcggcggaatggtccaccgctcacaacagaagagaaacaaatcatgatcccgactatgttttatgtatcgcgcaaaggtcacaatattttttggtctgaagatttaaatgaagctatgacgtttgcccgtgatcgtgttgctatcggtggcgttaatatcaccgtaaccgatgaaaacggcattgaatactataacggcgacgatgaagagtaatcaacaaggcgggattaatcccgcctgtattaaagggtaatataatgaaaactttcaacgcaacagcctcgacaattggttatattattacagtgcaagccgttgacctggtagcggcagcaaacaagattaaaaagatgatcccaacaggcagcgaattttccgtttgggaagtaaaataaagcttgacaataatttgttatctagtaaagtgtattacgtagggcggggcaatggtgcaacgcctactaatgagggtagaatcatgttagagaaaattttcacggttgtaatagtgggcctggcgttatcggttggagtggttgcaactatggctaacatgatcctatcttcccacggtatcggttaaggtgaaacaaatgatcacgaacaaaacaggcaaaacggaatttttacgcggcttacaagttggtaagtctgagatctggcattgcacgaagtccgcgcataatgaaatgaaagatttcaccgctactttacaacgtgttaaaatatctattacacagaaaaaagccttgttagtagtagaaaacgagatcccgcaaactattattattgtcgagcgtacagcatgaaaacagaaatcattattgaaatcatcaacggctataaagaagcctttatttttgctgaatcagcaagggatcatgaaggtaattttattgataacttagacgattatgatttttctcctagcgcggatcaacggatcgcccaggatgtaacagcctttattaatgctaatcttgccgctatctctgaggcaatgagcgacggcgcaacagccaaccagatcgggaatgatttacattttacccgtaacggtcacggcgtaggcttttgggatcgtcctgaaatatacaccactaacacagccaaccgcctaaccaatgcagctaagtttatgccgaacgtgtcggcttacattggtgaagataatttgatttatattgaataaaaagtattgacacagatcgccagtgtgctaatatttaccacgtagggcggcaatggtgccgccgataatgaggaaagtaaaatggaaactatcgctattgttaccgtagaaaagctggttgttggtgatgtattcgcgttaatggtgcctaacagcagcaaactgggcgcttatgaagtgatggatcataaaaatgaatcatttggcgacggttgcacaatggcggtaaaatctttaaaggatggaatcatccgccaggctaactggcacaaagggaatcaagtcggtttaatatcagctaatttcttgccagaagagcaaacgttagaccaactatcaggcggtaagacgttagccgaactactggaaacagcgatctaatcaacaaaggggcggcaacgcccccacatcagaaaggaaaagattatgagtattgcaacagtattaaacgccgttaaaaccgctgaatcatccggcttacatgttgagcttatagatcaaccaggtggcgatctccttgtccaggtttacccgccgaaagtaggagatgattattattggtgctattctgatacgttcgaacaagtagacacgaaagcgatcacggcttttattttaaaagctattgaagaaaataactttcattataacatcaatcaataaaccataagcagggcggtaacgcccaattaaacgcaataggaagaggctagaaagcatgaaaaagatgatcgcagtagttgccctggttgttggtattaacgcgcctgtactggctaatgagttgcctgaatccatcacgttaaccgatatcaacgcaataaaccggatcggcgttaattatcgcctatgccttgccgctaaaactttccaggacggcacgacagaataccacggattcgagggtatccgttgcggtgagcttgcacgcgaccttaaggaagatccagaccttgaggccataccgatgaccgtaaacggtaaagcttacgtaaaccgccaacaatgagaaaggtaatcatcacaatggggatcgtaatagcaacgctggcgcttatccccttcatggttgaacatgtgctgatcaatgttgtcctggtagtcagtgacctattggaaacggttggcaactggttttaagataaataaacagggcttgtttttgtcctgttttttgttatacttattgaacgggcggcacctggaagcaggggaagataatcaccggaagaccccgctatatattgatagctaacatctatcaaacaacaaaacatcaaagagataaactatcaaatctttacaatcctacctattgacaccggatcacgcttacattatcatttatcacgtagggcgggaatgtttcccgcctgatttaggagtcatatcatgatcgaacaaattaaaagcactaaaccaaatgttaacggtaatgtttctcactttatcggggataatgaaagaggtacaccgtacgccgccgtaaccgttcaaccgaacggggattattggtttaccgtgtacggatcttactcttttggacgttcggcacatgataagatcttgcaagtggttaagcctactgggaagaatatcacagcagaaaaattttataaaaaataacttgctttatagctcctgttaacttatagttattgcgtagggcgagcaatacagcaagcccacaaagaggaaaataaaatgagcaaatcagcaattaaagcacttgaaaaagcacaagaagtgatcgcaacgtcaaccactggcgcaaaggttaatcttgttggttatctgacagatgaaactatccgtaaaaattggcgtaatgctgatttactggcttgcttattgattaatagtgtcgctaatgctttccagtgtgaaacagccgagagcctggaggaaaacttgtttgataatatggatcaagccattgaaacctatatacaatcaaacatggatagctggaacagtaaaacatggcccgacaatttacgcgatacaactgatcaactgatccgccttgccctgatggttgaacgcgataacgttcacaaccgcacaaagtaagattatacaagggcgcactaagcgccctttaacgtaaagaaatgtaaataatgcgctatcccctattgacaggggatcggcgttatattatatttaactcactggcagcaaacaacgaaacgaaacaaaggacaacaccatgaacattaaatcaaataatccagcttactccttcgataacgctttttgtcacggtagcgccgccaaaggcttcgaaatcgatggtaaattggttatcgtgaacgttgacggggaagaggttgcagtatatccagtaaacgatgttaaaagccgtttacaatgccgcatggatgttaccgcatatcagcttgatccggtccgtgtagttgccctggtattagaggaagagatcaaagcaatgcatcacagcaataagtttattggtgacgcgcaggataatatgaacgtttgccgccataaagttaatgaagccttgaaagaatgcggttttaaggatctgatgatcaaacgtgatgaaaaattccgctttcgtaatgacctggcaaaccggatctactcaatctatgaagcgttataattgacaacaaaacaaggggcgcactaagcgccctttctttttgcctgaataatgttgatagattccgcctatggaaaaccgacacagaacaaaactgaataaatagcggtatcgagctaatcaaccattaaatgaataaccatacctcccagggtaacaggctgttagagagccatttaaagcggttaaaatcgatcaacaaccaacaacaaaccatcaaaaacacccttttacctcctttctggtgcaatgataaccattatcatctatctatgtttatctatgcaatataagtgcataactataatgttgataatagttcgcaacaactaactaaccaacaacctaaaacaacaagcaaactaatcataatcaaaggaataatagcaagatgattgataacgacaaacaatcaaaccatgatgaatactaagcaggataacgataacacgacaaaacaaccaactaacgaacaataacaaacgaaaccattaaaagattaactattagcaaaatagtgcctgaatgaaatcattacaaaacgaatcattcacaggatcatcattagcacgctatgccggacacatagcgagctaataataagccaactacaccccaacaatcataaccatcggtgatggttatttcttgttactgcgtagcttgcaataattgcaagcgtaatgacgcttacacttattgcgctggcttattattagcattatatgtaattaccaagatcataacgttagcgcaataacaataatcattgtggtaattacgtaaggaaacaattagcatggcaataattatgggggcaatgggaggatgattatcatcattccgatacattgcacactatgcacataatagaataaaagtcaataattttgggggcgaaatgttaccgccacaggcgggaatgttgagcactaagagaagagattaaaggaataatctttcgggggcgaatactatcgctacgcgatatgttgagcatcttctcttaaacgtaaataaaatcagaaaattcttgatttattttagtttatatgttaataaacgtttaaataataatcattctcatataaataatagtctgcttgtcatgagcgggattagttgacattgttccgtcatatgatgaagttgccaaaccattgataaataagtgtttgtgtgatttataatcaagtggtccaccttgtcgctacgttggcatgagccttgcataagtcattgaatacgaatgataattattctcattcgcatgatatttgggaattgtcgctgcgtggacctgacggcccgaaaattcgcgttaagcacttcttacgtatgcgccatgatttttgccatatcatgttgattctattagatattcttgccatgatagccatgaaacatggtgtcccgaaataatctctccccgtagatattttgggttactttttatacaagagtggggtgtcaaaaataatcggtatatatgggataattgataggaatcccctatgataattcgattgtaattccctaagattgatcgtatgatgttggtgattgatgattgccatgaaagatggctaacgatgagaggagattgtcatgcaagagagtaaaaatgttccgttaagtagtgcaacattgcttcgcttctataaagcatggattgccaactatcctgcaatgaatcgcacaacgagtggcttatgtggttgtctggtagattatgtagatgattttgttggtgagacaactagagaagaagatagaaaatggcgtgatcatttgttagaccgtttgaaatatgaaatgaggaaacaatttacatgtgcagggctggactacaatcttccgttcaatgcagattgcatggattacctttcagagtgcataaacttggcgtgtcataccaacacgttacgtcttcagtgggtgaaagatcgcattgaagatgcaaataatgcttgcattgaataaagatgtttgtataatggatgacataacagatagccaatgaggagatgaaatgaagaatttgaaaactgtcacaatgttcttgactgatcctacacgtgtgcaagcactggctaaagccagccgtgtagctgtagaattccaaaactttaagccgtccgttgtgacaggcagtgaaacgtgtgttatcgatttcattaacgaatacttccgagggaatccggttggtcgttactttattaagggtctgaaggatgcataacatgaaacgcatgaaaattcgtattgagaatgatggtggttataaaggattggcacatgcaaaatttccacttgtgttggaagctactgtggaatacagtgggcttgctcatgtgcgattctcgaagatgatggaagtgcaggaatggttttgggacgagatagatgcacgagaaggggaagattatgttttctttcctcacgaatatgaaattgtctattaagggttgtgtgcaatgatcacaccacaacagaatgaagcagcaatggatcttctcgatagtttgtatttcgataattggtactctgaatgtgaatggatgaatatgcaaactctgaaagagaagacaaaagcgttgattacagtagatcaatttcttgcagagacggaaagaatgaattatgatatggcatctcgcgcacgacgagtttccattttcaataaaatgttggcattagggggaggtagaaaatgagacaattcactatactggcagcttatgtgcaatgtgttcacgattatgttagtgctcatacaggtttgctggaagttaccagtaaaattgaaggtaatatgggtactgtctgtgtgcaacatactttatccaacgtgccgtttaaagtgttcactgttgtagctgctgattacaatcgtgtagatgtgcgtttcttggatcataattttcgtaacgcactagataatatcgaagattatcttcccgtgaaacctttgtcatttccgccgagtcgtgcaaataatgtagtgacaaaccttaatgaaaggaatgtggctatgcacaaaaaagtccgtcaactgaaaatgctgatggaaatgcaagaagagattgaaaaagaactaaaagaagattttggtatgcttccaaaagacgctttgaaatggtatgatgaactaggaggagagagcaatgtttaaagaaggtcatgtctaccgtttccaggatgaggattatatgcgactatattctacctttgataacagtattgcggctatcattggagagaattttttcgaggtgttgagcactgatgtaaatggtaatatcttgtcaatggttgtaataggtatgagagatggtattatcagtgctggtgatggggatcgttacataatcaattctgctcatatagattattttgttgacggtggtgttcgtggtggtcgtggaaaaccccaagaagaacctgttgatacaacaaaagaagagtggtatgttgtaatgactgatgacacctgtatttctggatttgaaagttatgaagaagctttgaaagaagcagcagagcataaaatggctaatcctacagaagaggttgaagtttataaacgtatggttgttgctaccatcggcgtatcttttgtttaaaaggggaatgttatgtttaaagttaatgctgtttactgtttcaaaagtaaagctgcctgtgaagctttctctatgatctctgatgaaaatttcaaaatggcagctttgattgaagggtcttgtttccgcgtcgaagatgttagtgaatcagggtccgtttgctcattgactttattggacagtggagatattattgaagctggaaagtatccgttcaggagttgggagatattgttagctcgcggagagcgtaacttttttatgtgcgtgtctgcgggggaagttgtgaaagaaactaaggatgtttctgtttacaattctgaatttataagttatagtgagtatcaacatctggaaggcattgttggtcacttgttatctctgattgatattgaatgtgacctgcctgaatcattgaaagaagaattgaaagcattagatctgttataatgtttcgcacaacgaaaggagaataagatgaatctgactgaacagttacgccgtattgcaaaagaagcttccttcaacttccctgttgaagaagtgatcgagacatgttttgctgaagcacgagcgggaaactcttcaagaaatttcacgccatctgattttggtttggataattctcctactcatccaggggaaatctacaatcaggtgaagtggatggatgaagcagtagcaattcttcgtgagcgtgggcttattgtttataaagaaatggatctgaacggggcatacgagtggatcactattgattggtccgaggtgaaatgatgaaaggtaacaagatgaaagttaatcaagtgccgagcgcatacactttgtggcttgcgcgagcattacaccagacgatcaaaaaccctaagaagccaatgaagagcgggaagaagtttatgtctaagggcaaaacaacctttggcttcactcgtatgtctgttaagatgaaaagactggggtataagccaaactacgctcgttacccttctgaatacaactggtttgactaaagaggagaacaaaacatgaaaacatctattcgcgtgaaacatgatccgaacagcagttacccatacgtgtatgttgaacgtcatgaaggggactattataccataaaacgtaaagtcccaactgatacagggtttaactttgatgttattgcgctggatgatcaaggtgttgataatctggtgaatgcattactcgcattgaaggaagtacgatatgaaaatcagactaaaggtaaagtggctttcgattcttgtgatcgtttagccgaagagattgccgaatggcgtgatactcactaaaataggagaaagattatggctacttttcaacaactgaaagatgtttcacgtttagtaagaaaaatccgagaagcagacgctgctgtgcgaaatgcgctaacgccagcagagcgtgaagatcttgaagaggaggttaaaacagccgagaatgcttttgctgtgtatctttcaacactgtacacagggggttaaatgtcagaagaacttaaagaattttatcaagcctatcataattggctgttagctggtgctccagataataatcctttctggcacgataaaggtttgtgcagttgcctctatctttggtctggtggctatgatgatctaaattatgaaatgcaaatgcaattccgcgaagcagggttgtctgaagaatacccgtttgatgacggagactggtttaaatatgattttgcacaaagaaacgggctattgcatttgaatgctgcccgtataaaatgggtaaaagatcatgctacacaggaggatgtgcaatgccaatagtgtttagtttcttaataattgttatggttgttcttttcgcggcatggctttggcattttgacccaggagcagcgcagcaaagagctacagactggaaagaacaatgtattgtgctcaaacatgaacgaaatgcggagaaatttcttgacctggagtgtgatcgccttgtaagatacaagcaagataaataaccttgaggtgcaaaatggtaattgagattaaacttgaatatgctggggctgttgctctgatcgcacaaacgttgggagcaaagattgaagaagtgtgtatcaatgcctggagtgtagagattgatgttcctatggataacattgctaatcgcttgctggtggcagagtgtgaacgcaccaacataatctacaaaggagcataatatgaaaattagagtttgtgatgtattgggttatgttggttttgagaatgttcagattccttttgttgttgaagcacatcttgttagtgatgatatgacaacattctttgttacgatagaagaaatgtccaaagttgagggatgggagtggtttgaagaagatgtttgggaaggttgtgattacgtatttttctctgacgaagtgaatgttcttgcggagtaagtatgtcttgttttacaaaagcagtgtccatatgtaagaaacagtatgaaagtgattacggaatatttaatattccagcagatcatacagagtattgttcatgtggtggcagaatgaagaaaacagtgatttatgcggataatggagatgaacttgttccagttatggtttgcaaagcttgtcattctgttaaaacattaaaagcgtaaggagtcgggacacccgacgattggagctaaaaattttgcgtacaaccctttccgcccaacaggggcgcgtcgggtaaataaagaggagagtttatatgaaaaagatcatcgtaggtttcttgttactcatcgcatcacttggaacagcaaatgcgtctcaagtttatgagtgtgtgtcagatgtggttgttaaaaatctgaaaggtgaagtgatttctggtcctaagaaaatggcttctgttgtcattaataaagataactcctttatccttaaaaattcaggcggtgctttgatgagtggcattctgcaatacacaggagaaaaaagtaaagatggtagtgctatgtacggttcacaacaatttattggcactactgaagtggttatgctacgcacagaatatcgggacactttagcttggtttgcatttcttaaaaatgataaaacaataacaaatgttcttactctagaagctgattgtactcaacactaagagagttcaccgtaagatgttcgaaatcatatttttcactgtgtgtatatttcttttaggtagcttagtttatgaataggagtttaaatgtctaaagttaaacattatggtgtaaattggagtgatgcttggcctctatgtaaagatgaccctacagaagggacatttgtaagatacgaggattataaagaattattagatgctgtgatcgcattgttagacgatattcgttcacgttatccaggacaagacttcacttgtcctcacattcaacttcttgcttgtctagtagaaggtttgccaaaggaggtagaagaagggtttaagcgtgtgcaatatcaaggtgaaactctagatgttcctgaatttgttaattatattacaacagattcaagtggtgatcgttatggttacagtcataagccagagattccagatttcgttcatgcttggcgtattccttatgaagtaatcaatgttgcagattgttggtatttaggagaaggagacagccgtaattggcgtgactctttgattcaggtttaacaatatgaaagaaacattgccagcagcatatcgtttgaatgatgaacgtatttgggagtggaccgacgtttcttgcttttaccccgaaatagttcagtattggcgagcaaaagggtgtgttgtagttatcaatccttgtggaccagtagatgaagattgcctgtatctcgatgggaagtggcacagttattgtcgctggccttttgagtggatgtgtaaagaagatctcccagaaggttgggagtatccgaaagcaaataggagataatatgtctaaagattttgttgaagtgtttgtcaaagacgaagaaactggtttaggcacaggtttcatttgcgaagaaacttttaagcgtgaacaagaaaaagctattcttatgcaccgctatgatcatgcattagaacaatggaaaaatgcagaacaaaaatgcaaaaacctttacgcagaaaatagaaaactacaagatcaaatggagttgttagctatcagtttacgatctctcattttggctgtagaagatggttttaaaaatccagatggttttcctgtgagcgatattgaacatgatttgtatcttgctcgtggtgcttacttttatgttaaacagaagtctgtagaaggagagaagtgatggaagaaaaactggaacgtattatcgagttagccatgtctattggctacgacgattgttttctccaaactattggagaaacacagaacgattacgactcttgggtgaaagagttggaagaactcaaaacttccttgattgctgactttgctgaagccgaggataaagcagatcgttacaactatctgtgtcgataagccttgacatttattttatgtatggtatacatacattatcaacgtgagcaaggtggtgtaatatgaataaagatcggtttctttctttagtcgcggaagctccttttgatgttcttggggtgagattatggaaagacagaaactatgggttagatgttcaaacatactctctttggttggttggggagcacagcttagatgaaagcttgtgcatgggtagagattctcgttccctctgtttaaagttcagaagcttagaacgcgcaaacaaagagcaagaaaaactaacgaggtggctaaatgaaaacaagcgcaaggttgatggagttttataaaatttatctagcatggattgatgttggtgctcctgatggtaaaccttttcggcgggattgtggtttgtgtgccaacttgttcgattatgtgcacagaggtaattacaaccccattataacaaccttgtcagatgaaatgcacgcacagttttaccataaagggttgaatcaagaactccctttcaatgagaactacgatgcatatgtcttagaatcagatgcagaggtatgtcacctgaacgtggacaggattaattgggtaagagatcgtattgcagaggaggaggatgaataatgtcggattataactggtatgaacttgaggctgtttgtcagttttacgactcaatagttctgcgtgatccaatctgtcaagaattaagtcgccgtgcaagtgcattggcaatcaatgttaaagtgcacgattggaacgcagatttggaaaaagaattggaattccttttggaaacaacccgtgtcttccataaagtgttccctgaatggtttgagatggagggataagcatgtggattgtccgtcttaagtatgatggcaagtttccgtgggagaaagatgtttgtgcctgtgattcagcagcacatgccaaagcagcgggtcaggcagtagttgacatgtataacaacaccccctttgatccagaaatggcaggtgttacaatgagcatgttcacttactattcttttgaggtttactatcatgaaggagagtggaaatgagcgaagaactattaacattttaccgcacgtatttggcatggttggaagctggtgctcctgaaggtgaaccgttcacccgttgcacaggtttgtgcacgaacctttatgatttttacgacataggagaaagcgaacgatacgaacctgtactggatgaaatgcatgagcagttctacctcaaaggtttggttatggtgttgcctttcaacagtaattttggaaagtacaccttagaagcggaaaaaagccgttgtcatttgaatgtggatcgtgtgaactgggtaaaagaacgtgtagcagaagaaataattggttgacagaaggatctgtctttgtcataatcatctcatcgaaacagagaggagaaaatcatgaaaaagtttatttgcacccgttccactaacagtgatatccttgtaggtaaggttatcaaaggagaactcttccatgcaaacggtaagaaatatattctgctgaaagattctttcaacggggaatatccgcgctgcactttcttcaattacaacactccgtttgctttagaaggagatgcttgggactgggctgaacttcatcctttctgtgaagatggacagacagaagagcaggaagaatctacgggaagtttacgtgataaactgcgtaataaagcactacaagcaaattcccattttactgaaatggtagacgccgttctattagagattgaagattgtgcggaacaagggaagtttgaaaaatactttgaaccttccagttttggtttgtgcaataacccttcttcttatgaacagataagtgaacagaaaagaggggcaaatgttgtagctacaatactacgtgcaaaaggtttggatgtaacattggcaaccgcagagcacagtatttttgggattatcaaacacatcattattagttggaactaaaggagagaatatgcaagttgaagacctgatccacattctgaataaagccaaagagaagggtgctatcaaagactggaaacgtgaaacaagtgaagatttatctcactgttgtcgagaattttacatcgaaggtattgctaacgatcattatactattgaatggtatattaacttaatgactcttaaacacggttcatttgaggtttggtttgatgacattgatgtaaatggttttcatcctggctataaaatcgctatgcagttatcttatcgtagagaagttgtagcacatttgggtttacataactaaggagaaaagaatgcaagcagttgttaacgaagctattatgaacttatctttcttgttagctggtttaggaggtgttctcataggtttggctcttatctggtgtattcgtcgattaatcgggtaccgacaaaaaggtgtttcatgttttgtatcttacaattttacaactgcttacagcaatgaggttggatctggcaatgctcaagcatttttaccaacatatcctcctacggtggaagatattagaaacttggaagtagaacttatgggactaggtgataactatacatctctagttattcaaaatatttttcgactaaaacagggggcgtgaatgaaggtacattaccctcatccatttgatcctaaaaacaaagccgtaattcttcgtcagtggcaacgggtttgtcgtactaaatgtccaatcaatagcccacacaatgtagacaaggactatcttgggacatttgttgaatacacttacatagacaaaaacaagcgtaaacaacatgtcgaggaatactgcttaagagtagaatggctgtaaataataaataccttgacaagtgtttattcgttttgtaaagtgagaatacagcaatggtttaggagtggttatgaaaaagtttgttgtttacagtcgtctttctaaacagaaaaaaggtgaggcacaatatggtatggagagccaagagaatgatatccgttacttcttagactctgtgcctgatgcggaagttattggtcaattttctgaatactattcgggtaagggcgattggaagcaacgtaaggaactggttaaagcggttgaaatgtgtaaagctaccggagcaactttattggtagctaaagttgaccgcttgggtcgtaacaacgcctccgtagcaactcttctagaaatgatcgatgttaagatagccatcatgccagacgcagataaaatggttatacagcttctgtctgttctggctgaacaagaagttagaggtattgctgatcgtattaaaaagggtcttgctgtagcaaaaagcaaaggtgttttattaggcagtgctaatcctaaaactgccgctgcacgtagaaaaggaaaaatggaatacaactctgttaaagcagacgcttttgcagagacattccgtgaacgtttggagatccttagagatttaaatacaccttacaaaactattgctgaaaaattcaatagtaagaaaatagcaacagcacgtggtggtaaatgggatgctaaaactgtttctcgtttgtgtgccagacttaacattaaataggagaggatatgaaacaagaaaatgaatctgtagatcacttaatcatgctgtcagccctttttgccggatgggacgtattttttgaaaatttgttcaattctgctacagatggttctgattttatgcgccaatttaaacgacgaactgttgaggactatattttctattcaggtcggattgaaaaaggttacgaagatatagatacaatacttacaattaaagttttagatgtgatgtttagtgttatagatgctattgatgaaagtcttccgattttagaagattgtaatacgaaagcttatgtttacaaaatagcccgtgcttatgtgtctgcaaacagttgtcttctttccacccaaattgcggtgaacaattttgccaacttgttcgatgaaggagaaactttttatgacaattgatttgaagtgtaagaggattcttttagatttctataataattggttagaacacctccgtctctttccacgagaaagtggttacgctgatgttggcttatgccgaggtctacgtatgtatataagtgatgaatttcgagccgatcattctttagcatattctgtttatggtatgcaattagccagttttgaaaatgctggtttagatacaactttcccgtttaacacagcaaaatcttttgagcaagagtgtaaggaaaaacgttgcatgtttaatgaaaaacgtgtacagtgggttaaggatcgagttaaacaactagaacaagatttggatttcttctatgatgaggcagaataatggatagacaaaccttaaaaacaatggcagatgccactaattccccgtactttgaaaaagtaagtaaattggtagctcaagccgcagaggaaggatattataacataaacatccacaacccaagtcttatactagaaatgccaagtgataagaagatacaagagagtatctgtgaaggtattgttagttactggcgcgagcgtgggtgtggtgcaaacatggctttagacagtgcaaacattgtaagatatataaatatttcttgggggtgattttatgattcaatgcactcatatccaaattacttggagagatgaactttaccatttaggacaatttactgtaggggaaacataccctgtcattaaacataatcctaacatcgcaaactttgacaggatggttcttgttgaggacgatctaggtcaaacttattctttagatctaaaatatccgttttcttacggctacgattggatcgttacttttgaagacgtggaggaaaataaaacaatgaacgaaaaaaattcttggtattatcgttgtgaactgccgccagtaggtgaaaaggttatctttgttcctgatttggaaagatattcttgggacagttcttattctgttcctaaagaaggcaccgaagttgaagttattgcacatcgcacaacttcgcatggtaacgatgtagcagttgttttctgggatgatgaaggcgctgcttgtgcagggggctttgttgcaggtaattttgaacccctgccagatcctttgaaggaggcaattttaggcgtagcttcttttggactctcttacacatctgcacaagagatcgtagaaggtattttaaacggtaccgttccaaacgaaatttttaaacagattaaataatagttgcaccccgttctgcggggtgttattgtatatgtaaaggaggcgctaatgtattacactgaagactacatactgtataacttttttaaaggctggttgaaatgggctgaacaagctcctgtcggagattgtgtttttccttgggattctcgtcaaggtttgtgtcgttgtttggaagattggcttataaccacaaactacaattcagagactaagaaatctacatcaaagagactaaaaatgttatttgaagaagatggtttagatccgatttatcctttcggtgctgaaagcttccacaatggtctttttcttggcactcaacattatgacaaagatcgcgtagattgggtaaaagaaaaggtagcacagtatgaatggggctaagacttatcatcgttggttagaaagttatattaagaaatgtgaacttggtgttccaggctatacttacgacacggacgagattcttgatgaaatggaagtttggtttaaagagcctcgtgaactattggaaaacattctaatggcttgggatggtacggcacaaagcattgaaggaggtagaaatgagtaagaaattgtttaatattcgtgagaatcgtgatggatcgttctctgtagtcaatgagtttaacgtttcggttgggacttttattactaaacgtcaagcagaacaagtaagagatactttaaacaagtaaatttttaagggggacttatgttaggtaagatcaaagcttttttcaaaagtattattgaaggaagtccaacagaaggtgcattaggaagatctctaacaggagaaccgcttgccataatttctatcagtcggtatggtggatattcaattaaacaaacacctttaggtatagaaggtagtatgctttcttggacaatatctcaagttggtgataacagacttgcagctatagcattgcttcgtggggagtatgactattgtttatcagcatcttgtaaaaagcacctcatagagcacattagagacagagtagaaagagaaggcggatacttcttcgaaactaagagaaacgaacaaggaactcttgacttcactaaggtttactgggacaatcatactcgtcaaactgttgaacaacttctggaggaaagatgttaaaagcttttgctgtatactctactgtaggattcttttattggattatagttattgtcggatgttggttaggttcttgtgttgtgatgggagaatggttaacatacaatgtattcgaatgggatgtagtttgtagatcattacttgttatatggactgctattgtttgttggataactgttagtctaacattagatctatattgattaatagatggtagatagatgatcatagtttatctaccttcacttacgtttcatacctcactatcgtgagtaacatgaaacattattatatagaaatctactactcgctatcgctcgtaaacatatgtttagggtaccatatttttttgaaaaagtcaatgctgattcacctatcaattatctgtttaagataagtcttacctatcaatctaactcttaactagtattgcacctatagtaagactattcctatagttattaaccctcttcttctgtagaatgtaattagatccttgacaaactcacaaagcttatgttacattgtgtctcacaagtgaataataccgaacaggaggaagaatgagttccaattttctatacaaagcaaaagattcacgagatggagagaaccattggtggttgatcacagaagatggtgttatcatcctaccgtgggacggagagacgaaagttcaaatactagagaaagtaaaaggtgttagttttaatgttagtcatgatataacaactttcaaagcttttgctatgaatcctagtcttgttgctgaatggtaatccaggagaagatatgactaaaatgtatgcagccgttgataagctggatgggtctgattctgtttttattttgaataaaatgggtgtcttagtttatgcccgaacttctcaaaacatagagcaccaagtggaagcagcacaaattttagagcaaataacccctccatacctatactcaaatgttgagcgttttaacgatgcacttggtttgacgttaatagcggaatggtaataatggcgaaaatgttgaaaattgataatgtcgtaacaatcactacgtctataccttgtcctcctatgccttgcccctattgtggtggtgcaggatatgttatggcggatgtaggtcaaatttacgagtgtaacccgtgcaaaaccacaggttatatccaagtagaatcagaggagaaacactatgagccaaaacgttaaagaaaaagaagtaatcacggtaatccgtcagatggaaggtgccgaaaacaatgcttttgttactaagattcttcttaatatctttgaagatgttattttaaacaatcctggtcataaagattatcagtatgatgttatgatgggtgctttgcttgagattaacaaaaacacttttgctgaatatgagcaacacatgcttttaccagaggaagatcaggattatttgttatctggtgctttaagtgcacaagaaaatttctaccacgttcttaatatggcttatgcagatgaacttgctgtctcccttgaagagcggattcaaatggttcgtgacgtaatgaatgaacaaatccaagaagttgaagatctggtagcagagcctttagcagaaattcgtgcagctattgaaaaacaaaaaggaactcaatcatgatgcaagtaggtgatgtggtttgtcttaaaggtgcaaacaaacaaatgacagtaatagaaagttatggtgaatcttgtaaagtaacttggtttgatgaaaacggggagttgcaacacgctatattcgatcaaaaagctttgaggaaggttgaagaaaaagaatgagccatccgtcaatatttttctgttttgtagatcttgaaaacgagtctttaatcgttgatagtgagggttacttcacttattgggaatccgagcacgaaactataagtgtagtgaaagaaattatgcaaaccaatccaaacctaccagcacataagtacggtattgcaaaagtgtttgttactaaaacagagtacacaaaagagcgaagcactttgtaccataatattgaagtgattcactatttcaaagatgttatttaggaggttatatggaagagaagatttgggatggtaaaaatcctttagaagttggacacgtagcacgtgtcaaaaaatctactacaggtcctggtttttctggtttgtatcatataccagaagaaggtcagcacgttacaattttggctcgtgacaaacaaaacggagcaacgcctgtgtggattgttcgttggtatgacaaagatcttaacatttgcttgtcacctattatggctcatttgctggaagccccttgctctgaagaagctctaatttttgtttcggcttttcagaaagccacaggtttaacattagatgcaaaagatgtgcaaaaagcatttgacattattcaggaagacaacgatactacatctaacgacgaactggttgaagttacaatcttatcttcagcagatatccgagagattgataattgtgattttccaatcacatttaaaatgtcgcagaaagacatacagtcatctggaagttgttttggtatacctcgttggttttttgattctatcaaaaattctaatacagaaggatcagactatgatcaagatgacatgctttggttcttaaaaaaccgagagattgttctctcaccacttaaataaggagaaataatggtttcatttatcgtaggtgtagttgtaggctatcttattaacaaatatcaagacgttatcacggcaaaagtaaaagacattttagactcatctaaataatctatcaaagctgcatcttcaataggtgcagccttttaaaaggagatatggcatgactaaacgcactgattttaaatgtatgcattgtgggaaatcttttggggatcatcaagctcgcacattcaactgtccacgtaaaggtcgcggaaattttaaaggttttaatcccgcacatgtttattctccagattacgataagccagaagaagaaaaatttgttatttaataaggaggtcatatggaactcgttcaagaattgtataatgctttaggagcaaaaggaaaagattggcccgaacatgcgcttattgctataagagactccgatggtgagattaagttttcaagcgtaagtaaagagcacatcgtagaaacaaaactgggtatttacatgcgtggaacttattgcttattcaacaccagaatggtagaagctcctgttattgaagatggaacaaaagattgccccacaatcgtaacaaaagctgaatatgagaagtttttctacgctaaggcttgacacagaaacaatactataggatagtgatcctatcgtagcaatagaacccgcttcggcgggttttttcatatctgtagcaataggaggtcgtgtgttaaataaaatcgaagaaggttgtatggcatttttggtagataacccgtttccctttatggttaaggtccatgtaggagagtatttaggttatgacgaatgggattgtagtatcaatagtgaaatgcaccactaccaaccaacaatacttaagacggatcaaatggcgcgtattacagtagaggatgaattgatcattgagttatacgagagagcactacacaagtaagctagaacccacctaaatcgaacagagacgctctaaaatagaaaaggcacccacttgggtgcctttgttttattcttcgttagattgcgtttcagacgcgttaaattcggtttcagtacaacttgctaggtaacttatattttgcatcactacaactacaggtgtttgaagtttatcttctagccccgcagccacttgagccaaggcattatcaatatttgatttcctaacgcccgttccatgtcctgttgccaagtaaagattaccttcccctttttgtgtagcattggcaaagtagtaaacgtaatgtgcaaggtagtaatcacggatttcttcagtcattttattctcctaataagaaaggggccgaagccccttgagtggtttatttgtttaagtggtcttcgaccattttaatgaaaccttcattgctgaaggctgttgcagctttttctcggtaaacaaaaactccacgatcttcatagagaagtgtttcttcgtaattaactccagggttaactacaaccatttttgtcccgatgttaagagcaggaaaaagctcccagttaaaattgataacttgattagagcaacccactacaatcaccatatcttgagccgtcaagccgtctaagatgtggtacatatcgttatacaatggggcagtctccccaaagaacactacattgggcttcacatacttgtaatcatccacatcgatagcagcatagccaacatctttgatgattctattgtctacgatcacttcaggcaggaagccgtgaacatgtagaacatcttcatgaacaacaccagcttgttccagaagatcatctacgtttgtcgtgatgttgataacacgatcacagccgtactcttgaaaccattccgcgatctggtaatgcgcagcgttaggagttacactatccatctctacgcgacgtttattgtagaagtcatgagttttacggtagaggttgtatccctctgcatctaatccgccaacagccccaggaacacactgttcttgttggtatccagcacggaagttgaaaatgtcacacacttcagaaaggtcgtattcatcccacaaagctttgccactttctgtgtcagtgcggaaagtacgaacaccgctatcggcgcttaagccagcgccgcttatcactattaatcgtcttggcattcttcctcctcataatcatcataatcttcgtcatccaaatcgtacacttcgtcttgagaataactcacttcaaagtaaatatcaaactccgcaaacaaacgtagaatattggacatgctgtaataattatcgtaggcagattcagcttcatagtaaacataaagcaaatggttagccttatcatcttccaaatatttcccgtctgcatatgcatagtctgcatatgctttacctgcatcttccacaagagaacgatcaagcagagtaggaaatggtttttctttttcttttagtttgctcaccaaccagtgtgcaatatcatgccaatctgcatcctctccgctgaaacagcttgcgacttcgccaaacttggcatctcctaagtctccgctaatagtgatcatggttgaactattgtaaccacaagtttcgcaatttgaacaactgttgtgcacatgaatttctacttgaaacatatttcctcccataaaagaaaagccccctgaaacaggaggctttgttcagatgctggcactataccagactttgtaggtatttgtcaagggcttcttgatcgccttggcaaacatagcaacggaagtcttgagccgaaggttgtttattttcatcccagtcccaataaacattacccttataacgtgaaccaggaaactcaaaagaggctgtatgtgtaatgtatcctgggccaccagtgaaatcacagaatgagaattgagggtatgctgcctttactgcctcaataaaccaagctttacgatctaaagcttcattgatgctatacgcatgtctctccatttcttcccacgttttccagacacttctttcatcaggagaaaagacaagccattctggaaggtagagagtgtcatagtaatcatcatattcgatctcggaggcgcacgaagctgactcctccagttttgagtaatcaaaagcagaatatacccaccaaccatcttccagtaaggctttgacagggacgaagcctttatcagcatattgatcgaattgtttgacacggtggcttgtgcagtcttcaaactcacattctaaacgatatgcaccttttcgacgagcctcaagaccgtgtgtactgaaaataacaacacttccttcaccatcattacgatctacttgataagcaaccagtggttttgaatttgacattatttctccttatctagaagattgttagacaaaaacacggcacgagcaaaaccacgtgcggttagggatctaagttgttttgtttttgcactagctccgcctaagcttttccaaccccagaagcagcctatatgatctactggtttcttcactggttgaacaaaaccattgccgtgccaaatacaagttttctttgtatacccatcacgggtaggcattttaggatgaaagcttccttcctcttcaaacaaatacccaccatattcataaggatcaaagtaaaaatcgggtttacgccataaggttgaaagtttacctactgggttctcaatcatccaaggaacattatatttgttacccaaagcttccactacacgaatattagctaaagcttcatccaattcctctgtgctgcgttcgtgtttgctaccactacctgctaacatagtgcaaggtggaaatccaaaaataatatcgggtttaggtatcccatgatcttcagggctgaatgtagaatctatccaggcattcacataggttatgtttgggtgctccatcctaacctcgtatttaccgtgatccccttcatcagcgtttacacaaaaacacttgtgacctgcttcggcataacgtaacaccatgatcccagatccgtcaaacatagacaaaactgttttactcattacccctccattcaagacaagccataactttacgccaatcactttctgtaagaaaaatctcgtttgctttcttccacaaatctaaatcgtgaagggttggaatacgatatgttagttcacagaatctatgctcttcttctgtaatataaccaaaatgcagagccacatcgtgaaaccaacaccaaccatgcatctctcgaacaacatggtcatgttgagacattattttatgccgtaaacctaaccaacaaggaacagatactttagtagtctttaatctgtgatcaacagtattagagtattcaataatagttgtcagtttcaatcgtgctttttctaaatcctcatgcgtcactttgaaataactttctgaaatatatccacacatattaataacctccttcaaaaggctttactacatgatgattagctttaaaacgttcaacatagtcgttttcgcccatgttttcatatagcttaataacaacataaaagttttcccaagcatattccctaaaccaaccactagtgatggatgtgcagactttagataaagccattataaaactttgcttaggggttggacctccgatctctccaccgaaaggaatttgtgaacgttccaaagccaaaacacacgcttcttcataaacacctaacaggcgcacatgttttggttgagcaaaaaacttttctttgctggtcataacttcacttccatctttcatataagatttatatgccggagcatccattaccgcgattgcttcatggatagaatcatgatcataaacatacggaacctcatcacctttaaaaaagtctttactttttacgtttaagttcggatgagagtaagtgtatgtttctttctcacgcaactcataaatactcttaagattttctgggatctttgcgcccagtgaccgcatgaaatgaatatctttcatagttttaaagaagtgaggactatcctttttaaaacgatgactcattttaagaaggtagagcacatctaaaggagcaacaacatgtccagcgtaagttcgacgaacatcatcagaatcttcacaataactaatcaaagcttctgtgctatctccttgagaagcaatatcgtattccaaatgtgcaccagctatcattttgacatggcctttgtttcctttacgttctacaagttcaacaaactcctcttgagagaacatttttgataattcttcccactcttgttctgtacacaggtaatctaaatctacacaagggcgatacaagtcttttcccatgtccatagcatgaatttgcaatgcacggctaccaattaacaccataatatttctcctctattggttgataggttaagtttatcaagcttccagattcctgtcaataaaaaacccgccgaagcgggttattatttactaacacattgaggaagaagagatccaaacacctcttgtggttaaaccattttcatccaactctacaccataatcttcacaaatgaaatcaatatagtgatctgcggctggcgttcctgtagggtaataagtttctccgttaccgtagtcacctatccaagcttgttcctgaaactgttcacaaagttcttcaatctccttacgaaactttctttgtgcttgttccatctctttaactttcttttttatcagcagttcgccttcagactccacaatctctccttaacagctactactgtgccaaacgccttgagaattaacgacgaaaccatcatcaccttcaccataacaagaagaggattgccaatcttcaaaacagattgcgtcattttctaaactaagaccaaaaccagcatgttcagcttcttttgtaagttcgtccactaaagccataatagcttgggctttttcagttaattcttcaacattacgataactcattagtatttctcctctggttggaaaacggaacgacaggcccacatagaagcttctttcaacttagtctttgctattgaaatttggtcaaggcgggtggatatattggtagactcttccaaatcttcacaatcatccagttcagtccacaattcagacattagagcatcaaagattaagcctaatcgaacttcagcatctttaatagcattcactttaccaattttgtcatcggtatgcggtttataacctttgatatcttcgattcccactttacctcctattaacaacttaaagaagatggatgccaatttgttccagtattctcattttcatcttctggatcataataaccacccatcccatattcaggggagaaactgaaaccttcaccagtctcgtctgctaactgctctgcttctgctaaagcctcataagctgcttttacggcttcttctactgttttaaacttggtcgtcataaaatttctcctctcctaaagacatgttgacatgaaatgcgcggtatgtaaattcgttgtccgttgtgtttgaataaaactcaaattgaacaacaccgtcttgagaagacaaatacatgccaatttgaactgttccttctggtaccaggtaagcatactctggacgtagggttacattgtaaaaataaagttccccaacacccatttcatcccaagcttcccaagcggtaacgaagttactttcaaaacttgttactgatccgaactctgccataaaacctcctcaatcttgtagtttgactccatctccaacacatttccacgaacgtctctccgaagaaaggcgtaagctttattaggtattgtagactcatatttaaccatatctggcacagcaaaagatactactactcctgctgggcttctgtcaagagccttattaatatttctaaggatatcgttagccaagatttctgccaattctccaagaacggtttcggttatatctttatatcccattaagtatttgttgatatctttcatctctgtattgttcagagtataatccaaaggatagaaattcaaagcggagtcacttttatgtgtccacatgaaatgcacccgatccgagcagaatcgtaaccctctttgaagaatatcttctacaacaggcagaatttcttttgtcacatcattaaccatgttgtaatctaagatttctgccaagtttgttctttgttcaccacgtttacgtttaggaatcacttgttattgccctcattaccaaaggtcgtagaaaatcgtaaatctcttgttttgttttcccacgaatgtttaaacaaggaacattattggctttagctatcttccaagccgtagctgttccaccttttgcatctccatgtttatcagtattagcacaagccaacaagaaacaggatggagcaggattttccaaatctctacctaacacttgatgcacattacgttggtgcaattttctagcaccctgcttaagcttttcataggctgggtgaacatctttgatccattgcacagagatagcatagttcattgtatctggttttgcaagaacaataacatcccctggaatctgattacctttgaaattttcccaaggaacataaatctccttgttagtaggattttcagactcttggacacctgtttcaaaagcagaatcactaccctctgccttcccagaccttaatttaaacccaaggtttgaaagccatttccctatgcctaccatcaaagcccactcttcttcggatatgtctctacttccaactcccgtatagaacagttctgccataatcacctcaacaagtaatttcaaaaggtgtatacggttccgtatttctcatgatccaaggactgctaggattgctcggatcataaggaccaaaaggttttatggtcggttgtgtttctttcttctgaatctcttcaaaaatacgacgaagttcagaatattcttgatccaccataagattcggtgcatctgattctacagcttgcaggttatcttccttaagaacaatctcacgaacaagattaacatcttctgtttctaagataacttctttacggatattacctacactttgaataattgtaatcttatacattaatcctcctcaagagttgaataaaattgaagaccaccgtccatatcgaaataagcaaatgttaagttattattgaacacagatccagtatccatataaacacgattcgcattgataataggtgtttttacataagagtgtccatgaaacacataatccacacccatcacaacaggaagtttcattccctctttagcacagtctaccatatctctgtcccacataagtgcttcagcaaaacggttttcctgtgtttttgtcatcttcgaaatgtattctggaatatctgttacagggagatattccaaagaagatggatacccaccatgaataaacgcaagtttcatgcctctgtagttaacaatgagaacaacaggtaaatcttctgtcatcattgctaaggctgtagctccttcttcaccacattcttcaaagaccgtatatcctccattttgataccaacactcgtagtagctacgatctccttccagcatacctttaatcatcatgtcttcatgattgccacgaatagcgtagcgattgtgtttacgagtaaattctaaaacacaacgaaagttttgctttccacggtcagtaagatctcctagagatacaaccacatctgtatctcggatacctaactttgcctttcctttttcatacaaattataacaaccgtgtagatctccaattataaaaagatcttgatcgcttttaacagtaatttctctgtgtatgatcacttatcctcctcaaaatctaagaaaataaaaatattcacctttccttcaatctcttgttctaaaacaagatcggcaaattctgcataagctttctcttcaactttttcaatatgttctgcggcatctttaaaaggcgtatccccatccacctttactaataagaaaagagatcgcatttcgacgtttttactgttacgaggaaggaaatctacagcttcaacaattctccaacccaaatagccaggggttttatgaatctcccctaaatacttttctaagattttacgaccctcgtcgataagggcttgttctgtagtaatttccattccttcctcctcaaattattaacgaaaccgcatgactaaatcttggttcagatataacctctgctacagtcacatatgtatcgtgcagccaaaaagattctactctacaaacacaaataccgttgataatgaaatctacacaggctttattattttcgcacacttgttgactataaacaacccctaaagagtcataaagtgatctcactgttgctaccatttcatctgtttcgtcttcctgtgaaacaaagaaaacgaatacagacaagttattagcgaaagtattgctattctctacttcaaccgacttacaaggtaaaaaggagtaatatttaccgttaggtatcaatttcgcctcaacctggttaagtatgctttgagatggttttgttacataaaaaagattttcagttgggttttcaacattactccttactatgcaacgagtggggttcgaaggatcaaaaacatgatcgaaatcgacacacacaggtaagttaacaactttaaactttttgctaagaatgcttactgctgtaaaaatcaaaccagcatttattttgccagtgaaagttgaacgcataactactcctcggatcattctaccaaagagaattccgcctcttccaggtagattacagaccttgttgcatgatatttaacgctccagaaattaccttcgcgccgtaaaagtatctcattcacatcaagattgcttagaaaaaccatataacttaaagcttgttgacgcgttgagaattgtttctctaaaagttcttctccgctctgcataatccctccttaaaatactccctccgaaaagggagtataagtatatcacgtagttgttatgttgtcttcttggatattagaatccacttctgcaaacatatcttctgcactgtaattatttccagtccagcgtgataaaaggatagcaccaatctcttttgcatgagattcggactccgcataaacgttagtcccagtgtcaccttttttcttttcatgtgcataaatgcagtaataattgtaagccattaatcttcccagtcattgccctcggtagagtgaactaaagctcgcacgataccaccgtaatctactgcctgatttgcagcatgttcggcataaacttcaatggcttttttgaagaaaagagcagtagctgcttcaatattatccatttcgccatctacgtcagtagaaagtgaaaggttgaggctttcatctacttcatcaaaatcaatagccactgtcataattagtttacccatagttcacactccttaaacaaaataaaatggttgagagaggcccaaactattctttgggtcgtatacataccaagcgtatgctgtcttatctgttccacctgcaacaaacgaaggccgttctgaaaggactataaggtttgttggtggattcttttgatggaactctcgtcgtttctttgactccaagaagcccaaccgaagaagataaatacaaacatccgcctcttttaagctcttttccaagaactccattgctaacttaaatggaggatttgtgattataatgtcgggacgattttcccattcatgactaaaataatctttaccttcttcaagttcacaatattctgaaccttcaggaaaatggcgataaatcgcttcagcttcacctttgcaaggttctgcaaaaacccaaccttcttcctttagatttttgaaatctataacactaaacaaactattgattgctttttgcggtgtcggataataatcgctcgttgggcgatcataatctaatgccatctaaaatctcctcttttgtaatattatccaactctttaaaggatgaaatctcgtttaataaccctatttgatcagcctctagaggataagtgtttttatctgtttttctagacagaatatcttcaacaaacttatcaatagctaaagaagaatcataaaattttaaaagttggtaatccataggagatattttgtcatctcttagaaatatttctaacatgttttcaggagtatcgtggtttagtttatgttcaccaaaaatattaacttcgtaaacatctttgccaaaccaacgtttcttcttttcaacagtataggtttttgccaccaaaccatctaaacagtttcttgccctcttacatgtttgacggtaagagtggatagcgccttcaacaaacttagcaggaacttgtaacattattaatctcctatgtttaagaaatgcccccgaaggggcagtttgttaaatagcggttccttcgaaatccgccacatttacgagattaatattttcagatttagaagtcaagttgttttctgcaacagatttttcttcagtatccgcctcgttacctgccacgttacgaggttcttcttcaccgtagggattaccgaatttcaaaagattgatcaattcttctttggagaagttttctaaatcatcgtctgttaattcaataatctcgtcttgttcttcaataaatgtttcaccaccagaaaaagcatctcgctttttagctacttccatagcttgttctggtgttgcccctgcgtcaagagcagctaaagcaaagtctgacccacttcctactgcataatattcttcatcaatcggatatgcacgtgttgggttgttaccttcgtgcaggaaaatacgtccgtctggatgaacaacaagtgcaataaactcttcatcttctttatctggatcagagtgaatcatcaaaccagggacagcatcacgtgctgcttcgcactgtagattttgttcaaaccattgaaagaaagaaagcacggaggtcagacgaccagcaccacctacaaggtaatctccaatttttcggacctttttgaaattaatagaatctacacgtccaccaaaagttaccttaccgtcactcaaaatcttatttttggttgcaataattgtcgtcactattcttcctcctctgttaatgttttaagaaccgctttcccgccattcacatatttgcagatgtattctatcgcacgtagtgtctctttgtcaacaaaaatttgatcagacgttgcgagcgggttattaagaagatcactacaatcacgaacaagcagtgctttcttattaaacaaattacttaagaacagtaacttcgcctcttcttctgttatgtgcagaaggctaggatcgtagccagctattcctattatacaatcaaacaagctttctttactatcagaaagttcttgaaaatggtttaaaagccaatcttctcctagacaccaacatttaaacatttccagtttatctcggagggtcatattctctaaagtaagagcaatctctttttcaatatggtttacacaaatttgacgaaattcgttaggttttacgagtcccgtttgatagcactcatctataccgcttcttccgatagctattgttgctacacccatcaatcctccttataaatggcttccctgccatgttattaaataaacacttcagtaatcagtttagacaaacgtccacgtttattatcgtccgttgtcagttcaacgtatccaataaaatctacaattggctcacgaacaccttcttcattttctggatataaaagttccaaaatttgatgcagaccattgctacgttttttaattgcatatgtctggcgaacatcgcctaatacaataacatgcgtattaatacctgcacgttcaataagaagtttaagtgtttctgttgacataagttgtgcttcgtcaataatgacgattgtattatccagggtggcccccaacaaatagttaggaatattcaattcgatcttacctgatccaatatcgttttccaatttgttggctgtcatgaattgctggaaaatacgttttgtagattcatagtgtgctgctagtttatctgttttatccccagacaagaaaccaatctggtcatctccgacttcagtagggttcttgataaaaagtagtttacggaagtctcctgaacgaagcatctgcaaagctttccataaagcaacagaggttttaccagtccctgccggagcatttacaacagtcagatcattccaaatcatgctttgaacaatcttattttggtccccttcaggcataaattcatctaaacggtaatcgtcattacctaccgcttttgctgcataacggctttcaatctttgctgaattagccagtttctgccgttgtgttttagctgcggttttatttcccatagtagcactccttttagaaggggccgaagcccctttattagttgtaagcatctaaagttccagaagtcagaactttaattactcgttcagcacggtttggcgtctggttataccatcggcttttacgcatgtttttacctgcttgagtataatatgcattgctgattaaagtcaagctattttgaaacccttcagcaccttttaaccccaactggaaaaccatgttgattattcccaatttacgagtatcactcaccttatcatagattggtgataagatagtactgttttttatgtctctcttcacttttgcaacatcgtcagcaaagatttgacgggcttctttttctgtgataactccattagtcttacgaccaagaagattatctaagatttgaatagcctttgctttatcttttattttagtcagaaggtgtcctatgccgactgtccaataaccaagatggtcttgataaacagtaagcttcagtccttcatcgactcgtagcatatcaaactcatctactactttagccatttacttcctattcgtcgtctcctactccgtgatccaactcgttaaacaacagatgttctggagaagtttcacgttttggtttcgttttctttatgttggacttcagctcatttgccaaagcacgagaaaagatcttacgtttctgtttacttttcataattgttactccgcaatttgagccatgagatcacgcagttcggtaaaaccgcctacgtatgttacctccccgttcacttcagacagaatttgtggaaatgtgcgtggaggaactccggtaagatcaacaactgttttagtcattgattctaaatcatagtcttggtcaagacttaaatattcaaactgtttattgcgcatagtcaatagttgttttgacatttcacaaaattgacagttaggtttaccaaaaattacaaattccattacctctccttattaagtaatactgctaaagactgttcaatacctttatttaaatctgattttgtaagatagtgactggttactagttgtgacttcaccggacgtgctgctggagcattataggttgaagctgataccgccgatatcttaacaggttctggcatctgtgtcaagatcttttccgcaaactccgcccaagaaataagatggcttcctgcaaaatggtaagtcttaacagaccttgaccaacctgtttttaatacttcaaaaatagcttctgctaaatctggagcatatgttggacaagagaactgatcagcaacaataataaaatcacgttgtccatcattatagcgagacaacatggtttttagaaagttatttccaaattcactatatacagacgctgttcgaataatatatgcgttcgggttaactcctcgcaccattttttcaccgagttctttcgtatacccataattgtttatcgggttaggtgtagtgtcttcaaaaagaggttgagaagaattaaaaatatagtctgtggaaatatgcacaaaatcaattttaagtttgctgcacactgccgcaatatttgcagggccataggcattaacagccaaagcagtagcaaagtcatgttctgctttatctacagccgtataagcagcgcaattaataacaccatctacataatcttcaataatagcgtttcgcacagcttcaaaatttgtaatatctacacgttctttaggataaattaaagacgcatttgaaggagccactttacgtaaagcttgtcccagttgtccattaccacccaataccagatatgttagcatacaccctcgctacgtagctgttgaaaagacttagccattgcatcttttgttgataagataggtttaaaatcttcgtcaaaaatcatatcgaagccccaatcaatccctatatcaggatcatcccaacgtaaactttgttcgctggaagggtcgtatggagttgtgcatttgtattcgaagatagcatccatactcaacactataaaaccatgtgccaaaccaggtggaagccagaactgtgtatggtgtcgtgcacgaagaacaacaccgtcccaagaaccgtaagtaggactatctttacgtaagtctacagcgaaatccaatacttcaccacttacacaacgaacaagcttaccttgcggattatttgtttgaaagtgcattcctcgcaaaacaccgaagtttgatttagacatgttatcttgaacgaaagtttgtctaccaatgatatcttcgtatttttgttcattatatgtttctaaaaagaaaccacggtcatctttataaacgtctggtttgataattaccgcaccttcaatttttgttttttctactttcattttccctccgctaatttgagtaggtattgcccgtactctgttttcttcagtgagtttccatggtagaccaaagtctctaaagaaatccacccttttttgaaagcaatttcttccaggcacgcaatcttcaatccttgacagttctcaatagtctgcacgaattgaccagcttccatcagactggcgtgtgttcctgtgtcaagccaagtaaatcctcgtccgagaacttctacttgtaacttcctgtcttcgaggtagctgcgattgatatcggtgatctccagttctccacgcgcggaaggggttacttctagtgcgcgttgaacaacagaattatcatagaaatacaaacctgtgacagcataatctgatttaggattttcaggtttctcttcaatagaaatagcttgacgattactcccaaattcaaccacgccgaatcgttcaggatctttcaccaaatacccgaagatacaagctccgccccaaacatctaccatctcactggcgttaatcagtagtttaccaaagctttgtccgaagaataggttgtcacctaaaataagagcaacagagtcttctccgataaaatctttaccaatgatgaaagcctccgcaagacctcgtggctcggattggattgcgtaagtgagttttatcccaaacatagacccatctccgagaagatacttaaagtcttcctgatcgcctggtgtggtgatgattaagatatctttaatgtcagccaacatcaataccgataaagggtagtagatcatgggtttgtcatacacagggagcaattgcttgctcacactgcgtgttaccggatgaaggcgggttccacttcctcccgccaaaataatacctttcataaccctccttaaatcttctcactccaccattgagggttgtttaagtaccattcaatcgttgagtagagatcttgttcaaatgtagagtttgcactccaacccagttcagactctattttagaaggattgatttcataacgcaagtcatgtcctttacgatcttcaacaaaagttatcaagttggaagaaggataggttcctgcttctggatgtacagcatccatgtagtcacaaaccatatagatgatctccatattggttttgggattacgtgttccaatattatacgtttgacctggttctccacctgttgccacttgaagaatagctcgcgcatgatcctcaacaaaaagccagtctcgcacctgatcgcctttaccatacaccggaatctctttattcgtcaagatacttgtgatgatttttgggatcagcttttctggatgttgataaggtccaaagttattggagcagttggttatcacaacaggtaaaccgtaggtacggtaccaagctttcacaagatggtcagatgctgccttagacgcactgtacgggcttgaaggggcataagctgtctcttcggtaaagggaacgccagagtctgccatatcgccgtacacttcgtctgtggagacatgtacgaacatcttaagtttattttttgggaggagccttgcagcttccaataaattgtatgtaccaataatattggagtcgatgaaaactcgtggattcttgatagaattatccacatgactctctgccgctaagtgaatgatgaaatcgggattgcactctactactaaacttttgacctgggtttcgtttgccaaatctgttatgcttagtttaacgtgagtgatatcgcctacattctcaatatctgctgcatagcccatcttatcaacgacaaaaacttcgttattgggatcttgacaaagagagcgcaccacggcactcccaataaaaccaagaccacctgttaccagatagcgcatcagttctccttaccagacatgttgagaaataatagtttccgttttaatgttatatttttcaagtagctttgcataggcttcttttgcattctcattcaattgctcaagatctacagctatgcttccttctccgccttctaaatcaaggccatatatgcaataagactcatccgcatcgtagaaaggagagatgcggcttaagtcaagaccttcttgtaagaaccagttaaaatctccgtcaaattcttcttcaattctaggatcttctcctacagcctcttcccacttattaaaaggtgcaccctgtaacatacgccattcgatatcaatacccatttttcatctcctcctcttcttgagcagctttaataattgcttcataaatatcgtaagcaatgcctccacaacatctagcttcgaaagctattgcttctgcaatgtgatctgttaattctcgtggaatgcgaacatactctttttcactctccatcttctacctccaacccttctttttcaaagactactactcgtccctcaccatgacaattcaggcaaggaaatgttaccataatttccacttccatctgtcccgtcccaccgcacacaggacaaaaaataagtttttcagccactattcctccttaattatttcaaatttggcaacaccatttacaataatatgaccacaagacataactcctagccaaggatcgccgtttttcttcaggcgtttaccgaatacatcacaaaaaccattcttcatttcagaggcttcataagaagcccctttatcaaaaacgtctttgaatgtgtcgattataccaacacatttcaaaatcattcgaagtcaagctcctcatcatcagagagatctttgttagctgaattcaatttgtaattagttaactgaatctcttgggctgctgactgaatcaaatcaggattcaaccatttttccatccaagctaaaggactatgtttaggtgctttaaacttggctttcattttcaatcgacgataaataggagcagcattgaaataaacccactgtttagacaattcggcgttaagacctacaataaaacgaccttcactaaacaggtagtcacaccactgttcctcttgttcaacaacagtgtcgaggatcaaagtcaactcttcaatattatcttcgtaaattttacgccaaattgggtcatgcatcaatgcatcaattacagcatagtccatcttaacatgcaagatttcatctagcataattttctggatcagtttacaagccccaacaaacagttgttgttctgccatagcaaaagtagcagagaaggaagatataaactgaataccttctaatccaatcagggctaccatccctttaagaatcagcaagcgaagttcatcgttagcttcaatcaatcctagagcatacttatgaccagcttcttccaactgacccatgatatcagcaatgatacccatacgattgaaaattttatcattaatcataatctgattgatgacttcaattggatctggagtacattgacggattatttcagaatacgttaacgcatggagaacttccatttcactctgcttcatcatcatagcacaggcttcattgttactcaagaatggagagaacaaagtgatgattgattttgcaagagaatcattttcccattggaacgataagtttttaatcataacatcatagttgtttttagaacaagctacgaaatctttacgtgtctgatccagattaacttcattctcatcccaatcttgtgctttttgaagtttgtagagtttatgcatttctggataagttacgttaacagaatcaaaaatccctaattgttcccctaaaaatactggatattttcctgttttgtaaacttcgttatgtaaattaattgctgccatttaaatcctccactatttcacaaaaaccttttaagtttaaaatatcatgttcctcaacaccattagtccggtagaaaccttctaatgcttgccatacgcttctaccgagtataacagtcactgtttcttcacttcttgcccttgttattgcgtaagccgtagcttctggataaaaagattcccaaatctggatattagctatttgaagtccgccgagataatggtgacaccaaacaagggtaaaatcttcagggggaatcaacaaaggcttaaacccaggacggtagattggggttactccaggtaaaactataagtgtgctcataatctctcctcaataaaaaaggggccgaagcccctgtattgttacatcttgcaagcttcacaaccaccatcagaatcttcttgtgctaaagaatctgctgattttgttctactattaaggtaatacaatgacttaccacccagtctagcaaagttcaaaataaatttcatctcttctttaactgataaacgtccccctaccaatttagaataatccaaccaagaatcacaagaaattccttggtctgtaaacttggtaaagataccatacatttctgcaaggtctttagccggagtatcccaggcggattggtagaacattttcagtttttcgtagtctggaacaataaataatacgctacctttctgactttgtttatacataatagtatcacgaacagggtacagagagttagtagtattgcttaccaaactgctggactcattaggtgcaatagcagccaagacactgttacggataccaccttgttcaatgatttcagcacgtaagccttcccaatccattttaagatcaaaattaccgatactatctactgttttagcataagtgtcaattggtagccaaccttgaggccatttggtcttatcgatccactccgcattacctttttccttagccagacgcagagaggcttttgccaaccaaaagtaatgacgttctgcaagttcatgcattaattttttagcataagcatctgaataatttacaaaattacttgccaagtaatgcgctaagtttgtaatgcctacgccaatagatctacgtgctttagcagttatttcgttatgtttaaatggataatccattgtttcaataacgttgtcaattgtcaatacagtgtagtatgcaacatcctcatattcttcaggcaagacacgaccagcaacaatagaagataagaaacataaagccaactcttgatcttctgtattctcaccagtaaagagatccggcatactatggaaagctttagttggtaagaagatctcttgacacaggtttgattgatacaccgtatccaggaaaggtgtatggttgttaacgttgtcagcaaagaacatgtaaatacgtcctgtttctgcacgttgaacaataatctctgtcagaagatcacgagccttaacaaattttttcttaatgcgacgacggcttactttgtcataaactgcatcaaactcttcttcacttttatacaaagcttcataaagttcaggagcatcatcacaactaactaacatccaatcttcgttttttgctgctcgacgcaagaacgaacggttaacaacaatagaataatccagtttgtctactcgtttatctataggtgttgttggattcttcagtcgaatcagatcgtcgaaatctggttcaagtatagtaaaggtaactgtagcactacctccacggcttgcttgcttcgaagctccaacactatcttccatccatttcagatacggaagaagaccaccatgaataatacgattattcttaacaccttgacctgtggcacgagtttgaagattaacaccaatacctgcgttattcaacgtatactcatgagctaagtaattagcaatagctaaagattctgccgtatcgtctgcacggaataaacaacaagacgcacttcctttgattggagttcgtagagttgtcagatatggtgatggcagattaatcttaagatcactaacataagtataaagttttttaatatcttctatacggcgttcttttggttggatctccataaccttcattgcaataccaatgaaaagaaactgtggcgactcatgtactacatcgttcaccgcatctcgaataagatatttatctaccatttggcgtaaaacagaataaccataagttaggtttttattatgttttacaatcttaccgatttctttgatctcttcatcagtataatccattttagcccaatgtccacgttctaccatatcatgataaaaggtattcagtgaagggatactgtggtatcccccatgagcctgtttgtaaatcatacccagaagaagccttcctgccatatcactgtaagcttgtgttttcttgtcaatacacgctgcaatcattgctttatgcagatcacgtgtagacacaccgtcataacaccgcttcacagcttctaattcaatttcagaccagtttagtttacctgctgcaaattcagaccacttgcgaagtttttctggattaaactcctctgtcttaccgttagatttagttacaaaacgaatcaacttctcctccctattattaatgcatattcaaaacatctacatcataaccgaacttcatttcattaaaaagtccattagcatatagaaaaccttcaaaatgagttatgtcatcaaacccttttgcttttgctcgacggtctgcttcttgtcttttaggagataaacgttttgaagtgtctagaattacagttacattacaaccaacagtttcatcaaaatagacttcgatttcacagccttcatatttattatcagtcattgtccctctcattgattagtatcatctgctttcgcaggatcataagagttaccgaaatcatccatcttaatatgtgacgcaccccaacctgtaaattcttcatcaccaaaatgaaaaatatcattttcttggtagattcgtttaaaaccacaattaggtgaaacagggaaagtgaaaagcgttgtatttgcaaacactactcgcttatcgttattgcttcggatattcacattacgctcaacagaatagtgtgaatcttcagccatacccagcattacaagcgacgctctaataacagcattttgtttctcgtgtgggatattgccattgtgtttatttgattctagtttccagataggggtagacattacagtagacatgcttacggtagcccaagttgtagtatttactaatgacatattttctccttcattttgaatgggaggactcacctcctcccagtattgtgctatattatactaaaactaatactaaagtcaataactatttaaacagatcaccatttagtatgatttgttaaaagttgacgatgttgaatccagcctttgaaattgccagaccaaaacttaccattacgatctacatgggtaatacctggttcccaagagttaaaatcccaaggagcattgataaacaaatcttcaaaacagttctctccgtattgttcgcatgtttcttgcattggggtggcttgatgttcaaacggagaagcatgaaccttgcgcccagttagcaaacgaccatagatatctaaagctttatctttagttgcattcaaacgacgatagctaacctgtgcacaacacgaagctgaaatagctttggcttcttccaaagtaaggacaacaacttctccagattcatcttgaacatagtatccaccaaaaacaaaatgatcgtcaccttctgtgccaatattatcatagaaatggtctacataaggtgtatgccattgccctggtttcagcacttctggtgtagattcttcatactctttgtgcatctctttagccaaagcctcgatagtaggatcggcttctttgtcatcacgtagccaccagaaattttcatattctgttgctgtcagaactgttttaattcgttggaaaggttccagaagacggtttgcaacttgtttgtggtaccctgccaaagagaattcttctgcaaaacgtgctgcactaagcgcggcaagatcccaccactcttgagcagtataacctgcatcaataagagcgtcatgatcaacacctttatcctgcataccaggttggttagccccaaaacgataaggacgagcaggttgatttcgcaccatttcaatcagtgttttaacaggtatagcacggctagaagcagcattacgactgaacaggcggtgagtcatcaattctgaatgaataatacgtggatattctagttcaaaagttacaatctcttttccgtcttcagtgatggaatgcgcaataatactagccgaaatctgttttgtcattttttctccttagtttttaaaattgttcaaagtgttaaaaacatccaaacatgttagccactgatcttctaaacctgtgatcacaacatttggttttttctttagttcttctagatggttatctttataaggcgtattaaaatatattttaaccacttcatctggaaaatatagtaggttatcagccctgtcatctattgctatatcacaaggcaataagtatttttctttcgtagcaaaaaagccgttaccagatcctttgctaaaatcaatcgtatctaacgttcttaaaacatgcttatgtttagaacttaagtgaccaccttttgtcacacttgcgatcaaaagattgctacctttccttgaaacatactttaagaaatctggcatacctggaacaaaacccattgtatcatagagatgaggattatccagaaatccgtaaggatctatattgaactcctccctgaaaccaggaaagtagttggtaagatcatagtctgcattttttgtgaatgtgtctatcttaacaccaagtccactaatcttattcaaccattctaaccaagcaacatctaatggagccacaactaaatcccaatcacatactatctgcataaaacctcctctctcttttagtatagttatcttatactaactttcaatttcctgcaataggattttgactatttgtttgcggcgtttcgctactgtgctttcaggttctattttacgcttcttcaaccaagctttatctttcttagctctacacaaagctattgcttctttttcagctttcgcttcttcaaaagatatgccttgcttgtctgcataagcaagaatagagttgcacaatttacaaaccattcgcaaatcttcttctttcacatagattaaacggaaaacaaaaagaggaatatcatcaaaacattgaagttgttttgctgcgtgaatatgatccacttggaagtctttcattcctcctctatgtccacatatttcgcactcacaattccaaacttgttttggttttccagttttcttgtctatcatcacattgccgtctttatctacgcgatcaactttaaaacgccttgcattgataaccttaattttattagggtgtctcatccatgcttttctaaaacatcctctaagataagtataaaattccgcttgtgttttccagggtgttccttcaccccacattatttttggttcacctgccaatattgctcacctttttagctgtatattcccctggtgggatattgtgtttaaaaaacaaaaggcggtctaaccccgccttgcacattgtttctggaatagtcaaagttagtaaaagtttatcaccttttcggttgaatattttataaacttctcctgctccatattgtttagtattgctcgccactaatacgttccttaagttgtttaatagcttcgattgcatctacataagaagagttatacatgtgtttcagtgctactcgtactaaaggatcttttgtgaagaaatcaataagaagcatagcttgatcatgtttagctgcatttgtcatagatggataattttcacgaaccatatacgtgttattttgcataagggttctttctagttcgatacaatgaatagctttatctaggttaatctgacgttcacctttaatacgtgttgcgtattttgccaatttgcaaaaacaaggtgtgccaccaaccaaataagctagttcaataggttgcattgccatttttgtgtagtgatcaccgtcaacctgattatcaaaagcattagacataattttcctcctgaattcctactgcgccttcttctgggtaatctgtataataagctaccctaccttgatagataacatcaccatcatcattgtagattgctgtatcttcttgaattgttattttaacgtcaagtaaatctgggtctttttcgatggtatagtttaaacctaacatttcaaacagttcgaaaatttcgttacctgttaatgtaatgctcatatttcctccttttattgtggttagcagagtatacactaatatcaaatttttgtcaataaaaaagggagcaataagctccctgattattagattccaataatagttgctgctcgtttatctttggatctggtgtttgctctactacgtgacaaacctccacaagattcacaacgaatgatatcgaaagaacttaccgcagtgtggtattgcttaccagtaacaacgtgaacatgatcactgccgcaacgagaacaacggactttctcatctgggtaataagcggataagttaggatgctgtggaatccacggaaggattttcatatacaaatcacggagtgaaacaacatcgccatcattgtaaatctgcatacgttcaaaagcatcacgatcaccttcacaacatgctttccataaagggaacccctcgttatccagtttttcactttctgtttcaaaatacgctcccatttctttaagagagttggaaggaagtgcaaattgtttcttagctgccttcaatgtatcaacaactacataattagaaggaggagccatatcgtgatatgcaaatcgttggttaatatatgcacggtcaaacttatacccgttgtgtgccacaactacatctgcctcattcagaaggttccaaagatcttggcaaagctcccaatcatctgtatgatcaatatcaaaaagaggataagaagacaagttcttaccttccacttcaccagtatacaagtcagcagaagagtaggatagcaaataacctctgcgaattacctggtctggagaaatgaaggctttgaatcgacggaaagtatatgcaatctctggtgcagtttcaacatcaataattttaataactggttgtttctttttaacgggttcttgtttacttccactgaaacgtgcaaggaaatcatttactgtgctttttcttgttgggctacctaaaacaattgctgcaatattacgagaagacataccctctgcactcatactaaggatatctgctttctgctcttctgttaatctgctcactctgcctcctgttgtgagatgtatgactgaagcatactctcaaatgttgtatcgtcattatcccagcgtttcatgtataccaactggaaaattgtttctatccattcatctgttgtcatatggacttcttctccatcccaagaagtaaaattaacaccatctgggaaccatgagtagtaagtatctttaactgtttggaaaagttctgcttgagttttacaagcagaaagaagattaaaacaagtaatatctccgaacttaatatcaaaatcttgataaggtcggatactatctgttttatctcccattagcatctgatatgctaaccagtaactgccccaacctttaacttctttctttttacctttatctacgatccatatgtcgccaatagactcgtcaataagaattatatctggattcttaaatactccatcctctttgtagaaattaaaaaggatactaggagtatgtaaactatctttatctatagacactacaatataagaaaatttacccgtccttttataatctttataaccttggaaaccatacttctctaactcatcgtcagcctctattacagtaacaacatcaccattgtggaactccacaagataatctttggtttctgaaagctgaagtggtttgatatctaatcgttcagacttatattctacaggcattttgaaggcgtgtctgaaagtttttcctacgccaataactccgcaatatttttctaaacgtagatgttttagaatacctaagacttttgttttagctgcttggaaggtgtgtccgatatcttctggcgggtattgcttatcaataatttcgaactcttcctttgtgaagggacgtttgtttttggaggctctttctgcatttgtatctcctagccaacctccaattttagtcttacttttaccccaaaactctgtcttatttttaaattccttttgagcacctgaagggatgtgcttcgcaatgattgttcttttctctaatgcagacgctgcctggaaagcgatctgatcataatcaattgcagctattgtctcttcgttgacatataaatgaagatcttcaggtttaattaaaatataaccgctaatatttccccctaattattcatcgtcatcctctgttgagaatgttttagtatacggacattgacgacttttcgggattgctataacttcatcttggttagcgttagaatagtagcaatattttgtgttgccattaacttcagaatcagacaagattaaagtaatttgacctgctgctactgtgaaactaaaagctaaaagaacgactgtcagaatctttttcataacgcctcctaaaaagcctacctcattaagtaggtaggcataatatcataactaatcccgcaagtcaagaacttatttaaggattgttgctttggttaaatcttccatcagacctcgaatctcattgaagcacagaaggactgaagcttcaatactaccttcttcgtctgcaaaatatttcggaaaacgtagtttagaaagtttaaactctttatccactacaaaatctacaacaccgtcatattcaagaccgattgcaacaacatctttaccatcttcttttagttctacagctttagactcgtatagagattctttactccaaacaacaacgccctcgctatcctccattttgatataatttccgagagtaatacgatctgcttcgtgattctccagcaattcaccaaaaccttttacaatagcttcttcgtgcacactaaaacctaccgaagggaaagtccccaggacggaacggaggaaagaagtaatctcttctgcaacctttttacttccattaagaacataaagaagattcgtagttttatccaagacaacatagttaaagaaatcttcaggttctgtttcaggcaatagtgcaaattcaatatcttctttcattgctttgactacttctttatcgacataaaactctttaccttcgctctccatgtcctgacgcatttcttctagacgttcattcagaatacgtttaactttctttttatctaccttcttcacagattgacctacattaagcagttcaagatctgaaaactcttttacaaatttagagtcatcttcgaaacgaacaagaccgatagtgtgtgactgggagccttctgctgttacgaattccagaggaatatctgtaatgctgttaagggatgctacagaagcattgtcaccaacaaccataggcagagcggatttaaaagattttacaaacatgtttcctcctatttaatacatctcacattaccgcccataaagggcggcttacaacattacttattaataatacctgcaatattaggtttgacaaaggtcgatggtttcatgatcttacctttatcatcaaagaacacatacactttctgtttttcattataaacagcatgaacaccagtgtatgccccttctggacgattggcatttcgttcttcaattgcagcgcattcttgtgcaatggctgaatcgatatccgaagttttccaagttttcagcaactgttgtttagttggatacttggaatcattacttttcaatacctctttaataactttcttttctgggtattttgaacggattagagtgtcacgagacatacgcataataccagcagccattagtgccatttgaactggctctgtaaatgtttgttccaaagcatcaaaatcagtatacacagttggagtaaaaacatcgcctacagcatagtccaagaaattcatcgtatgttcttcaccaaagaacatgtaggtcagataactggatactacaaaaatatccgctgctgcatccaagagttctacatgatcgtttactttcgcggctgtttcatactctttaagctcttcacgaacgaatccgatttgggacataaatagctcttgagtgaattcaggttgttcaccacctcgtgctttagcattccaatcaatcacgtgcttcgctgcatttttgaaaaattcagtatcgaacttaatatctttaaaaaaattctcgatcattataactccttatttaaaatagctttctagaaagttgctaatatttactacagtctcacccatgtaaattcctgcgaaaccgaaaacaagcatacgtggaatattgaaataccatttatccgctggaaaagatgccagaattacaatagcaattgctatcagcatcataagaattgttgctaaaattatcataaaaatgcctccaggtattttacacaatgataagctaagaacatttttccaccttattctgctggttcccaagtgcctgggatcatttctcgaatacgaacaccaacaggttttgttggaataccttcatctgaaaattcttcatactctatttcaacgaactgattaatcaaggtagaagcattctctgctttacgataattggtagtctcatgagcatctttacgcattaagaattcgactactttactattttccatctcacctgtcaacactccatcaccatttttatcactttttgaatttattactttaacttcaagcgtatgacgaggcttacgtttaataacatcataagaacgtttatcaaattcgtaaactccgtgagcattacgatatactacaccttcagctttctcaagtaaagctttttcatagaaagcatcaaactgttcttggttttcaatatactctgtatgaactacacaaataagctcatcaagaccataatcctccactactgccttaagagcagtaagaacatcaacacgtttttcaaacggtagatctggaactggaatatcgtatacgtaatagttcagcaaaggtgtatttgcattatgcttcttccaggcactgttaatttgttgtagactaaggacacctaacccagcaaacacttcaccatcaagaggatgaccaacaacttcactaataaagtttggaatacctttccaatgaggtggcaggttgtacacttccccagcttttgataaacactctcctttcatgttaatcatagaacgtaacccgttcagtttgtattgtgcataaccagggaacacaaccctttcaggataatctttataatcctggcatttcattggtgtggaaggaacatggttttcagcttcttcttttgttttataatagccattctttaactgttttgtccatttggcaaaagcttcaagttcagcttgttcttccggtgttgtttcattggaacgaccaatgttttttgcttctgctgtataagatttttctgtgatttttccacctacccttccatgagctacagtaacaactgcaccatctgtatacactgtccactgtttaagttttccttttgaatctttaccatacagcgtttgatttgtttgttgcattagtcctcccatttaaaaactgaaattttcaatctgttacacacttcatccaaatctgcgtcgagtaacgttgtagatgttgccaacatataatcaatgcttgtgaaaccttgccctttggcatagtcaagcatatcttcatacatatcttcaagatcaccgtcatcaaaagtagctagaaaatcctcgtccccgctacgaacataaaatgcagtactcattcatcttcatcccaagattcaaaagcacaacaatcatcggtttctataataccaacacgtccacaggtattgcaagtgattttatcaccgtagaataaataatttttatcaccttctgtgtttacagttatgtcattactaccacaaggacaagtcagccaatcaacaacgatatcttttttcataattcctccttaagcattcagttcgctgttgagttcatatatctcttcttgaagagaatcgatctcttcctccaaacgggagatctcttcttttagatataccatttcggattctttctcttctaactcattttcaaattttactttattcgcctcattttcataatgcagttcagcgtaatcatcacgcatttgttcaataagatgaatcagagataagatatagttatccccagtttcatcacgccactcttcaccgtgacggagaacggtaattcgtccagtatcttcgtctaaaattgtctcatatttacgatcatctgtataaatttgcattatctctccttattgaagtttaagtgaaccacgaagacgtttctcttgttgatcacgaatatgttgtggaacctcgtgaattgaatcgttaccgtgcctattttcaacaactaaagagataacttgataaccaaactcttcagcaagagttaaataaggtttaagttctttctctgtggttgaagtgttagaaacaataatctttttaagatcagatttcatagcatcacgaacaatactctgacaccacgcgtgtgctttacctacgttttctggcttccaatcgtaaacaccactttctgtgtaatgatattgatctgcctcacagataggccaataaccttcagaaataatttctgctaccgtagatttaccagcacctgaaacgccacgtaaaatgataagttgtttcatttatcctccaatgaagttttcgattttttcacgtcgctcttgctgatttaaagcagcccattgagtcttcgtaaaattatttcgaatccattctaacaaagcgtaatattcttcgtcaacaatttgtttggcattttttggattatcccaaatcagatcccactttttatctccaccacgcataagaaacttcttagtaagatagtgtggtgatttaatttttaaaagtaagttgaacggatagtttgtttcacgaactacaaacccttcgtgtttacaatgtttagacatttcaacaacatctgaaaacttaaccatcgaatgaacttcaggacgcttaaatttggtgacagaagcaattccatcaagagcaccttcaggtaacataaaacttgtcccatcaggattttgaattctggcaccaattaagtatgcacctggttcttcttcaacaatatgcggatcagaaggatcgcagatttcaaaaaggaaagttgcttttgcactctctgtccatttgatgaaatgttctatgtcatcacactctgaaacaatatgattctttgcaatacttgcaaaatctgattcaaggcttcctgttgtcgatacaataagttgacctttatatacacctacagaggccataaaaccatttactttacgaaccacatctacaagttcatccgctggtagatctgtgccattctcaaaacgattaaaaatcttagtgaaaggccaaataacaacattgtcatcagcatcaacaacgattccgcgacattctagaagacgagaatcaatgctccataagttatcccagaaaactttgttcttatacttaagaacagatagaccagaatactctccttctttatatgttttcttatgaactaaacctttttcaaccaaatcgtcgcaattaaatttagtcacattactctcctttgattattttgtgatggtctacagtcacgatatctcgtttactcatcatagaaattatctcatcaaaatgcaagatttttccgtgtgcatcccaacccacatctaacattttaccataagcttcatcagggaaagatccgtgggaatgcccgtgtagcatgattgatccacgaccttgtttattccaggaggccatagggtaatggcttaagacgaagaacagcttctgatatttcacttcgtcataatacaccacttcgccatactctgcaagcacttctcggtgtttactgtagtcatggttcccaacacagtaggtgatatctccttggagacgggaagcaattttacgggtatcttcttcagttccaaaacagaagtcgcccaaatgccacatcttaacaccaggggtagtagcgcatttgttccatgcttcgatcaaggcttctgtcatgtggtccatatcttcccacggacgatattcaggagcaaactctcgaatacgtttatgcataaaatgcaaatcacttgtaataaacattagtataatccctcgctaaataggtcacgatcatgaccattacgttcgtagtcaatctggtctgcgtgttttgcaataatgtatgcatcttcacgactccaccaattgtagtattgatcaataaaaccttgattgtttggaagacaatgcactttatcaagaacacctgcttctttcaatacattcaattgtgcagataatacaggatttgcatgtcgaacacaaggaataattaactcttcaccattattcaaaatatatttattcgcagcacagacgataacacgttgcgcataatgaccctcaccaatccaggtaagaggttggtaacaaatattgttttcaataccactcattgtttcctaatcctcctctcttaagttatcctcgataaaactagtatctggaagtaaaagatcattccttgtgtcgggccaatcctcttcttctcggtagataaagtaaccttcgtcctcttcttgttccgaccaaaccgaatgatgcatgttctctccttaatagtgcacacgaatcattttaataccataacgaagcattgattcttttgcaagcatgaatttatccccagcggcgggattagaagtatgcacgaaaatggtaggtgaaccaaagcaaggtttaccaaacgccagaagttcttccaggtacaggaaaacatcatatccatcttggtctgactccatacctaaatcattgtcaaaagaccactcggttactcttcgatacagtttagcaggatcattgagaaaagccatagcttcttgtgacgttttaaaccaaattgcatcttcctgtccatagtcggctgggttccgcatatcatctatccaaactttcatataacctcctctaagctggcatgattaaaaaagaactctccacttcaaaatgccaatcatctacaagccctgattcccaatccttctcttcatggaaagagcaaatccaacggtacatacctggcggtgtattctcaacatcttctggcaacccataatccaaagctgtcttaccgttctctgtaaaaccaggatggagattaggagctttcagtacagaaaccatgcctccaacatccacagctacgatccactctgtcatgtatgggctgtcatattgaggctcatcataacctacctcaacagcctctgtgcgtaagatgataataggctgctctgtgattggggctttgacaatatacccgtggtcctcaaaaagatcgataacctcgaactcatcgccgttttcgataccatagctcttattcaaagagataaacttcgggttatcatcgtaagctttagttactttaattttcatttttcctccttcactttaacctcaaattctacaggcttaccctcaatgtaaaaacactgatactctgccttatcatcctcatcacgaggccaagttaccaaagagttatagcaatcttctggtgctttgaagatggttttagtctccacagtaacactcccattaagtgttgccaataccacccagctacagggatcatagtgcctccactttccacgttttaccattatcaaccaaggtctttgctacagcatactccttcccattaacaaggaaataataaacgataaaagatttcccgattgttactgtcttagtaacctctacgcgtttaacaccttgcatgtatttcgccttaccggaataaagtaaaatcattttgcattcctcttattgttgataacatccatagcagtatatggtttattagtgccatgatactccagaatcattggagagccttcttgcactacttcaaaaataccataaacagaactttcagcaaataccatttgcttcgtgccttcatcgtttacaacgagagaaaacttcttgcctgtcccgttgaggatctcgtatttcttgccagcagtgaataatccagagtaccactcattatctgttgcttttacacacttcaggaaagtcttgatcatttctttttgctcctctttttagatttctcatacaaacctaacacagccgcttcttttgcacaagtaggaactgaagtcattcctcttcgttttgcttctggtagttgcaaagtccatattccccaccaataaatttggtctgccgtgagtggttcagccattggatctgcctcctgctcctcaagacgttgcaacgcttcttcaatcttctcgattggtgtgtcaaagacgaatgcctccgtatcaaatttatctttcttaggaactgatttggctactttgagaacctcgtttttcggtttcttagtaacgttctttggctttgataacttcttcggtgttttcgccacttactacctccatacgatctaaaaagtcattcacaaatctccagtaacgttgacctgttctaagatcttcatagataaccacaggatcaaacactttagatattccggcaggttttggaaattccactactgtatataaaccaccttttgctacacaagaataggttacgcctgtaattggatagttgctcatttctttacgtactccatgattggggtatggtcgccagtaagcgtaacacggctgtaggacacatcttgtgtcttcagtgtatcaatccactctaagaagtgttctttcgcttctgtgtagttctgtgtgcctttaacaacgtgtataccatctagagttacacggaataccatttgaataacgtctttcatttcttacctcctttgttgtcaaaataacttaccagaacatcgtgaaccacacacatggcaaaaatcagaacaattgttgtcaggactggattttcactaattagtgctatcatctttaaccacctccaattgcctttcgagtttgactttgtttgagaactgataatgacacaacttacattgcatgtcaacaatctgatcgtgatttaaccctacaattttaacttcctttgcaccatcccattccaaatactcaaagccatccaaatgattactcttgtacaacaagaatgctatctgctgccattcaatctgaatgtcatttaaatgatatgctgcacagaagatatcctcgtagtaaaagacgatcattgtcattgcttcgtccagcacaactacctcttgtcttgtaaatctcattctagcctcctaaacgcgtctctgacgcactttttatatataagatgataaatcaccttacttagtaagtaaacttgctctacgagcctcttatgaagcttatgtcatagattatactattgctacctgtttaagcaaggtttttgcacacagaaaataatttttaataaaactcttgacttttgttttcgaagtatgctaccctagaaatctattaacgagcgcagcgagttaaggtttttaggttgttgatgtagtactctgtactcaagtactgtactccgtactagattaataataaataattattagatctaacaaacaggtacagtgtatcagaactggtacgtacagatcaacttctatcaattaaaaaataaaataataaattattataaataatacttgatctatagattagtatgaagtacagtacggaacatcttaacaagaatggaggtgtgcaatgattagtgagaatccgtgcaaatggcatcatgtgcctattaaagattgtatgtcttgtaatccacgttctatttataacattgcatcttatgatgatgacaatgtgttagacgatgatgaaggctgggaggatttagattggactggttatgaaaccaaaaaggataaaattattcctagttgacttaagatatccttcgtgctaaactagaagtgaggagatgccgatcactccccatttggggttcgaaggatatatgcaaaatagtttttattttaggtgccgtgcttgtaataggcatttgacaaaccactccagacgtgataaaaatggagtcatcaaggaatcagacctctgttctatttgcacaggtttggcttttgatgatagtcccgaaagggtttatcagcatcaatgtataacagacgttctcgtgtcaaacttggtagaggacgaacaactaacagattaggaggaacaatgtctctattagaaaaacacgtgtttgaagatggtaacggcaatgcagtttttcttttccatccagaaaaatacacatctgaaaacaatggtacaacttctattgtaatcactaaagatgttaaagttattgatttcttggctctgatgcgagaaatggatcttgaaattaatacttttaacgcagaagctttggttgttgctcttctggaaaagaaagatagtgaagaagtagcagaatatgcttaaataactattgacaaacgtatccttcgtatgttaggatacgttcatcaagtgtggtaagagggtcgttgacttttgttaagatgggcttgcactgcggtagtgttagagactacttcttcagaggttagctaccaaagaggaaaaggaatagtctcggctcaagaacttttacgctgaaagttgggcttggtcttagagaatgtagcggttctctacaatcgtcagcgtctctgttaccacatttatggccctgtagctcaatgggagagctgtcggctcataaccgataggtagctggatcgaaaccagccagggccaccaacgtctttatggtgtaatggatagcacaggagtcttctaaactcttagtcaaggttcgattccttgtaaagacaccagaacattttaacatgaattagctcaagtgatttgaacccactactgatcatggtggcagagaatgaggcaagtatgtcagacattataaacaaaggccacggttatattagaagacataaatgctcgaagagcaccgttcgtggagaacgggggttggtggagtcaccattcatggtaaaatgttttaaaaaactattgacaacaagtattattttatgttagattataagtatggaagggcaaatcgacgtggcgacgaaaacggtcttgaaaaccgccgagctttaaagagccttgggagttcgactctccctccttccgccaggttaggtagattggtgaaatggtagccacgacagtttgctaaactgtagtcggaaacggcgtgtaggttcgagtcctacatctaccgccaagttctttttaatgtagcttactttagcagagtaaatcttcggcaagtggcggtaaccactttaccgataactcatagttagtggtgcgaacactggctattttaaaaagaatttaaatactagcatttaggtgagttaattccgtaggggtagcggggcagactgtaaatctgttatcattgcgattcgggtggttcgactccatcactcaccaccaaattaagatgagttggctgaatggtttaagcggcggactgttaatccgtgttcgaaagaacgatataggttcgaatcctatactcatcgccagaattatggacttgtagagttaaggtaaacccccagtcgccaagaggcttctggaattgcaggtatcgaatcctgccgagtcccagctttgctcctatagtataatggctattacaacggttttgtaatccgtggatctctgttcgattcagtgtgggagcaccaacacaacattaagagcactgtgattgatcgtcgtatcctgtgcacaaggtctgctcgaaagacagtgttcttagtattgtgttgatcacaaaaagagttacccgaaacttgaccggagtagggttggatgggcaaaagaagaagcggctctcccatcgacagcaacgaagaataatatttgactttggttttgtattattttaagttagcttaccgaacgtagggctagtcacccaaagggatactcgtcactgtcccacctattaaataactattgacattcgatagtaaaatgtagtatagtaaatatatacgaagcgttattagtgttagcggttcagcatcccgtccttccaagtcagtggcatcggttcgaatccgatataacgctccaaattatttaataaagggttgccagaaaactttctcttttactcatggttttctccttctctcacacctcttctggttgcccttcattaaatgatttattggtttgtagtgtagtccggtagcacacgacactttgactgtcgtaggtttggttcaaatccagacagaccagccatataacggaatttagctcagtttggtagagtgtacgctttgggagcgtattgtcgcaggttcgaatcctgcaattccgaccaattaaatatttcatgcgtcagacaaaaggttagtctgtatcagacgtgagatattcttttaaatgtttcgtagttcaatggtagaacccacgactgataatcgtgagacacaagttcgattcttgtcgaaacaaccagtttcccgttagacttacaggataagagttccacagcttattgtgatgctggttcgaatccagcacgggatacataatagcgggatagaggagtctggtcgtcctcgccagtttcatatgctggagatcattggttcaaatccaattcccgcctccaaatatcgcttgccagcggtatctttgaagaccttgcctggttccttctaagatggaggggtgcgactccttaacgcacaattataataaagcatttcaaattaacagtatttattagcctccttattggaggctttttgctatctattgaataaaacttgacttattattttttatatgttaagataaagtttaggaggattttatt

SEQ ID NO: 23 - DNA, 167861 bp, synthetic construct
  source 1..167861: mol_type = other DNA
aattttccttattaggccgcaagggccttcatagttttagcgatttgggaaacttcatcatcacttaaagagttgcgatatccgatgaagtcggaaacaatacggaatttcttggtaaactcagcaaccattttatcactgttttttgaagcattatttgataatacatcaaaaagattagttactgtccagatatcatgaccgatggtatcttttccaccattaaaatatacaccgcgcaatgaactaactatattagcgagtcgtgtatattcttcagaaacttcatctgtactgaagtacttcatcataaaatctagttcaggatacttgataattttatcaatatatcgttgagctgaacttgaataacctacgtacttatcataatctacatcatcaaaagcatctacatataaatcacgcagagtttcaaaaatacattggcactgaccgagttcttttacctttttctgcaaaagcggacgaataacataaaactcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagcaaatcaatctgcgattctacttctggattaataaacagaagacgctcattatgatgaatattcaaagtgttattaaattcactatcatctaacgctcgtgctaatccacgaacaatattaacacgatttttaatattatcaataacgatattaatttttgttgtattaataccaaacagacgataacttgatgcaacggctgaagtttcatgactttgcttaatgcgcttcagtcgaggatcaagatttacttcatacacaactcctgcattacataacttattgtcaggttcaaacatgctctgcatctttttatatgacagatttttagtcgtgaatttgactgaattactaatcatataatctcgagcagaatatcccatcttcatcaattcacgatatgtgtgacgaggagatgtagattctttaaatcgttttacatcttcattaaatgctttctcactgagttctttaactcgttcaataatatttttacgagtacgatcatctagtgaaagagcttcgcgtgatggagcaatatcaagcgaacccattggaaacttaatgtaattcacttcattacgaatgcttagccagttacggtctttaataacaccatcgataggataaacaataccgccatagatagcatataatccaccacgatcaggccagtatctttctggatttatgccgtaataatcatcaaaatccggaaaataatcaatttcgcggtcaagaccattaatgatagccaaatctttgaatggtcgcatgatataagaaacttcataagcaaagtttctaaagtctttttcttcaactggaactacgatttcaataccagttttatcatctggacccatttcttttacgaatgtaggtttaatctgtgggccatcaccatccatgtaagctacataaccacgaatttcacctttatgatacgaagtaatactaaacgtatcagtataactaaacggagatttagaacctaaaccaaatccgccaataaagtcattagattcagctttagatgaactgaagtatgaattatacaacccaggagaattatcatcaccctgaatatcaaaatcactcatacccggaccaaaatctcgacaaacaaatcgtgggtctaaacgtccaggaacttgaatgataaatttttcaggatttccattgagagcatgggcatcaatcatgttggtaatcaattcacggactactgcgcgaatcttgtttgtgtacaaatcagatgatagaattttaaatactttaggagatgctgtgatgctaaatgcttttgatttagaaccattaccaagaattgtttctttttcagtggtgataatcataatttcctcattaattcatattgcgtttaataacttcagcaacttctagtagttcatctttagttgcggtgtcggattgaattttatctctaatatccttaaagcggtttttaaactcttcagcttctcctatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactgggttttgaatcatctcacgatattcagatttttccaaagagccaagtcctttaatataacggatgctatgtttaggtagagcatctttggcactctcatattcagcgactgtataaaaccattcttgttttttaccgacctgagcgatgattacaggagttttgacgaagcgaattcttccttgctcaaacagttctggccaattactaaaaaatccaagcagagaaggataaatgcttcctagaccatcatggtcagcatcagtcataatagcaatattatgataattcaagttttcagctttttcaccgagaactaatccagtgattgcgcaaatatcaaacagttctttgtttttaagcatgtcagcatatgacataccccaactgttgagaactttaccacgtaatggataaccaccatgaagttctttattacgaacatcaataagatatccgatagcagaatcaccctcagtcaagaacaatgtagtatcagcatctttaccacaaagattcgctttgatatgtttatgaaccttagctttagatgcctttttagctgctttagtttctgctgctttttctgccgccaatttacgagccaaagcagcttcaataattggcatcagaattgcttcattattcaaaatagcacgtgaaatctttttagcatcaagctgaatatgactacggatttcaccaaatggagaagtcaaacgctctttagtttgagaatcaaatcgcatgtttttcatatcacgaacaaacataacgattgtcaaacattctttaacgcgtgctttagtcacatcaattttgaacttacgtttgatttgtggaataaggtcttcacaaatatcatccataacacagtcaatgtgatggccaccattcttagtatgaatgttattaacgtatgttaattgacgaaaaccatccggtgaacgaccaactgcaatagaacagttttcttgttcttgaacgatagcatgctcatcatattggcgtgcatatttcttaaaattgccctgaacctttttaccattaaaggtaaattgaatatcaggataaacaacagcaagtgtctggagacgatctaatgtaatgtcaagataaacttgagataattcattagtttcaaatgacataaaatctggaatgaaagtaacacgagttcctttccattttccaggaatagtttcccatgatttattttccatgccatttgaacaacgaactacaatattattttgaccatcgccagtttcaccgacaaacatcacagaaaaaatgttagttaaactagaaccaacaccattcataccaccggtgacgcgttctttatcatcaccaaagttaccacctgcttttggaatagtccacgcagcaactggaccaggaatttcttcaccagtaggtgttttaaccatcgcttgtggaataccgcgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacgaatagttgaatccttaaagaacagcccagaacatactgttccttctactttctgcccagtaggtccaatagcacgaaatccagtatgttggaaatcattttcagaacaaccgaaccagttatatccagtgatttcaatattagtaaaaccgcttgaagacaaaactttggttgcattatcagcatcagtacatcctactaaagacactgctaatactaatgccgcgatagaacgattaatatatttcataattttcacttaaatttaatggcttgaagaagactaataattctcaagcgacttccttcatctttaactgtaaaagaaagagggtcaccagatttcatagtgatagtgcattcaaaagcaaaaccttcgggaacttcttcgaagaagtcaaattcttcatcataaattagaacattactctgaaaactgtgaagaatttttccgtcatttccagatgctgtactaatcattgtaacattattacctttcatatcttcaacgataaattcgcttgtagatattacagcattaatagaaccattcctataaatagcagaaaatagatatttcttttcttcaccttcgcgaatgcgatatttcttaccgattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccatgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtaccatcttcagtgatttcacgaaatacaccgtaaattggttgtttatccccaaccttttcatacacataaaccgaagtcaagtgagtaaacttgatagtgtgttccttttgaactactaccaaatctggatcgaataatacatcttcaaattcatcattagtgcaattctgaacaattttacgtttcatcataatttcctcattaattattagaagagtatcagcgcacctttaacgaattatccattttattctccaagttgttttctgtatcagtagttgatattgatatagtaccataatcaactactgatgtatatagttttatgaaaaaattttaaactttatgcatagagagcattgctgtagtgtttaatccaactttcaggaatgactttatatgttcctaaaaataccacgttgtacaacttaacgccatcttctacccattgatcggtaatgtatccacacatagcgcgagtataaacagcctttccatcatctttgataaatttaaattcacaaggagcaatgaacttgatagcttgaccgagtttccacttaaagtctacacctacatgcgaagtatcaatcgtttcaattcctttagcaggaacagctttcaaaaacgcaggctcaagaaatttccatcgaacataaccaaactggggcttagacattccatctttagcaatgatacgtacttttacttcagaatcttcatctttaacaccgtgtttaagctgaatgcttacaacttcgaccaattttcctgctgctttagaacgggatttatcagatacacgagcaatttcaccaatattaataatcatagttatctctcacttgttaaaaagattttatactccacaggaccattatactctggtcccaagagtttgtaaactattaattcaaaatagctaccaccgcactacgaggtactacactaaaatctcctgcatggacaacgttcagaagctcaacaccatcttcaatccactggtctgttacccaaccacagataggattatcaaaaggacgacggatagacacagcagcacacaacaggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcatagtaggttccttaatttccagtggtttaacagggcatacataagtacttacaacgtcaaaatcaatcagtttagctgccggattcggtgtgtattcaggattataattaaatttcataattatctcatttcaataaaatctacaagttcagcatgggatttacggaacattacttgatgcccgccaacgataacttggtcatctggtacttcgtatacagcaagataaaatcctttcgaagctaattcttcacgctcttctcgtgtgaaccatctcatcatatcatattcgctagcgaaagcaaaatgataaagagctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacgtgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgatggagcatcttcaagacccatagcatatcgcaaagcgtacttcatcatcaggatgtctttcgcgcagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatgtgtcaagttcattctcagaaacaccattaagacgttgaatatcacgaatgagatcgactaaaattggaaaatcaaacgacattccacggcaccagccttgagatttccaaggatcgatattatgtgcattgatgtaatcattaaatttcgcaataccgtcgatagtgcttacatcttcatcggacggtgcaatattttttcgagcttcaggagactgatttttccaccattcgatagtgcttttagtaaaaagacgatgtcctttttggctttttaaatcaaatttgattttaatgccgcgtgaaactaattcatcaaatgtttcaactacttctgggttagggtcaaaagcaattacagctaaatcaataacagctgctttttcaccacttcccattgtttcaaaatctataataaaatcaaacattaaattttcctcgctaaatcgcgaatttggcctacagtatagtcttgaatataaactttattaataggttcatcaataaattttgccatagattcaatatctttttgcatctcttcaagactgtatattatctttaaagctttttcgcgaatagtaatattttcaggaccagaatttttctcaatgacagctttaacatttgtcataagagatttaaactgacaccaacttaattcaatcattaataatcgccttataaagatagctaatttcacctaaaacataatcactgattgtgacagttttcacttcaccacaaaagaattctaacgcaattaaatctcgttcaatttcttctaattgaagcatcaacttactagattcaatttttacagtttcacgatttttactataagctatttcataaatttcgctcactttatcttgaagcagataaaactggtctttagttatttccacgaatagcttcctcaaatttaattagtaatttacagacactttcatctagtgtaattaccgtatctgtattactgtgatatgattgtttttcaattcgtttaattgctaatatagtatcacttataagataaagcttatgaaggagctcagctcctgttaccataacatcgagattatcttgcttattagtatgcttccttatacaatctattagacgatttaaatattttgaattgatgttaatcatatatcctcacacataaaatacgtcataacgaccacgggtaacaccaacataaagaagttgttgagccaattcagcatctgcataatgaatacaaggtgtatagatgaaagcacggtctacagacataccctgcgctttatggaatgttgatgcaggaagtgctttcactttactaaactgtgatttagcatcccaaaaatcactccatggagcttttccacccttattccagtttttataagtttctgctgttttacctaaaaataggttaaacttatatagctcttcatcagatgaaattattttaatcttttcacgataatattcatcatcgccgtaagtttctactgttaaatcccaatgacgaattaagtattctccagaaacaccacgagctttaacaaatgttgatgtatactctgcttctataatacgaactaattgtccgttattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagagatttgacgattgaaaaataatttaccataaaatcgcgtaaagcggtatcaccagtaaatccacgtactccatgcccgtcaacaactttatcataaatccacttaccgttacgaacgtcagtagctacatcaataataggagcattactgcgtttaacttcagtgagttcacactgataaaaatctttatgtgtaaagaatggactgatataagcagtattttctcctggatcaacaggtctaatttgcttattatcacctattccaattatagtacaccaaggtggaatagttgaaagcagaattttaaatagctttctatcatacattgacgcttcgtcgcagattaataccctgcatttagctaaatctggtacttccttctgttcaaaaagaacgttttcttcatacgtaactgggttaattttaagaatactgtgaatagtactcgcttctttccccgacagttttgaaagaatctttttagctgcatgtgtaggagctgctaaaataataccagtttcacccgtagatattaaagcttcaatgatgaacttagtaagagtagtcttaccagtaccagcaggtccattaatagttacatgatgtttcttttctttaatagccctcataacgatgttaaaggcatttttctggccttctgtcaaatcatcaaatgtcatcggaaagtccctgcaattggaatactaacaatacgcccagtatctagaattcgttgatataatctttgtgtatctacatcaggcttaacatgtttaacttctattttattaaaccaaaacttgcgtggagtctcaactagtcttggaattcccatacctaaagctagtttatattggtctttgagagtagtaaaaactctatcagcaatctctctttcaaaaaacacagcaggacgatgttcatcaagtggaactggcgccgtaaatccgtctttgtctcggtaaactatcgcatatacataaaccatattatcctcggataagtttaaaaattgaacaatttagcgggtatcctcttttcagtttaagtttatcaataaaagacaagttttgataccgctctacaccttgaataattttatcacacatatcatattgcatttctgcttctgacaactttttcacaattttccaatccgagcctttaagaagaacgttcagtttaacaacttcagcgccttctgctatgcgagaaccatcaatacgagctttaagtgctataattcttagcttaatgtcagaggtctgttttgatttagaaagctgagaaatgtgttcaattcgattttcacgctttttctgtatagctttaatttgattataagtctttttgattttagcccatttcttttcatctaaatttagtttatgaacttttttcgcagatgaacgaccaattcgcaaagcaaataaatcccgtttttcaatcaactcttctaaagtataatcagaacgaaatgtattatactttttctttactgcaataacattccctttaatgtatccaatgttattatcaaaacgttctaatgataatttctctccttcaatacgattatcaaaaggttctcctgaataggcacaaactttttgatctaaaatattcttaatgtaattgaagtctaagttaaaatctttagaacgtctttttgcagatgcctgagtgtgctctaaacgacgtttaattttacgaatttgattattagacagtttcatatttttctcacatcttacggacgattgactactatactataacatttttaccttggcttgtaaacaattttatgaaaaatgcttcaaaaatttcatggtataatgaatctaagtccttccattatagattaaatccttcaaaatcaagagtatagatagtgtatgttgaatactttttatactcatatctatctgcaattctaaatacacttccagctggtatcattacttcttgttcatctgaaactaattccatattacgataacgatggctatccggaaacttaaagtttggattgtattctttacagcgcagagcttttatagcatactcctggaaattgaataccataggagctttgaattcaaaaataacttgtgtgttatactctaaaccggaagcaaaatgtagagctatatttttatcatatgaagctgatacgactttatcaaatgtaataatatcaattccttgatttaatacttgtttagtctcagctggaacacctctccaaagaggtttatcgtttggttccaaacgagatttgattatttcatttaaccaagtatggtcatctggtttattagtaatacaatgaattaaaagttcaatttcagataaattaaatccttcagaaagtaattcttcacgaatagaagcacgcaccgatgcatccattgatttgattttaaaatcttttaattgcattgctgaatatttcattcaactacctcaatatcatacactttaaatgttccaaatgaatcgtgtaatttttcttttgaaatagaagttattttatactttccaattggaatcatccattcttgttcacgtacaatcatcattaagttatcagtacgctctgaatctaatccatcagtatcttcatacgtgtacttaaactcagtattaggagaagaaagtataatatcgctgatatggtcagaataattaaaagctttattagtttttaagcgaagtattattttagtaaaatattcagcgtaagaaaaagaacatgctgtgaacaaactagtagtaaatgaatctactctattcgttgaaaacacttctccaacttgtaaatctttaataagttcttctgttgattttgatataccacgatataactgataaggagatttagttaaatgctttttaatgattttattcaactgcctatgaagagcttcattctttttggcttccatacattgccaaagaactgactgctcaaagtcagtaaatttttcacagacctttttatacatatcatattgaaaatcaacgctttcagcttttatagataactgttcaacatctgcaagattaataatcatgatagcctccgtatacttcagaagctatcatatcatcgttagaaaggaaagtaaacaactttttgaattattttgcccaaggagcccaaggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatactaattcctagcgataaaaaccaaattgacgattagcttcaataatctttctttcttcttcggacattctccagcgtagtccaacatcaaaatgagcccagaccatcttaacaaatgcatttatatctttaatatcttcaataatgaatgttttacttttagaaggttgacctgctaaattaagtgctaatttaactttatcgtcttcaaacagggcaaaaagaccatattcatgagctcttttatagcctttaatagttaaagcttcagaagaagaaaacggtgaatcagtattctgtaaaatatcttcagtatgctttataattagaataacattttctggatattttctttcttttatatctttaattaaaagatccggattttctgctaaaggaataattaatgagcattttttatcaagtgcatttactgatttaccttctttagacataaattctattgaataatgttttgctacttcaatcatgcgatttcctcttgcctactaatggaccgtcaggaattttgttttcctggatatatttctcattttcttccatcattttactgccaattttaagaagcaaatccattgcttcatttgctttagctttagcctcttctaatatcatatctctgttcacgatttatccccatagatgtctctcattaatttaagcgctgagcgttctaatttcttttctttctcagcactaatcattgatttcatccattcttctgattcgttctgcatttctttatttgcttgttcaacccaaccatcatcaatatacatcgagtttggtctattgaaccattcaagcatcttcttcagagctttcatttgttttacctaaaacaacagtaggagcatcatcaaattcatgaatttttagcaaatttggatgtaaactattccatacagaagaaataaagtatgataacgcatcttcacttgcaattataaatttatttcctttatctattttccaactatatagtgaatcgtacgaataaaaagataaaggcttatcattatattgttctgcgctaacattaatgtattcggatttagtaaatgcttcaattgctctaaatggaatatttggtacagtttcaataataccaatctttttaagttttatttcagcatcttctggaactggcattgaaacgaaattttctacgagatacattgggtcacaataacccttatcaatcattactgctacggtaattggaacgtctttagcaaacgacatactattactgctaatatacatttcaaacaaaatcgcttccataattttcctcaatcacaagatgtagatgaacaactagaatcacaagaacttccacatgaatcgcccgtccatacatgaacaggaacattagtgtcatatgaatcagaactagactgtgtattctgcgtattagatgatgtaggtgttgaccaacgccaaggatttttataatattcctgggcttcttcataagtcatagtaaccgcttctactgttccatctcccatataaacatattcaactacagttaaaggaaggtagtcatttgaaataggaactacaccttctccgggagttgtagagaaaaaatccgtaaagaaacttttaaaccaattaaagataaacattacaaaaagcctcttttgaattcaacttgcttctcgccataatcatatcgaatctctgcattaaattcaacagaaccatctgcgtacatcataaatgaatgcacaacaacttctgtagaccatggctgtagttcatatttcttcattacatgccgtgaaatgataatatctaaatcttcatttggtttaatccagcgatttaacatagtgctctcctctataagataattctattataccatactcattttggaaagtaaaccggtaaaatgaaaaaaggactcccgaaggagtccttgaattattaaccacctatttctgtaggcgtaaacattgcagcattcttagttttccaagttgttgcatcggaaactacatcagaataagctgctttttctgacggaaagatttgataatgagaatctgcaatacggtgttcatttgaatatacatcaaatgctacagaaacttccatacctttaacttctttgccttcacctgctggatgagtaaaggtcttgatgttaacgaaaccacccataataaactcctttattgtttaattacaggtgtatttatatcagtcttcaatgaaaacttgtgccaggaattcgtgttcatcttgaatttgtttatataaagccattacagcatttatattagagctatctactttaagttgataggcataccactcgtataaattaattaaagctttttgtcgtctaataaattcttctttggatattttcattttgaatgctctataattagttttaaggcttctttactgacaaaaatttcatcaagaccttcttctacaccccaatcaactacacgaagctgattagataagagctcgtatgtgagctccttgtcataatttttaaatagctggtcaatacgtttcttgtgggctttcttaagctggcgtttatttaaacgagccattaataacctcggtcttgacgagcgaagttttcagcatttttcagataataaagtttaaagatttcttcagccgtaagaccgaggccttggaacatgttcagaacgaaatgaagaatatcaatcatttcgaatttaatttccaactggtcttgtggagacaaatcagtaatcagagtttcacgtcgttcaccatgttgagctttccaaggcttccatacagcagatgcatctttttcaccattgctcataccaccaagagaagtcaatagttcgcggaattcatcatcaatataatctttctgattacgcagccaatcaacaacttcacccgcagtagccaaatcatcaggatgacggttatattcaggtttatctttagctaaacgaacctgcagagatttctgcatatcaagcataacttgcaacgggtctttttcatcaccgagaatatcccagtattcattttgagctttatcagcgccttcaatcagttgtgaacattcattaaagtatgccattatttttcctttcaattcatgggttagtagattaattatacaataaatatataaagcaataaggaggacatatggtacaaaaattaatggcacttgttaatgccatcaaaggtaataaaaagcgtatagcttttactatttctgctatggtaggaattttactctggaactttattttatcacctgttgcaattgcacatggtattaatattccagtagttactcttgatacattcgtagatttagcattcgctttagttgggttaatttaaatcttagcatatttagataaccgcattttagccatcaacccctgagcaatattatttttcatatattccataatttgttcagtggttgcaccttcctttctaatcatatcattaacatcttttgatttccagggagatttatcccaaaacataaccctttctcctgcatcaactaatttagtcattcgcttaatagtgtcaggatgacgaggttcattatctaaaacccacacacgtctatctttaaatggaacaacttctaggtctaattgaccacctgtaatagctataccattttcaataaaaagcgaatctataggtccttctagaacatatacatcaccatctttgactcgttcgactccatagatttttgttgcctcaggataagctttgatggtgatatatttttgaggagcatctttctttaatgcacgtccttgaaaagactcagcttttccgttagcattataaattggaataacaagacgaggctcaggtgtttcctttttatatgttcctggagctatactattaactaatttaggccattcagttgtaaaccaaagatatttccatttatcctttggaatacaacgagcttttacatattttataattggatggtcttccgccaatttatctaatctgatgcatgacggaagagatttaattattttcttctcaggttgtttaggaagttctttaggtttttctactggacgacttttacctttttcttttcttatttcaaagatatactcacgatataaatcaggttcaaactcctttaaatatattccgattggtgcatgatagttacagttataacaatgaatatttccttcattattatcgccataataccatccacgggctttattttgatcggtttttgaatctccacaaacgggacatctaaaccgtaatttaaaagttgaactattatttacttgtgcgaatttaggtaaatgagccaatgcacggtatgcaaactcattatcaatccaaggtattgatgacatttttactcttctttttctttagattcctcttttttctttttaggaatctgttcaggacctttatttactacagcacctgacgttgttccagtggagatattttcaggattaccacctgaatctccagctaccatatcttctttaataaattctttatatgttttcatattaacctctattcataaaagcattaaaaatttggtcatcaatagaaacatctactttagactgtttttctgatggtaattcatatccacatattacaattttgtgatcaatatcaaaatacacagaagcaatatgattaatgatgttttcagtaaagtctaaatcaacatcaatatctttttgaccacagcccaaaggataaataatgcgagtaattcgattatctttaacaaagattccaccgacatactctgtgctgcgtttaaagtctacacgccaacgaaatgaaaaatattcaggctctttatgagctctgctcataggacacaacgagtaactagaataagagatgtcaaatcctacgccttcaatatgagccaaagtatcatgattaaaccaattataatcgtacgccaaatccattagattataatatgtaaaaggcaccggattaacgtcattaatcacaagcatgtaattagcaactgctataatttcattgtttttaacgaatacaaaccgtgattgatgcgaatgacctggacccgcgttttcacgattaatgatataacactgggcacctttatatttgtatgtatctttgcacttgtgcatttgatagagcattattcacctaccacttcagcgatgatatttttattattaaagtttttatcgcaatacagaacataattatactgcattacaccaccagacttaagctgtttttgcacttcagctttcatttcggggcgatcgcgctcaacgatattcataatatctgcttcaatttgagtttcaacctcagtctgatccgcagtcatagaccattcgcacaaatctttatcatagcctgccatggcaggttgagcagcgcaagaagctaaagcaaaaattgcagcaaagataaattttttcatgataatctcctcggtagtttatgtttatataatatctcaatttccaacaaaagtaaatagttattttaaaacttctgcgtaatcacatgttacaaactgtttctctagcttaacgattttacgaaagtatcttttgcattggcgaatctgcctcttcgtaggacgtacagcaaacttaataaattccactcgaccaaatggaggactttcttctgctggaatatctaacaccaattcccacgtatctgcaacaagtgctttgaattgcgtatttttcctgacattatacggagtaggtttaaataaaacaatatgcatattatcctcggcaatctacttcacatactttcttgtcatcaatgaaagctttaactaatgctttattaacttcagcatactgagtagtaacccattgaacatcatctttcatcattgtggtttctttagtaaacatgctttcattcttaaaccaccccataaaaactacctttaccaattccataacaatctcctcatttaaccaacaagactactataccatagtcttgtcagcttgtaaactaaaattttaattcattcgccaaagcatctaactgagctcgagtggattcatttctttgatagcgattctgctcagcctgaatctgttgtgaacctgctacttcattcacttcagttggagtagaatcttgatcaatttctacccatttttgatttcctttttgaacacccatcaaaaacttattccatttattcttatcaccatatcgtgatttgatttgcttaatgagttgttgttcagcagctgctagctcctcggtttcaatgaccgcaagcataaaatcggctgttgctggaagaccagcagattctgcgatatcgctcatgttaacatcggaagagtcccaagcttgtttgccgacctgcgctgcagtccaaagaacagtttcggtttcaacagcaagagcacgtaattcctcagcaatggctttaacagttgtgtaactattttctgagtaaactctaatgcggcaagatttacaaatacccagatagtcgacaataatgattgttggaacaaaattcttcttgagcttcaattcgtttaaaagtgatcgaaatgtattagcgtctgctccaccagtaggatactgtttaacgattaaacgaccaagagtagatttctcacgccatttttccatttttcctttatactcagcgtaagaaatatgcccatcatcaatgtcatcaagagaaacatcaagcatattagcatcaatacgcttagcacagacttcttctgccatttccatggaaatgtaaagaacattatgtccgagctgcaaataatctgctgccaatgaacacaatcctaatgacttaccaacgttaacgccagccattaaaacgttcagtgttccagtctcagctccgcctttagtaattttgttcagaattctgagtttaaatggaaccttacgagctttattcatataagatagccaacgtgcttcatagtcatccatccaatcatggccaacgtagctatcaaatgaaattgataatgcttggcgcatgatgtcaggaatagcacctacatctggcattttcttatttcgtttttctggaggaagctcagcattagtttgaatttcgattattttagacgtagcattaaacatcgccctttgctgaacatatttttctgtttcttttattaaccaactgtggtcttccggagaatcagctagttttgaaataagtgtttttacaccagaatattctgtttcagtaaatgaactattttctaatgcaacatttaacgcattaatagatggaacgctatgatactcattgacatgagatttaattaatttgaatgtatttttagctggaccactttcaaaatattctgaatccatatatggccaaacttttgaaaaataagcttgatcaaatatgagatgagaaagaataatttctaccacacttactccttaaaagaatttaaattttttctttgaccttttattaaatgcatcttgcagttgcattgtaatacatttttctacatgaggagctaactcagcttttctttcttggtcaagaacagcaaagtccattacaacctttccattaacccaatccagttttgttacatatactatatgcgtagaaccatcttctagtttaatgacaatctcctggataacattttccatagcggatttaattatcttaagagattcattaaaaagacgttcttttctttcttcttccccctccgaagagggggattcatcgataatttctagatctaagtctaaatcatctttattcattaaattcttccatatcacttaactgctcgaggtcagtttctaaatcagcagctgatttacttttactttccggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttggtatcttttgcgcgccaagatttttcttcgcgaatcatctcgccagtttcttcatcaagaaattcacgagcataccagccatttttaggttttactacaaatcctaattctagagccatatctaacaatccagaataaggatcgataccaccatcaaatttaacatcaataaagaatttacttttttctttaacggtacgagatttttctacatttagaacaaattgatacccctgaagatcagaaccatctttaatctgacgcttaccgataatgaatacggtatcagccgaatacattacgcctgtaccacctgtcatcacggttttactaaacatttcaattgtttcaattgtatggttaaccgcaacacatggaatatttttaatgctaaaataaggagtaacaatacggaataatgacttcagtgatttagcacgagtcatatctgccacagatttttcattcaaggcatcttcagtttctttcttagaagccatattaccgattgagtcgatgaatacaataactttttcaccgcgctcaatagcttcaagctgattcaccatatcaattttcagctgttcaactgactggattggcgtatgaattactcgttccgggtcaactcccatggatcgcaaataagctggagtaataccaaattcactatcatagaatagacaaaccgcgtcaggatatttgtttaaatatgccgcaaccatagtcaaagacatatttgatttaaagtgtttagaaggccctgcgaaaatagttaaaccagactgcatgccgccatcaatcgcaccagaaatagcaatattaagcattggaatttttgtacgaattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctatcggatgaatagcattaaacttatgaaatgcttctgatttttctttgcgcgaaacacacatgcgaagaacctttaatggctcgtcttcttcacccaacgattttcgtttttcgatattagaagttttccaacgagcttgctctggaaactctctattgatttgctcaagcgctctattatgtttagaattactacgaattgaactacacccgccaggagcttgtgcttttccagatacaaccagatatttgaacaaggccaaatgcggataaccttgattaattaaattgagaaatgcatacatatcttcgcataaatcaatttttccatacccaatttgttctgtcgtaagttttccgaggtcataccatgtattcgtaaatccatatgaattttcacgataattaccccaagatgaagtaattttaaaaattggtagacgagcatggccatgataatacccgcaatccatggcatcctcaacatattgaatcaattcatagaactgttcacgagtcaattgattgactttatctacacaacgacggtcatctctttttcgcattgaactcatacgaatagtagtatcatcgtcaatcatccagattcgttgacctgcatacatatcagtaattgctttacgagtaccggcaattccgtttacatcatcaggaatagttataattttagctctagacccataggcatcataataagctttttcttcatgttcacgtactacgatatgaggttcataatcagtcggaaacatatcaagggcagaaactgcccctacacgttgatagctcggaattacgaattgaatcatttccactcaccgttataatcttttttcacaatatgagtttcgccagtattccaccaatgatcaaccaagtaaaaatgacgagaatatacatgaagacttccaacattccatataatagaacctgctttatactgacgagttgaatcgccggcattcaaatcagatactaatttatctaatacgtatttttgccatgcataatcattacggaatccgaagaccacgtcatttgagcgcatgcttactactgcattgactttcttatcacgaatcaggtactgtactgtattagtacacatgaaatctgacataccatctttattgtagtcaaattgcatggatggacgagtataaatcatgataccacgtcgagaatcaggattttgaccaagttcagctaaacacatatcatactgggcatagttatcttctgaccagatagcccaaccataattcgagttaatttcgcctttagaagatgctacctgctgccaaatctttggtgtttcacctggaatatctttaacaaacaagctcttagatttataccattcaagttcacgctgaatgtattcatcattaagagcgccaaaaataaacggttcatctgctacaaatgatgcgccaataatttcaatagttttaacaccagttttatcaactacgaaatctttttcctttaatgcagttcccaaataaaaacggatttcttcaactgtcatagagtcattaatcatttaaacctcaattgatgcattcatatttaaattgtaacagtaataaaccccaccctatgataagagttggaatcatagcaggaactgttacgctatagtatatacttattataaccatcaagattaaaagcaacactgctataattttgcttttcattccttctctctgatgataattacctgatttggctgcgcagactttttagtttcacctgcaattgaccaaataaatgtaataaaccaaccaataattgaccagttaaacagtaaagacgtgaaaaagattcctactgtcgattttgacccacgcatcaaggcaataaaccatggaagcatgtatataataatagccaacacacctgaaactaaaaccataaaaattgaacctgctactaaagtttccatgttttcctcacttagtcaaattttttacacatgaattataagaattcactacatactccatcggagcatttttaccggtacgccattggtaattattagcccaatttgcccaaagctcggcgcagtagttttcaattttttcttcgcgtgtaattacatcagaattacgatatgcttgagcagattcatctggacgaatagcctcgtcaaaattcgcctgcatttgttctactgtctgttttggagcttctttataacacttgacattaggattataaaacttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacagtgctagattcaatcacaggttgagtatcattttcaacactaacaaatggaactgctgctaatgcaactaaacaaactgctaagcatcccataacaattttcattttattctccaaatccgtatcagtagttgatagttgtatagtaccatggaagaacattcttgtaaacagttttgtgaaaatttttttagggaattctaaatgtccagaatcatctgtttttcataagtatagatttatattacttgtatgaaaaagggacccggaggtccctagatttattctatcagccaaacaggaagtctaacgaagctttttcttcatagtccatacctgccgattcacacataccagcaagcggtttaacaaacgatttttggaacaaagttgagtagtcaatccaagacagtacatcagaacgaatttcttttggaagttctgtacccgacggccaagcaatgcacttatcaccaaatggatttccttcacgcaatggaagaaccattaccttatttccatccaaaattggagctacacctaaaccgctaacagctcgacgataagttagcacaccacgaatatggaacggacatttaaatcctggccaacctttatcatcatatttcgctatatcgttcgcagtttttacttcagcaataactttatagtcaagttgacgatattctttctcgaagttcttgtaatattcttggacagactcttcaccttcctgaagaatacgacgaatactttcttcgagagcttcttggaccgctttaggcgttgaactctgctgagtttccatacccatgatttttagatgcggttcagcaaatcgcttatcttccatatcataaacgttcagagcataacgctttttcgctttccaaaatccaccaacgccctttgaaccaagtggagggcaagaaatagcttcacggtccatatgcatcagatgctcgcggttattcatataatcacataactcacgatatgcaacatcaatcataggttccatctttttcttaccgaactgattcatgaattcaactaaatcgttctgctctttgaatcggtcaagaccaactttttcaataactttatctacacaaacatataccgaatcagtatcacctgctgcgatgaaatcttcgccattagttccacatactttattcagatactcattaattttacgagcaatccactgaataccgacttgaccaaaaattgtaatagcagtagcatttcgcaaatcatagtaacggaaatgaatattaccaagagcaccataaagactgttaataagaattttacggttcagctgatttgtgttagcaagtgtagctgctttttcacattcttcgatcagactattaagaacagattcagtataattcgatagttcatttaagaaatcatcactgaacttaacatatcgttcaacttctggtttagttgaacaagaccctgcgcctttcataataatctttttaatagcttcggcattcatttcttcagcgaacattttctttttccagtctttacgctggaaaaatactttagcgatttcctttggaatgataccttcttggtgcttatcatacatccatccattcggagagcaagaatattcatcacttggcttaggagctgttcctgcgatatattcatgaattggatgaactttaaactgcccacgaatagtctcaggactaatgttaacctgacgaataatgctaggatacagagacgtcaagtcaaaactcataatgtatcgacgagcaatcggtttaggttcaaacacaaatgcacctggaaaactctgtttaacgtgcgaaccttgttgaggaataaccttatgttcacctttcagtgagttaaaaataatagcatcccaagttttaataggactcattacaccagaaaaaggcattttagcgtaataagacatacttaaaactagatcgataaacccacgaattttatcaattgcttgaactgattctacgtcaatgatgttataactaatgtatcgttgatgattagtctcacgaagtttattaataggaccatcgtacggcaatttaccttttttggtttcatgttgagcaactgattccaaagagaacgatggcaaattagtaaatgcgaacttcttgtataaatctaaataatcaagaatagatacgccatcaatagaataaatttctttgctaccgtacatattttgaattagtttagattttactcgaccgattggagagaagcgtttcatactacgttcaccgagaaccattttaacacgattcatgatatacggaacgtcaaatccctcaatattccaaccggtaaaaatagcaggtcgtttctgttcccagagattaatatattccatgagcatatcacgctcattatcaaatggcatataaattactcggtcaagaatttcttgaggaacttcatcaccaccttcacagtcaagcttagcagctaactttgcatcccattttgatactgaaccgtacattgaattcaacaaatcaaagacgtaaaaacgatcgtcaattgaatcataatgagtgatagcatcaatttcatattctgctttcattgggtcaggaaatttatcaccagtaacctcaatgtcacagttagctacacgaacaaattttcggtcataagcaatttctgaaccatatgtatcactgatataagcgagtttaaaatcgttcataccgagagcttcgagaccaatgtcttccattcgtttcatccagtctcgtgcatctttcattgatggaaatttttgaggagcacaatttttaccataaatgtctttgtattttgactcttccttacaatgcctaaacatagtcggaagatattctacttcacgggtacgttcctttccattttcatcaatataacgttcaacaatgttatttccgactgtttcgatagagatataaaattctttcatagatattccttagtttatagcccgagttattaggctcttgatatattatactccaaataaggggccgaagccccttgcttaaattaataccagttgtcggtgaaaaattgttaatccatctgcattaattgacttaaccactgcggtaaagtgtttttgttctgggtgaactaatttttgaaattctacctgaaattttagttggaggttttctggtaaatcaaaaagtgtttctgttgcagaaagattatatttttctttaagagacgccatgtattcttgcggagttatagcagtcatattaattaccaatcgtatatttaggaacgagtttccattcatgcttttgtttaaaagaaataactcggaagttattagttaaatctttcataaaagttctttgaccaggaacgatttcaatcagtccccaatcttctaatagccatgcaatcgaatcacgacgaacttcatcttcttctgtcatttcaacttggcgaccatccatacgaagcatttctttaaaatgaacgatataatatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaaacctttaagttcttttaatactaaaggtagttttccatttttagtaagaattgatttatagttaattgcatcatttgtattaacttgataccgtttagtaagtaacttaataatcaatacttcggtggaatcttcaaccagttttgcccatttaccatatcttttaccacgaggaactgcagccattagataattaaaatgagcttcatcacttaatccagaaccgattaaattcattgcatatacagctggcatgcattctggaaattgtgataatgcattttcaaccatgaattttgaataatctttttgagcaatagagcatttagttttattattgatagctccaattatttcaaaaaattcattttcggctttttctttaaaagaatcagcagcggattggacagctgtccaatcttttgaataccaagcaatctgatgctcgtttaattgaatatcatcttcaaataagctcatatcacttccactgcatttcgcacgctaattgaatgaaaagatatgctaaatgtaattccgtattagccgcaattccatgatactgattattttcgccaacaatttcgtacatacgaataatactctgtggagttacacgtgaatagatttcttcggcaagtttacccacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaatgtaataactcgacagcgtgactgaagtggtttaataataccatcaatattgttagcagtaataataatactacagtttgaactataagcttccataaaggaacgaagatgtcgctgagattctgctaaacctgaacggtcaaattcatcaataacgattactttttgacgaccatcaaatgaagctgcactagcaaaattagtcaaaggaccacgaacgaaatcaattttacagtctgatccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctctattaaaaatcatgggtagaatcagcttcaagagctactacataattcgcatgttcaccttcaaatttagcagcgccttgtttaccttttgcccaaagcagaagtttataatttcctggttgcattttcatatttgccatattgataatgaaattaaatgtgttttcaccatcataatcaccaagagtcaaagaatatttaacacgagtcaaagcagaatcttctactttattaaaaccgttaattacgattttaccttcttttaccgtgatagcaattgtatcaatttgcagaccacgagatacacgcaacagttgttgaaggtcttcagctttaatttcagtaacaacagatgctaccgggaatggaattggtttattaggagcaactactgtactcggatcggctgctggccaaaaaattgttgagcgggcatcagcaattttaatatttccatcttctgactgggaaatttctgcatcatcattaactagagacagaataccgagaaaaccgttcaaatcgtaaattgctacatcaaaatcaataacgtcagaaatatttgcttccgcataagttgtaccattaactgcgcgagtcataataaattgaccggatttaagcataataccagagttaatagtagcgaaatttttaagcagagcagtagtatctttagacagtttcatgtaatttccttcaattcaaatgagatttaattttataactaatttaataaagcaattaacgattaaaatcagctgcgattgtttcggcaacaatttgagcggcaacaatcagacgttcatctgcattgccacaatattcatcttcaaggcgttcaccacatgaagtcataataaatttagcaccagcgtttagggattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcatttctattggacattatttttgtatattctgctttaaatgcattcctaagcatagattcagtaactatatgctcttcattagaaaaattatttctcagaatatatcgttttatttcaggaatagttaatagatgctgtccggttgaatattccatgtttttcctccatagagattatactctaataaattaaagcataatctcttataaattaaaccattacagtaaatcgaccaactttcttcatttgaagatgctgaccgtatgcttgcgggtcatggtctctatgcgaaataacaaaaacgttagtattttttaaactatctaaaatagttgaaatagcttttacaccttcaacgtcggtcgctgaatcaaaaacttcatcaagaattagtgtgtttattttaacacctgaaactttttcagcaatatcacgccaagtaaataaaagagcaatatcaattcgtgctttttcaccttgactgaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagccgctttaacttttttagctttatctaccgtcgtgattagagattgctttttattgcggatatcatttgccaacgactgttgggttttaatattatctcggtattcatcaacaagaacttttaaattatcacgatgcgttgaaagctgttcaaatgaatgtgtgcattcagaaactttatctttaattttagaaacaactttatcaccggaacttaattgtgacaaacaggttgggcataatccaccttcgtgatacatattaatgactttattatacgagtcaatttttgatttaattaaaactgcttcttgaccgattttattaaatgcatcagtcgggtcttcgtctaaaacaatattaactaatctttcattagcttcttctatttccgattttagcgttctagcttcttttgccaaatcatcatacatattttgcagacgagtaaggttgtcacccgttaattttttctggcgttcaacgttatcattatatattttaatttgttggataatactatcttttttaacatcaagcacttggttttgtgaatttaattcgcgtattagtgctttattaagcttatccatttcagctaatgttcctacctcaagcaagtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcgaaaacgttcggtttttgtcctcttttgatatagtactttttctcatcatattccatccacagttcaactaaaagttctttcttatttgtgctgtttattaattgacctttctttacatcacgaaatggcttgccaaaaagcccaaatgtgatggcttctaacatagtagacttaccaccaccatttcgtccagtaataagagttttttgaaccttatctaattgaatgtcaataggatttccacctactgacattatattttggtacctaactcggtttagtttaaaattcttcacaaaagattccttttaatgtatcttttagaccattctatcatatcatcataatctaaaaagtattcatcaaattcagccatgcaaacaacaccttgtgctgtttttgatgtaatataaattattccaacatatctagaatcttcttcggtataatcaatgtttgctatgaattcatcattaatgtcaaatgtcgaaaacttcacagtatgcatccttaatacaagatacggacatatctcgcaatgatttaggtgtgtcattatctaaaatgttgaagttaaaagatacagcccaatctgtacagaccgtaacttttttaatacaattatcttcaacctctagcggttcaaaccaatattcaataatttctttatgaccaatatcatcttttacttcgcattcaaaatgctgactcatcataacatttttaaattcatcaaaagtcattgtgttgcctctacatataactgatttgcatattgaataagtgcttcacggtcagaatcagtgatgtctggaattgcattaatgtattcttccatcaacgtctgaagagattgaacttcaacttcttcactgtcatctgactcgacagagttatcaatctttgacacaactcgtaatgaatgcacaactttttctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcacctgcagttagtgtccatggtgtcccaatatatctgacgttagcagcctcagagatagtatggaagtgaccagaccacacctctttataagtcttaaggaaatcaggttcaagaccgtgagatttcattcctttataaaaataaaatccattcagttcccagtgaccaacacaaaaagaagcagatgaagttttgatatgctcaagaatttcaccagtattttcttcacacatccaaggaattaaatcaattaaacatccgtcaaaatctactgtagtaggcttatcatatactttaacattaggatatttagccaaaagctcagtagaggcatttggagttaaagtatttttaaagtgcatatcatggtttcctacaatagtatgtagggtaataccagcatcatcaagcatttgaactatttcacgggcgaactccatagttttgtgtgtgattgcttttcgcacatcaaaaatatcaccgtattgaatccaggtagtaattccatttttcttagaatattctattgcttgtttaattccatccaactgaatggattgaacccactcatcatcggctttaacgcctaaatgccaatcacctaaatttaaaattttcatatatcaagaaccgtcattgaaatgcaaaataaaattattgaaataaacccatctggcgtgctaaagaacccaatccaacatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcgcgttcacggtcataaagagttcggtcagatgacagttctttaatacgttcaaatgttgattccatgtcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaactgtttcaggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcgtattcttttgctaataaaaccggaattgaaaatgatttataatcatgcgcacaattacgagtaaatgatttatctttagcataaaccaaagttacttcatgaccatttttaataaaccaatcacgctgctcaagagaaaatttagttacaccgcaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcataactgccaccattttttgacttgataagaatcaacccacactttcatattggggtctgctcttacaataggaggattaacttctttaattgaactatcatggtattctttttcagaaattttcacacaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgtttcagaatatcccgacttttcttgatagcatattcgtattgagcaaaattattgttttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgttggacaaatgcattaaaacaagcttgagttatatacgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaagcagtatgcttggaacactttctccatcatctttttaaattcatgaatatctatgtaatgatcattaatatcagcgcgatataaaaagtctaaaaactttttatgtgtactaacatattcactttcatttaattcagaaacatggctttcccaatatccaacaccagttttatttgggaaaaatgaaattttcatgtattggtcaacatagaaaataccaaaattttcaatagcaatagaaatattaattaatttcatacattcatcaacttagccgcttcaagagctgcatctagtgaatcaaattggtcaacatattcaatcaattcgccgtaattggcatataaccaccattggctaaattcatactcaaggatgaatccgtttccttcaatttgagttaaaccaatgccatttgtatttacttcatatccggcaagacgcaaatcgttaataagagcttcgttcataattataccttagtaattttcaggtctgcaaattttttcttgcgttgatttttcatacgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcagagaaactactttatcatatgcgtaagaattgatggcgtttttaatttgaatagtcatacattatcctcaattgcattaaaattttattatccaaaaagggccgaagcccttagctaaactttttggcacccttccagccttcgtacatcattgcgactgacaatgacaaagctccttcgcatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattaccattttcatcaataaatttaatccagtcatttactaaccacttagttgtatctccttttggagtagcatttaaagtatatagcccttgcttaaaaagcatgcgtttgatattcatattttcctcagctataacgataacactcgtttgatttgcgcttagcaactcgttgagaagtattgtaatcaaaatcatcgtcaatgtaaactgattttttcaactttcttacttcactacgtaattgacgatttagctcatctttaacttctgaatcaatgcctttcattctacgccatttatcagagcgaaaaatgttttcaaccatatctttatgacttacaccatcaggagctttacgctttccgaaatagtcataatcacgtacttttaaatctttacgacgatacgttttacccatggagtttaatttccttagcaactgaactaaatacagcacgatcacaaatcatctgtttatgtaacttgagtataaaagataataaacttcaaaaccgtttacataagtaacacgaacaacattaccattaataaaataatattgtccctttttaatctctttatcaaccacaaccatatcaaatcctcaaaggcaattcatatgttaataataccacagtttgaacttgttgtaaacaactttgtgaaattattttagggaatgataagaagggaacgatagcttagaatggtaatatacagaatgtgagaaagaaaggcccagagggcccgtcttagtcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagtggacgatcatactcaatcttaccattatttgtaagaactttatagaaagtaaaaggagcattgagctcctttagaagttttgtaactgattgacatccaggacaacgacctacttcatctggaattccatagacttcaatcttattctttaagttcgagttttgttccacgagaaataattccttggtaagcccaataaggaggattaacagaatcctcaccagagttttcttcaggaaaataaacctggataacgaagccggattcatcaaaggtgaaataagtagtaggcagttcacctaacaaatcggcacgagcgttgatttcttcgaggtcttgttcacgtccagcccagaagcttgggttcagactacattcatagaaataatagtcattaccgaacatatcaaaaccattccaactctctactacataccgctcaaaactaatcataattaagcctttttatcaagaacagcattcagcttgttagtaattttatccagacgctcattaaactcactagaagataagcccttttctggagaaattaaactaatcacgaaaaatatagcaataaaaggaataaggaaaatagctccaactgccataaacagaaagaatgttacagttgtaagaaaatcagctaaacctttacgaaatttatacatattttacccttaattaattaaccaagcattgataagcactaaactatattgggaataaaattctggaccaaaatgaaaaatcatatcatttatagtatccataatataattcaatttaatcatgtttccacaccccataggtatttgaccaaagtcgctgattatctgatcctcgccacagctttttagtcggaagatttttctcatactttccatcaataataacatcaacatatttaagcatttctagttgtttaatatcttcaaacttatatcctgtccacaaccaaatgcttttattgggataaagattttttactgtttgaacgatgcaatgaatcacgtctctgttatcaggataaagagggtcacctccggttatagttaatccttctatataatcattattcaaacattcaattaattgttctagtgtttcaccagtgaatggaataccatttctagcattccatgttgatttattataacacccttcacatttatgcaaacaacctgtaacgaaaagaacggtcctgcagccaggaccattaacaaaatcgcaaggataaaatctatcataattcattggtgcttaaccctatgcatgatttctttatttttgccgagattaaatccgcgttcgttcggatttcccaaataaccacatgttcttcttattgtgttcatctttttaggatcagtttctccacaaatagaacaaacaaatccgttttcagtaggagtcatttcatgggtacttccgcatgtaaaacacttatctactggcatattaacaccaaaataatctaaatgttgtgcagcataatcccagacagcctcaagaccttttaggttatttttcatatcaggaagttcaacataagaaatgtgaccacctgtcgcaatgaaatgatatggggcttcgcgagaaatcttttcaaacggagtaatattttcttctactgaaacatggaaactgttagtgtaccatcctttatcggtaacatcttttacacttccatatttttctgtatcaagtttacagaagcgataacaaaggttttcagcaggagtcgaatacaaactaaaagcaaacccagttctttcagcccactgtttaagacgagcattcattttagttaaaatttcttgtccaatatcacgaccgacaagaatattcaattcatgaataccaatgtatcctaaagacactgaacttctaccgtttttaaataactcaattatgtcgtcatcaggtttaagacgaaccccgaatgcaccttcttggtaaagaataggagcaacagtcgctttaactccttttaaggaactaattctacacatcaaagcttcaaaacataaatccattcgctcattgaacaattcagtaaatttctgttcattgaactgtgttccaatataagaatccaacgcaatacgaggaagattcagtgttacaacaccaagattattacgtccatcaagaatttcattaccggttgaatctttccacgcgctcaagaaactgcggcaacccattggagaaacaggaatagatgagccggtgatagctttattgttcttagctgaaataatatcaggatacatccttttgcttgcacactctaaagcaagctgcttaatatcatagttcggatcgtctttataaagattaacgccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggagtctgtccgtttgaactaaagagagtatttacttcatattcataagcttggaatgcatcgtatacatctttttctgttttagattgagcataatttaacgcatcagcgatttgccatttttctgcatcctcaatatgttttgcataggtgcgtttaacataaggagaaagtactttatctacattagcaaaagtcgttccgccgtattggtgagaagcaacctgtgcagtaatttgcgccataattgcagtagcaacgccaattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaattgtgttttggtgtcagattcattatattcaaatcctctttgaagcatctcggccatcatttcctcttttcctaaacgagaaaattcctttgatttatctccaacaaagttaggatgaatattattttgggtgtaatcggattttaaataagtaagtaaattttctaaccattcaagataatcaacaccttgtccctttaagccagaacgattaaatttgtgcttcatttgaccttctgcagcattgcagagattacaaagcaatccacgtacctttcctgcttttggtccatttaattcatggtcatgatcaagatgattagcttgaacgtcaggatttagttctcgttggcaaattaagcatttaccattttgtgcatcataaaatttttgtttttcttctttgtataatttgccagtcaataacataataaatacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgtcctgtcagaaaaagaattttgagtttttttcaagtattgtaaaacatttgatgcaatcgcttatattgccgaatcttttggtcagaaaaagaaatttgagtttcaagccattcaatgtactctgcggcagcttgcatcaggttaccttcatagccatcgttattttcttgcgcagctaatttagctaatgcgtatgaaatacgttcaccttgaaaagcggctttaggcttctgaacatcttggctagttctctctacaacttcttcaatttcgccattttcaacggattcagtattccacaaacaccagtatgtaattggcttatcatagatgttaataatctttccgtcggaaagttcaatttcaataattccagtatcaggttctatatcatcttcgcattcttttgcaagttcacgaactttaaagacagtacctgcactaagttccggccagtaattacatagccctgtatcaacacgattaattctaaaccacttatctactgtaatcatgtcccatctccatatcaattaagtcatttatcgttggttcattatatactgtttcttcatcaatgtaaaccggttcttccggctctggctctacagtttcccatctagccgcccaccaaggtttaaccccgaagcttattaagttcttcataatcaatccaggattctaatcctgatggcaaatcagattcaatttcccaaagaagctcttcaattttctgaagacgatctagttcttcggctggaatagtaaccattgacggagttcttgatacattaatatcgtaaatcatatttaccccaatttaaccatacaatcgccgtatttccacttagaaatagacttttcaccattagaataataaacttcgagtttagcacgattatttttaatttgaataaccttggctgtcatcaaagttccatacccataataaactgcaacttcatcacctacatataccgcgcttccgcggtaatcatgaatatagtcagttccttcgagcatcatttaaaatattctcgcagttggtcaaatccaccaatatgacttccatcaggagcaaatacctggggcattgtcaagccgatttgagtatcacgacctagtttagtcagaagctcagcaattttctcatcatcaaaaacacctttttccggcataatgttgataaattcaaacggctgtttcttcacggtcaaaagacgttttgcattatcgcaatacacacatttatgaatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccatgttcattataataagctattgctaattcacggactgccttttcagcagcctccatatattctttacgcttggtcatttttaatccaaaatattattaggcattggttgaacactcacaagttctttaaagaactcagtagagtcaggcaatttaaccatttccggagcatgcttactgaatttatgtttacattgacggcatttatattcaagctctggtttacgccagttaatcaattgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgctttggcggttaaagccttaagaactttagtatactcttcaatctgtttttcaacttcaatcaaacgggcactgagatattcgcgttcttctttcatagtatcatttccatgattggattttggtgtaggtttaaattcactagggtcctttaatttaataacaaatttagtttcaaacagcgaaagaccataattcgtattatcatcaaaggatttgactacatccatatcagataataacacgcgtaaattataagccaaagaactaatagtttcattgtgtttattagcttcgcgtggtttcatatacggaaggtttttatatatctcgtgcggagcacaaatgataattgacaattcaaattgcccattctgggacgatggagtgaatttagccgtaacccagtcttttacattcacattaatagtacggttatcaccatgacaaaacagtctacgagaatgcttaaaaagcatattcacgttattattgaattcgtgtgaaaattcactagcaaatttttctttactatctttagaaaaccattcttctaaataagttcttttcacgtcgttaataatattaaatgtaacaacactagcatttgatacattagtctcaatgtagcttggatacataaattttttaacattattaacagctatcacagaagatagtaatcgggaacgtttgaaccactcgagcaaagaaccaagagaatgtgaatacgcattttgtgtatctttacaaatatggttttcccatccaatatagtctaaaaaatcacgaagaatattattgattactgctctgtgtcctatctgataattacgatgtttagtaataagactgtcaaaataatcaatataatgtttacgagttttcatgttcttctcacttggttaatgatttatactccgagccatccttggctttaaattacttaattaactgtaaagcttgttccagacgatcaagacgattaacagattcttcccaaatccttttagcctgctcatattctttctgcgctttattagaaatttctagaacttctttataagctttttctagtgcaataacttctggacgaatttctatcggttcaggtgaatcatcaagacattccattagttcctcaagggtagtttcttctttaggagtattcacaatttcatcacatttttgttggtaaatttctttatcagtaggtgaataagcacatttcacttcacgaaggctaattacgagtttatatccttcccaaccgcatatattcttaaaaggatatgtatgaatattttctactgtttccatacaaagtaatgcggtctctaattgacgagttatagtgctagcaattgagaaaaatttattaatattcttttggttagtttctggtgtaaaaaatccataattcacaaaaatagatactttatttttatcaagttcatattcttttatgataatcatatcagaagccaaaggatgaatttgacgataatcgccataacataatttagaagctgattttagaatttgtttcttaaaaagtctgaaattactgatccaacgacgagtaaaaatattctcagggtcttctttaatattaagatgataagaattaacatcaccgaaccaattgtatcctactacatctttagttcgtttaatttctttcccaaaattaccaagaatatcccgattaaccaaatatgaaagaagacgagactctttaaaggttttcttgataacatctttatctacacggctagaaattttacgaatttcatgaataaatttagtagaagaaacaatacttgcatcaacactattgagccattgattgataatagaaagaacgctattttggccaaacatcggtatagctttatcatcaataacgctattgaatgatttgatatattcgttacgagtcataataatctcctcagtagaaagtaaaaacattataccacatccttgtggcaaagtaaactagttcagtgcatttagtgcattgttcagtttagaacgttgctttgtcagattttgaacccttgactgagcttgttctaacgccttttcagcttctagcacttcattggtcgctttaacgagttcatcatctactgccttaagagacttctcaatcgcgtcagcgtgccatttttctacaggtttaaaatttgaattttcagtaggaagaaaactcactttattaagtttacatgcatctatattgcttgagctatacatccaaaatttaggatcgtttgataagtaattggataaatttaaatttaaggtatcttgcacttcctgctttttctcttgaacaatttcatcctttctcaaaaattcatatttaaatgaaacgatcatatcaagttcatatgttgttgtatgttcccaatttcgctcaaaacgaggtaaaatcttagattgaacagcagcaacaacatccatatacttaaatgcttctgtcagctgtgatttaagacattcacaaattgaaagagaatttttagtattaggcttaaagctaattcgtgcagttctattattttcttttaacggtcttacttccatctgaagagtataaccatcaaatttcaggttctttaagttaatatcagagccttttaatcgactagcagtagacaaaatttgctttaattgtttacggaatagagcaataaatctccattcaatacgataatgatttggattgaaaaatccagatgataaatcgaccttactttgaccaacgccttgaacaatcaaaggatttttataatcaatagttttacagaaatcggtgagctgttcacgagcagtcatttgtgtaatataccctgctttactaaaattacgcacccattcactgctattcgtatacttaaagtgatgaataacacgattaactttatcagggtctaaattattttcacacaaaaatgtcataacatcacgagtatagctggcattacgaaccatatcttcaatttgagaacgagttttcatggtgttccttaagatttaagtaaatcaacgattttaattaatttttcacgctcagatttagctttactactcaatccagatagtctgaaaatttcatcatcatattgctgaatagaaatatttagctcttcaatctgcttattaaaataagcaatttgttcagaatgtttttcattactgcgaactggtacaggttttgtaggtaatttagttgaactggattcatctgggcgataaattaaaatgcaatttgaaccaatcggacatttagcaccagacacatattctaatgttccggcttcttttaaaacttcaaaagctaaacagagatgatgccccatattaacataatctgtagagcgagctctgatgtaataatcatctccacgagtactaaatttaaagcatttaaggtcttctgtattattggtcttaaaaatcatttgtttatctagacctttagctaatcgagcgcctaatgctaataatcgtcgttgattttcccacaaatccgcaatcatttggtcaaatgataatttcggcattagtcgaccataaaggtcatatcctttattataattgcgaaggatttcactcgcattaatacgagacaacgctccaattttattaagggctttcatgatgcgattagataaacccattccagatccgtttgttcgttgcaaatgtttatctaacccaaacccaatatcaactttaaatttatctaaaatttcagcgtgaacatctctgtcaataacattcaaatccaaagttgggttaaatctatgaaaaaatttatctggctctccacgacgaagtacagtccattcatttaattttttattaactaaagatttaattactgcattgacattattaattactactgacatattttcctcactcaatttcaattttactaaatatacagaataagatggaacagactatataagcaccacacacagattgaactaataccattccaaagaaccaaacaatattatcaaacaatgtctgttttacgtcgaaaggacgtaaacttacagtaatattatcacctttttctattgatgaatacatctctggggaaatatattcactaaatctataaccatctttgagttcatatacggcaataaacgataaactagacccttttccttgtgttcctgtaatggtattaactacagtaacatcataatctttataatgcatataatcattaattgcgtaataaccatatgcaattgctatacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttgtaagtttcaatacgctctgaaatgagagtgtatcgttcatttactgattctttcataaaatcaggaatttcacgagaagctttaatctcatcaaatttatcaataacagcttgctcttcagcaattaagttatcatacatcaaaatatctttcttgatgaactcaatatcttcttgagttacacgagataatttagatgctttatcctttttgtactgttcgttagtatcacgagaccagtgtaatgtacgatttttattcgtattcttgtaaatttctacaataccaatctcatcgataataacgatccaattccaacgagatttgtaaatttgtcctccgtcaaccgtgatttcacctccgattgagatgtcattaaagaacttactttgtgcttcagatttaaatttaccatcgttgtaatttaccaggttgaaaatatctttagcgttcattttgtgttcctccgtagttgatagttgtatagtaccacagaggaacagtcttgtaaaccactaaaagaaacttctttcacaattttttccactgaaccatgcgcttaccgctttcttagtctcaggagcagtgttatccataaaccattcaaaggcagcctttttatgattctggagggcttctcgggctttaatctgctcacggtctattaacactaacatatgagcctttcttgtcaccatgggcttcttatgattttttgaatactcccagtcatttgtccatcgcattgtcgttgcgaacttaaatactgcttctttaattttagtttcgtaaatttcacgagcctttgagtataacatcattacctccattcaccagtttaattctagtcatctttttaatggcagtccatataatctatttctgaactgcctttttgtcatagaagtcctcttatgaattatttcagaagagtaacctcagcaatttcttcccaaccgtttttgtcggtcataataaagtcagcaagataaagagcagtacgcagtgaaacattgcgtaaacgattaacattaactttcatccatgataatgctttataagtttcttcatcagaaagaccgcgcttttgcatcatgtcagttgaaagaataacatcttcaaccctgaccataatttcttcattagtgtgaacacccaaatccaaataaaccgagcgggacactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagatgcggtgctccagcagactttacgggtctctccagtgtccagagcagctttcagaagattaagaatgtccatatcagagaaaacatccacatcatcaatcaaaaggacagaattctcttcacgattattccaaagttgttcataaagaccgataccggagattttaccgttaatgcttttatattcaatgtatccattatcatttgctttattcaaagctttatctaaagaatacgttttaccaatacccgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcacctaagagctcaaaagttccagagatttctttaccgaagtagatacccttattgatagttacagttttcattttattctccaatctcacatttgttttgatagggtaatagtatcacactactacccttctgtaaacaatttattttaacgttcgccaaatttttactgcttcacggcgagatacttctacagctccaagttctacagctttttggcgtcggcgagcgtgtaagtcataatgtttaatgcgtttatcttgaaaccaagaacgtttcattcctattgcttctgccatttcatgaagctcttcaatatctccatcagtgaacatatgacaatttttagttggatgaccgcgaagtttccatccatgattcattaaaacatctacgtaaactgtcattgattcttctccaaataagtttcgataattttctgggcgagataaaccgcgttatcttcagttgcgtcttctaagaaactttcaaaacactctgaaatttcttctgtatcaatcaacttttttacttcaattggtgtaattttcattttgttttccgtttaagtgtttgttttgatagttgtatagtaccataaagctttatgcttgtaaacagttttgtgaaaaaatttttaaaataaaaaagggagcccgaaggctccctatcatttataataacttcgatggttttcaagatagaccttctcaaggaagtcatcccagaaactcatgtctactttttgctgcataccgttcttagaagcttcagtagatgctgcttctacttgatcgaccacatcttccaaaaactcttgaaccgttttaaatggatgtttacccaacttcacgtcgagaataaatggagcatcttggagtggataaaccaagtcaccagttttgtaaatttccaatagttggagtccaccacggcaagcatgactcagagctttccagtcaataccttcattggcttcggccttacgagcgcgttcaccatattcagcatctaatttgttcagtgactgcttaagctcaataagagaaagcgttgtctgatatttacgacccaacactgtgtagaacgtctgtgggcctgttttctcatgattatggaacacccattcacagaattcgttttctggaagacgatgcttaatatcttcaactttagtacgacgctgcttaatagaaccatcttcttggtaatcaacccactgctcagggatttgattaactactttcaatacatcacgtaatgcagccaaacgagaacccttaacgccgtatttagaagcttgcttacggacatatcctaaataggatttcatgttagtcgtataaaaacgagaacggttgtcttgaataaacttccacacatcaggcaaatcagatttaaccactaactcaggtggagtgtgaagcatatctaacgctacagtttcaccatctgctgctaatttaaagaaatatttaagactgtatagttcatggtcaatatcatctttagtgtttttagatgatgtgttgttagtgtttttactcatatgctctttaacatttccgataagaatatcgcgagcaggaggaacaaagatttctttaaaatctacatcagattctggagtagaagttccataaagatgactaccaaaatagcttttcattactgttttcatcattcagccttatattcaataacaggacatactttagctttacgcgcttttaaaaattcgacgataatagatttcttgggttgaataggaggtaaacctttatacgccctatcaatattttctacatgtaaagcataatcctttttccatttataatctttatatttttcatgtagttgtgcaggaataacaaatgaaccgataataagtaaaacaagcaaaatggcaagtataaatgctgatggaataagagtccataaactaccaaaaataagccatttctgtatgatttctgcacagataatagttagacctgcgagtatagtacatccgaaaaaagaaacgaaaaatgtagggataacaatagaccaaaaatatgcacaaagtgtcttaggtcgtttccattcgtcgttaaacattttgaataatttataatgccaagagttttcattaataatcataattatcctttcattgaaggtgtaacagttgttaaatacttaatcatagcttcagcttctgattttgataatgaaatttctccattattttgacgaatagaaataaaatccggatgacggtcaccaccagcttttaaaacacacatataagtatcagtttcatcttcaatatttgaaatgattgaagcagttccacatgaatgtggtttttgataaactaatacagcttttcttccaccatttgactgttcataaacttttaatacatcaaacaaatcacttcttttatcaatagctaaaatgttgttttcatcttcaatgttaaatccttcggatacttcataaagtgtcacccataaatcacctatatcgatagtagcattttcctttccatgactttcaagagcatgacaaattttcttgatttcgtcataactcattttaataatatcatctccttgactaagaaagatgtcatttttaaattcaacacgaattaaaccgcttccacttgaaataaacatatttcctcactttgaaatcatagttggaatgacagaatcaagataagtctttaacgcaatagcttcgtctttggtaaatgtgacaatatgtgatcgaaaatcgtcaatttggcgaatagttaagacatctccctcttcataacattttgatacatttaaaagagtttcatcattctgattgcaagcgttagtaataatagcattgcaatttttgagccattttaaactatgttttctttcattagaataataaaaatatttaatcttatctataaaactatcccaatggataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgcgtcaaacgatacatgttatttactttttctatagccaattcaccaaaaagcggactaacttctaatactaatcgtttcatattaatcctttttattggcacgaatttgttctaaaattttagaatattcctttgtatcagatttacgtacaattgatacactataaggcatactatcggtgtcttttataaagcgttccaaatgacactctaacaaaatttctggattataaatcgtgtacatcaaattacctgttgctccacgatattggcagatttctactgattgaacaccattccataattttgttaaaactaaatcacctacttctaatttaggaaagcccatgttattcaccaattaaagtttcaatataagaatcaagatttactttagcttcttccataagagttttgtatttaatcttgttagcatgtccggagaaagctgattcatcaataactgttgctgtatgaacagctttgctatatgtttcaattaattcttttaattttaaaagcctgctcacttgtcattacatactcctttgaataatatcaataatgttgttcaccagattataagtaaacattgggtaattatattgaatcatcacatacacaacaaacaaaactttcattctcttctccttggcagttgacaagattactatatcataaccttgccaacttgtaaaccattaaatgacgttttcaataaaattctgaagctttgtatgagcatcaaccatgattttcaattcttctttagcgaaagctgtacctctttcacgagaagaacattcatagtcagaaactgcattagcatattcttcaattagcttcattaaaaacatctgcttttcagttttcattattccacctaatcatttcaagatattgaactaacttagctttagatttatccaaatcctttttagctgcttctataccatcgtatgaatatccttcacaatgctcaactgctaattgatatgaatctatttcaatatcacgtgctaatttaatgattttttcaaactgttcgcgtgttagcatacttacactctcgtattatgatcgataatttcatcaagaaacatatctaacgcttctaaagcattatcaactttagcttcaaatttttcaatacctttatttgcaatgcctgccgaaaaccaagcaaagtcactaagttcctcatctgctttgcgaattaaagctaccaattctttaattttatctgcttgttcaattctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattaagtgcttcaattttcatgatgttctcctctttatccgatagttgtatagtatcacagctcaaatggaaagtaaaccggtaaaatgaaaaaagtctcccgaaggagactaatgttattcgagggaaagaagatatttactctggtaaaacatcccagtaatatcatctatcgtgctttgaatggctggaggcatttctttataaatgctgttagattggtctagtatgcgatcaatcattttaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttattttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcgttccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcgcgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcatattcacataagctattaattcgttttctttcttatcaaaccgatcagcaaattcttcttgctgttcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatactgtaactcaaaactattcatttcggtttaccttctttaacgaaatcaggataaggataaaatcctgaataaaatccttcacctttatgattgatgcatcctttattagaacaatagcaccaataatcgaaatcacaagccatttcatcattacataaagcaaaaacaactggccattcacacttttcgcagtgggcatttttaagaatactagtttggctcataaccatgtaacctttaaacaatattcttctacatgttgtttacgacctttcctatcaataaaggtatattcaacgaatgttccaatatagtctttatctacatcatgtggactattaattgggcatttagtacggcaaatgcgttcccattgacgaataatttccactttgtttttaggatcaaacggatgcgggtaatgtactttcataatccaccactattaaatcaatatcaggagtaaacatgtcgattaatttagaaaccttatcccaatcgccgccagcaataccgcaacctatgcgtggaatgtaaattactggtttaaacaaaagggtttctgcctgtagatttaattctatcatgcagtttactaaagcaccataatcaagattaggacccggttcgtattgtgtatacaggttatagcatataccaaatcccgtaggactatgtttaaaaacaatagacatatcgcctaatttatcacgagaaccgtactcggtagtggttttatctatttctaaaattttgggataggctcttgctaattgacccgctacgccagagcccattgtgtggaagcaattgcacccgtgcgcaataatattaccttgaagaaatagggcgacaatatcgcccttgatatattttacaatcatctagtactcaatcctcgattataagaatctactaaacggtcaaccattgaatgacaagcggctttatctttctcctccgcaactgaacattctaaggtattccactttttagcatatcgttttaacaatgtatcatttttgtatctgcttgatttatctctttctccgtctttatatgcatatattaatttctgcgcaaattcagcttggcatgctttatttttcccgcaataatccgctgcagtacggtttacatactctctaatttcagtatatgatgtatctgctaacacagaaaatgaaattaatcctatacataaaaccaaaattttagtcatttactatttccaaaagtttattatttttaaggtaattagccttttctaggacttcagaagcatatttagaacctgctttaacattccatcccgaattataagatgatattgcttttcttatatcacccttatgtatatttaaccaataagaaagttcaatgtacgcccaggaagctgaattggaccgtttattcaacattctttttatttcagcatcggtcatattataaccaagttccttgactctcgctcgcatagtaggcaaataattttggaacattccataggcatgatgctttggtttagattttaaattaactccggcagagctttcttgccacaaaatagcagccattatatgacccaatccgctcttatggatgtttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctacattgaagtgacgggtctttgaacttcgcgttaggtttacaaactgtaaatccaagccaaagatttccatctgtgatttctaaacgtccaggacgatattcaaccccatcaataaaatcctcgtcaatgtcaggacgcggaggcatactcaggaattcattaacttctaaaacatggtcttttattttatggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaagtgacgacgaagcttatttcgacggataaaaacttctgtattgatagtcatgttattctcctcttaactgatagaaaaattataccacagtcaagaggaaaagtaaacagttattctttaaatctaatcaatttattcatagactttgaaacttctgcacgaacctcatgtagatttttgagctgttcaagacgctgctcatagtaagcaatttcatcttcttcgagacagtcctgtgaatcttctttaagataacgtgcatagtcctggaaagcgttacgaactacttcctggaagtcatcaagactttgaattttcttaggagcaacagatacacgacgaggggcagtataatactcataaccaaaccctgcgcttaattgagccattagtatttttcctctggttggaacactgcgcgacaagcccacatactggcttctttgagtttcattttagcaatagttaactgatcgaggctttcggcgtaattcttcgcgagttcatcatcttcacagctatcaaatgcttcccagaattcatcatataaagcatcaaagataagccctaaacgaacttcagcatctttgatagcattcactttactgattttatcgtcagtatgtggtttataacctttaatgtcttcaatcatattttacttcctcacctgttcccaaatcatattcaactaaacgaataggttcatgaatgccatatccttgaacagaaatttctgtcgtaggataaattccattaatatcacccatgttccatgcttcgttaaattgctgttcgcctgaattactaaaccactcggcgaaagcatttagcacatcttcagaaccttcaataattatctttgccattacaaactctcggtgaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattaaaaaataaatttatccaagattgttctttaattaaaaatggctcagaatcatatgccattaaactctgtgtgattagtcctttaaaaggcccatcaataaattccatggtaaaatatggaattttattcattagccgtgcattaggagccgtgcacaaaactctgcatcctttgaatacgcctttttgtaatttgtattgcttgggataaaattcgctcaaaatgttattttttgccaaaatttcaaaatgattcaccaatttatttttaatagtttttggcgaaaaataaagatattcgaaaagctgagtgtctgtcatcattgcattccgattacgaaaaactgtggacgagtaataccaccaatgcaacatttaatattacagcagcagtgtacagtgtcaatatggacactataaatcttatccatatcaggagatttgacaggctcatcaattatatacaaaattcgcgaaagcgataaacctctgaacttgcttcctttattaccaataaaactgcgcacagaatcagtaaataaacgaaaacgtatatcatcattagaataacgcgaaaattcctttttaatattatctgcggaaattttagcgtaagctgaagtattagaaagaacaataactgttccaccgtcatacaaccaattagcggcaaaattagttactgcagttgatttaccagattgacgcccaccatctagtcgaagtgtacaatactgtttaagtaagtcttcaaatggcgggatatattcgtttttacaaatttcttctactctagcatcagaatggtgtgtaaaagcattcatcagggatagataaggaccagttaaaaatgttctcattttgttctctctaggtttgggccattccatggcgcatgaattgtccatttctgtatttacccattaccgcacttgggctcgaccttattacaggttggcgggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacacgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaggtgtttgattataccatctacttttagctaagttaactgctgcttcatcccagcgtttttgctggagcatgcgtaaagaattagtaaatcctgctacgccggtttcccccatttggaagaccatgttaatcaatgcacagcggcgaacagcatcaagagaatcataaactggttttaatttagcatttctcagaattccgcgaacagcagcatcaacatcctgattaaagagtttttcggcctcatcttttgtaattacaccattacaattacgcccaatagctttatctaattcagatttagcaacacttagtgatggacttttagtaagcaaatgaccgatgccaatagtgtaatagccttctgtgtctttatagattttgagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaggtcttctagaaggtctggattataattgctaaaaccggtctcttctaagcattctctttttgcagcttccagtgcattcaaatcagaactttctacacgtccctttggaatatcccagcgatgtgccatcattccaggcttacgagaaccagtaacccgacccataaataaatctttatcttctgtcatgaagataataccagctgataatgttttcattttaatttcctgcattcagtgataaagttatttaaattttgagtatatttcttttcatcaaaaatcttttgttgtctgcgtagccgccatggcatttcaatgaacgtgtaccatatcccagataatattgatgctgtaaaaatattaacaagtatggttaaaagaatccaatctcctattctgtccattggattttttataaaaaagtaaaatacgaatgatgacacaggaagactaatgatataccacagaatcataatcttatctgtgaaccattcagcattcgttaacttagcacgaccattatgaatacacacgaatttatcatctgttacagtagatggcttaactgcttgatatcccattctaaactccctaattaatcgtttctttgtatcttcagaacagccgctccagtcaactctatcaactgaaatgccatcgtccccatcatctaaatcataccagcgagtttttaaaatcatttaattttcctacaatcactcacaaactcttccattgattctttttcaatataagacatatagctattatattcctttaattgtattttgtaatccttttttctttgccaatttattttaaaattatcataatgaaaatataacatggtaccaaagaatgaaaataatgaaatcgctatagtaaaacgaagttcactccaaacctctgttataattactgtgccgtcgatatttaaaataaaacagtcaattaacaatccaataagactacccgcaagagctgtaaatactgatacagcaagaattaatagtgcctcaggaaacgaatatttgactttatttagttttggcttttgcatcgtgattccttaacaaatttcataatttcatcaaattcatacatatctagcttaagctggtgttcctttttaatctttttacactgagctttccaatcacgtacacgtttacgataatgtcttccttgataccagtatcctacccaatttacgggtactaataaaagtggaactattaatggaagaattagcattaacacaagtatttcgccagaatcaatatcagtcataacatctaaaacacctccaataatcaatagaattacaaatgatatgagtataacaggacctattaacacatcagtagaaattatctgacgctttggttcatacttcacaggtttacttggaaggtatagtgatggttttgacatattctctacattccttaacaaatttttctagtaataaatcactttcaaaattgggattttctacaaatttatcaaaaagatcatcaacaatagttaagatattctttttactaagaatacgtttattttcatgcttcgtttcagaatcaactataagagtaaagaaatatttcttgccctgaaattttacagtagtatcaatataaaataaatttgacttttgtaaattacgtttaaaccatgcgtcacttaaactataaacaccgagataatcaaaatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatgcgtttaagagcatttagtaattggtctggaacatcaacctgtctttggaactcttcaaacattgaattgaaatcactttgcattttcattttcattcctatttactccaagtataaggggccgaagccccttatcattatttcagagaattaatgtattcctgaacatcggcagaggtagtttcaaccccagaaatattaccgttaaaggtttcaactcgagcaagggtatcttcaatatcaaccttagtcagtgctgcaatttcaactacatcatcagcagtactaattccaagggcatttgctgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcgtcaaattataggctcataatatctcaatcatgagcctgcgtaaacttatttcatattattgaaatattcttctgcgatttcgtcgttatcatggtaaactttagaagacagtttaacataaccttctgctgtgaacatattaatcacaacttttacagtataccactgaccgtcttcattacccattactgcgtaagtttcaaacatcggatgatcaggatcgataactttaatatcattcactgtacgaccgaaatattctgaaacgcatttcataaagaagttgaacagttcgccgtaattatccatttcattctccaagttgttttctgtatcagtagttgatagttgtatagtaccatggaagaacagagatgtaaacagttttgtgaaaaaatttttagggaattctagggcagggatgggcaattaaaggataggataatatattataaagggtataaactaaatgatgcctagagaggtccagaaaggcctagataccaaaaagccctatcatttagatagggatttaaaattatttacctagtttacttattatagcttctgcagcagcttttagcttagatgcagtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccacttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtaacagcgttatccgagtgattcaaactaaaaagccccaacctttcggtcggggctaagaatgtcatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttacccgaagcctttgcaaaagcagcgccagtagcaactaaacttttccaggccatactaactgcatttcccgtaaatccttccgctttcatgtcgcgtgcaaactggaatcgcgattcatcagaagcatctttataggaatatttacccgcggcaatggcagcttttgcaacagcttgaatttcggtgctagatgcttcatttaacaccgcttcatttaaaaattgagtatatgatttcatcttatttcctgttttaatttgtagatttaatatactaatatttataccaaaaagccccaacctttcggtcggggctaagccttgcggcaaccttgtcggggttccacctgctaaggcaagtgtttgtacgaaacgccgggattcgaacccggttattaagtagttgacgctactcaatatttttaaaaggccatatctcgaccatatccgaacgttccgtcaaaaacgctactcggcttacggcaaagatatttcctcgaatcgataattcggtgcgccgtttctgctgtgatagtaaagagccagaacacagtaaaactgtgggaggaaactatactccagggaacatcagtccgacgacttaccggtagcgacccggtttcttaatattcttttaaagaatcaatatattcacggcgtttacgccacaaatcaattgcttcatacgcggattcagcatttcgaattagccggcatttatgtaaagacttatgattttgatattgtgtagatagcggaattgtatctaaaaggtctttacgatcaaaatattcgtaaccatctaaaccaaatgaacgatttttgagaaattgccaatgaccatattcgttttcgacataaacataatctgcatgctgataaagcaaattaattacacgttcagaaataacagtatcattatgattaaaatagaatgttaaatcatgaactactaaataaacattacctttcatattttcctcacttataattggtcgaggcagtagggatcgaacctacgacctaggacttagaaggtccttgctcttccttctgagctatgccccgtaattggggtgaccgatgggagtcgaacccatgactacgagaatcacaatctcgagttctaccaactgaactacggccacattaatacctactccaacaatcaagatgtcttcacacgaaattaagagaagagtgatcagttcaacccctataatcgcgtcaagtagatattaatgtgacagttgtcacaaatttggcggacgtgataggattcgaacctataaccaatcgcttaacaggcgatcgctctgccattgagctacacatccaaattggtggggaatggtggagtcgaaccacccgagtcgcaatgataatggatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccgtggcaggatttgaacctacgacattctgctcccaaagcagacgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttggccattctcgcgctgggaataaaggactcgaacctttgcatcctggaatcaaaatccagtgccttaccaacttggctaattcccaattattaacaaaggctcttaagcaagaacccttgatgatagagggtattaatcagtgcgatatgagttaataataacaaataattcttaaagcatatttaccatttataataatacatatttacgatgcattcaagacccaaaggattcttgaaaatatcatattcaagaggacctttttctgtttcaataaagaaatcaaaatttactgtattaaatttacgttcttccttcactaatttaacttgagaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaaaacattttctgccgtagtcaataatccgcatataaatccaacaaacattgaaaaactgaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttgtagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactcttgaataacatatagtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgcccttcgtcatcaaaaacaaacacacctttaattgggcttttaccattaagatagcaaaatgcttgttccataatcgtgattacttctaatttagttagatttaaattagtctcacgatcatagtcaattccttcaaactctttacgagttaagcaaggatagtcggtatttgctgcaaatactccccatgcataagccaatgcatccttaataggaccagcaagttggtatttaactgcagaataattgctcatgataaaatcagcagtagtatcttttccactacgctttacaccgcttaaaaagattagtttcatatgtttctcctcaaatttagttaagattataacacatgaaactgaagcattaaacttccgctataatttttccatctttttctacttgaaaatacgtataaggaatcgttgctgtacatactaaagccgggtctgaatcttctgtgtagctaaattctacttcagacaggtcagaaacccaaggcttataaaaatttattgacatcacgatttcagttttgctattatctaaaatgtaaagcgtaatgtattcaggacctgttttttgggcagtattttcacctgtaagatagttgctagttcctagcatccattcatacattcctatccatgacttaagttcttcatcaactataaatctcacgatgagtggatcgtactcaaatgtagcacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataactgttggtggtataatgggtctaagtcccttccattcaattccatttagaacaaacaacagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccaggtatatatgccttaatcatttggtctgcacccctaaatcctttcacttgactccaatcaatttttaatttcgttttattagtaatagtaggtgtatttgcatattgctttaaaagctcttctagaaactgttgacgagctttaggtggaatatagtgcaagttcaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcgcgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgattcctctttcttcagcaaattgctttccggtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgttaaaattctaaattttattccacgcttttcagctaaagcttgagctgctttccatttgtcagtattaacggaatatgtataaatttcattcataaatcttttcttcgctgcagttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgtcgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctgggggttctggcagtaattctaggtcatcctctgatactactgaaccgacggatcctcctgctccagtaagaaaaactctagttaaaaattacacaaaaactatagttggaaattggagtcgttgggctaataaattaagaagctatgtgtatgagaggtcatagatgtcaggattaagttatgataagtgtgttactgctggccatgaagcatggcctccaacagttgtgaatgccacacaaagtaaagtattcactggaggaattgctgttctcgtagcaggtgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacgtttgctgaaataaaacaaaacctcattgaatggcttaatggccaaaatgaatttttggattatgattttgaaggctcaagattaaacgttctgtgtgaccttttggcttataatacattgtacattcagcagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattacaattcctcgcggaactcgctttttagcatatgcaaaagatacttctgttaatccatataactttgtatctaccgaagatgttattgctattcgtgataaaaataaccaatattttccgcgtttaaaattggctcagggacgtatagtaagaactgaaatcatttatgataaattaacacctattatcatttatgataaaaatattgatagaaaccaggttaaattatacgttgatggagcggaatggattaactggacaagaaagtcaatggttcatgctggttctacatcaacaatttactacatgcgtgaaactattgatggaaacactgaattctattttggcgaaggtgaaatttccgttaatgcttctgaaggagctctaactgctaactatattggaggtcttaaacctacccagaactctacgattgttattgagtacatcagtactaatggtgctgacgcgaacggagcagtcggattttcatacgcagatacattaacaaatataactgtcatcaatattaatgaaaatccaaacggtgacccagattttgttggggcagatggcggcggtgatccagaagatattgagcgtattcgcgaattgggtactattaaacgcgaaacccagcaacgctgcgtaactgcgactgactatgatacattcgtttcagagagatttggttctattattcaagcagttcagactttcactgattctactaaacctggttatgcatttattgctgctaaacctaaatcaggtctgtatttaactactgtacagcgcgaagatattaaaaattatctcaaagactataatttagctcctattacgccatcaattatttctcctaattatctttttattaagactaatttaaaagtcacatatgctttaaataagctgcaagaatccgaacagtggctcgaaggtcaaataattgataaaattgatcgttattataccgaagacgtagaaatttttaattcatctttcgctaaatctaagatgttgacatatgtagatgatgcagatcattctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgatgttcgtatagtatcaacagaccgagattctaaaggaattggtaaagttattattggtccatttgcttctggcgatgttacagaaaatgaaaacattcagccatatacaggcaatgattttaataaattagcaaattctgatggacgcgacaaatactatgttatcggtgaaataaattatccggctgacatgatttattggaatatcgctaaaattaatttaacatctgaaaaatttgaggttcagactattgaattatattctgacccaaccgatgatgttatctttacccgtgatggttcactgattgtatttgaaaatgatttacgtccgcaatacttaactatcgatttggagcctatatcacaatgacagtaaaagcaccttcagtcactagtctcagaatttccaagttatccgcaaatcaggtgcaagtacgctgggatgacgttggtgctaatttctacaaaatagtagaaatcgctgagacaaaaacagactcgggggaaaatctcccgagtgatcaatatcgttggattaatttaggatatacagcaaacaatagtttcttttttgatgatgctgatccactaacatcatacattatcagagtagctacagctgcacaagattttgagcaatctgattggatttataccgaagagtttgaaacttttgctacaaatgcttacacatttcaaaacatgattgaaatgcaattagccaataaattcattcaggaaaaatttactcttaacaattctaattatgtcaattttaataatgacactataatagctgcattgatgaatgaatcgttccaattcagcccatcatatgttgatgtttcatcaatcagtaattttattattggtgaaaatgagtatcatgaaatacaaggttccattcagcaagtatgtaaggatattaaccgagtttatttgatggaatcagaagggattctatatctttttgagcgttatcaacccgtggttaaagtatctaatgataaaggacaaacctggaaagctgtgaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagtaatgcacctatagattctgacccgttatcaccaacatactcggaaagactttttgaacctgatacaatgactataactggaaatcctaaagcagtatgctataaaatggattctatcggtgataaagtttttgctcttattattggtgaagttgaaacattaaatgccaatccgagaacttcaaaaataattgattctgctgataaaggaatatatgttttaaatcatgacgaaaaaacatggaaaagagttttcggtaataccgaagaagaaagaagacgtattcaacctggatacgcaaacatgtcaactgacggtaaattagtttctctgtcttcgagtaattttaaatttttaagtgataatgttgttaatgaccctgaaactatggtgaaatatcagttaatcggtgctgttaaatatgaatttccccgtgaatggttagctgataagcattatcatatgatggcatttatagcggatgaaaaatctgattgggagacttttactcctcaaccaatgaaatactacgcagaaccgttctttaattggtctaaaaaatctaacacacgctgttggataaacaactctaatagagctgtagtagtttatgctgatttaaaatacactaaagttatagaaaatattccggaaacatcaccagatagattagttcatgaatactgggatgatggtgattgtacgatagtaatgccaaatgttaaattcacgggatttaaaaaatatgcgtctgggatgcttttttataaatcttctggtgaaataatttcttactatgattttaactatcgtgtgagagatacagtagaaattatttggaagccgactggagtatttttaaaagcatttttacaaaaccaagagcatgagactccttggtcaccagaagaagagcatggattagctgatcctgatttaagaccattaattggcacaatgatgcctgattcttatttgttgcaggattcgaattttgaggcattttgcgaagcatatattcagtatctttctgatggatatggaactcagtataacaatttacgaaatttaattcgtaaccaatatccacgagaagagcatgcgtgggaatatttgtggtcagagatatataaaagaaacatttatttaaatgctgataaacgtgatgctgttgcgagattctttgaatcacgtagctatgatttttattctactaaaggaattgaagcatcatacaagtttctttttaaagttctttataatgaagaagttgaaattgaaattgaatctggggccggtactgaatatgacataatcgttcaatctgattctttgactgaagatttagtaggacaaacgatttatacggcaacaggaagatgtaatgttacttatatagaaagaagttattctaatggtaaattgcaatggaccgtaactattcataatcttttgggaagattaattgctggtcaagaagttaaagcagaaagactccctagttttgaaggcgaaattattcgtggagttaaaggaaaggatttgcttcaaaacaatatagactatattaatagaagtagatcatactatgtaatgaaaattaaatccaatttaccttcttcccgctggaaatctgacgttattcgttttgttcatccagtaggatttggatttatagcaattacccttttaacgatgtttattaatgttggtttaactcttaaacacacagagacaataattaataaatataaaaactataaatgggattctggattgcctactgaatatgctgatagagtagctaaattaactccaaccggtgaaattgagcatgattcagtaacaggcgaagcaatttatgagcctggcccaatggctggtgtagaatatcctcttcctgatgactataatgctgaaaataataattcaatatttcaaggtcaattgccgtctgaacgacgtaaattaatgagtcctttatttgatgcatctggaacaacatttgcgcaatttagagatttagttaataaacgtctaaaagataatataggaaatccaagagaccctgaaaaatccaacacaggttaaaatagatgaatgattcaagtgttatctatcgtgcgatagttacttcaaaatttagaacagaaaaaatgttgaatttttataattcaattggaagtggtccggataaaaacactatctttatcacatttggaagatcagaaccgtggtcatcaaatgaaaatgaggtgggctttgccccaccttatccaaccgattctgtattaggcgtaactgacatgtggacgcatatgatgggaacagtaaaggttcttccatcaatgcttgacgcagttattcctcgtcgagattggggagatactagatatccggatccatacacatttagaattaacgatattgtagtgtgtaactcagctccttacaacgctactgaatcaggcgcaggctggttagtatatcgttgtttagatgttcctgatactggaatgtgttcaattgcatctttaactgataaggatgaatgccttaaattaggcggaaaatggacaccttctgttaggtcaatgactcctcctgaaggtcgaggagatgctgaaggaacaattgaacctggggacgggtatgtatgggaatatctttttgagattccacccgatgtatctataaatagatgcacgaatgaatatattgtggttccttggcctgaggaattaaaagaagacccgactagatggggatatgaagataatctcacttggcaacaagatgattttggattaatttaccgggttaaggcaaatactatccgttttaaagcatatttagattcagtttattttcctgatgctgcattgccaggaaataaaggatttagacaaatatcaataatcacgaatcctcttgaagctaaagctcatccaaatgacccaaacgttaaagctgaaaaggattattatgacccagaagatttaatgaggcattcgggcgaaatgatttatatggaaaataggccacctattattatggcaatggatcaaacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcagcgtaaaatggcagtagcaaatggcactggagcagatggtcaaattatccatgctactgggtattatcaaaaacactctattacagagtacgcaactccagtgaaagttggcactagacatgatattgatacctctactgtaggtgttaaagttattattgaaagaggcgaactcggcgattgtgttgaattcattaactctaatggatcaatatcagttactaatcctttaacaattcaagctattgattcaattaaaggtgtttcaggtaatttagtagtaactagcccatatagtaaagtaactttacgctgtatttcatctgataattctacatcggtttggaattattctattgaaagtatgtttggacaaaaggaatcaccagctgaaggtacatggaatatttctacatccggatcagttgatattccactatttcatcgcactgaatacaatatggctaaattgttagttacgtgccaatcggtagatggaagaaaaattaaaacggcagaaataaatattcttgtagatgctgttaattcagaagtcatttcttctgaatatgctgtcatgcgagttgggaatgaaactgaagaagacgaaatcgctaatattgcatttagtattaaaacaaattatgtaacagcgactataagttcttcaactgtcggtatgagagcagcagttaaagttatcgctacgcagaaaatcggggtggctcaataatgaaacaaaatattaatatcggtaatgttgtagatgatggtaccggtgactacctgcgtaaaggtggtataaaaataaatgaaaactttgatgagctttattacgagcttggtgatggagatgttccatattcagccggtgcctggaaaacttataatgcttcatcaggacaaacattaacagcagaatggggaaaatcatatgctattaacacttcatctggaagagtaactctacaacttcctaaaggaaccgttaatgattataataaagtaattaaagctagggatgtatttgcaacatggaatgttaatccagttactctagtagccgcttctggtgatactattaaaggatcatcgtcatcagttgaaattaatgttcaatttagcgatttagagttagtttattgtgctccaggacgttgggaatatgtcaaaaacaaacaaattgataaaattattagttcagatattagtaatgtagctcgcaaagaatttttagtagaagttcaaggacaaactgactttttagatgttttccatggaactagttataatgtcaataacatcagagtaaaacaccgcggtaacgaattatattacggcgatgtatttagtgaaaacagtgactttggctctccgggggaaaatgaaggagaattaattcctcttgatggatttaatattaggttaagacagccttgtaatattggcgacactgttcaaattgaaacgtttatggatggtgtatcacaatggagaagttcatatacaagacgccaaataaaagtgctagattcaaaactaacatcaaagacttctttagaaggaagcatttatgttactgatttatcggcgatgaaatcaattccattttcagcttttggattaattcctggcgaacccattaatcctaattctcttgaggttcgttttaatggaattttacagcaacaggctggaacagctgggtatcctctgtttttgtgcgaaggcgctaattcagatacgcaagaaggatgtatatctcttggtggcgaatggaaagaatcaaacacagattattctatagaatatgaagatggaaaacctgtcagtcttttatttgatagaaaatttgaatcaggtgatataatcgttataacatggtttaataatgatttaggaactcttttagaaaaagatgacattattgaattaactgatgaccgttatgttagtaaaggatcatctactgaagttactggggatgtagccttaacagattttgataaaatcggttggccaaatgttgaaaaagttgattcttatactagaacgtataattcaatatcatctattttcgacagcatttatcctgttggttcaatttatgaaaatgctataaacccaaataatccggtgacttatatgggatttggttcatggaaattatttggtaaaggacaagttttagtaggatggaatgatgatgttacggatccaaactttgctttaaacaataatgatttagattctagcggaaatccttcacatactgccggtggaacagttggtacaacatcagtaacgcttgaaaacgcaaatcttcctgcgactaaaactgatgaaagagttttaattgaagacgaaaatggatcagttattattggaggatgtcaatatgacccagacgaaactggtcctatatatacaaaatatcgtgaagactacgcaacaacaaactcttcacacactcctcctactaatattagtaatattcaaccgtctattactgtataccgttggataaggattgcataatgagtttacttaataataaagcgggagttatttcccgcttagcagattttcttggttttagaactaagaaaaatgatatttcggttatgaataatcagccggtaggcgctgtaacaatttcacaaatagcaaaaggtttttatgactcaaatgtagaatctgctatcaatgatgttagaaatatggcagagcaacaggttggagctgtattaattaatataagcggcgtatctcctactggcgtgcaacaaaccgactattggtcatttgaaggaactgttactgatacttcagccaaaccaggtgacccagttattgttaacatgtttggtattccagttaaagctactaatggaatgacttcaattgaatttactagtgctgttagaacagctctacaggaaatggttgtaaaatttattgcaattgattcatttgaagaccatcctaccatagggaataaaatacaagttaagtatttagataaccaagaacatatcttagaacaatactctgataaaggaattactttcaaacaagaaataatttctccttctaaacccgggtatggaacttggcaattattaggtgcgcaaactgttacgctagatagtcacacacaacctacagtattttattattttgagagaatagcatgagtaacaatacatatcagcacgtatcaaatgaatcaaaatatgttaaattcgatcctactggatcgaattttcctggcactgttacgacagtacagtctgcattatcaaaaataagtaatatcggcgtaaatggtattcctgatgcaactatggaagttaaaggaatagcaatgattgcatcagagcaagaggttttagatggaacaaataattctaaaatcgttacaccagctacattagcaacaagattattgtatccaaatgctactgaaactaaatatggtttaacgcgctattcaacaaatgaagaaacattagaaggctcagataataattcatcaataacgccgcaaaaactgaaataccatactgatgatgtgttccgaaatagatattcatctgagtcatcaaacggggttattaaaatatcatctacgcctgcggctttggctggtgttgatgatactacggcgatgactccgctaaaaacccaaaaactcgcaataaaattaatttcacaaatagctccttccgaagatactgcatcagaatctgtgagaggtgtggttcaattatcaactgttgcgcaaactcgtcaaggaactctccgcgaaggatatgcaatttctccgtatacctttatgaattctgttgcaacacaagaatataagggtgttatacgtttaggaacacaatcggaaattaacagtaatttaggagatgttgcagtaacaggtgaaacactaaatggtcgaggagctactggttctatgcgtggagtagttaaattaacgacgcaagccggtattgcccctgaaggtgatagttctggagcattagcgtggaacgcagatgtaattaatacgcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggcgattggaataatcctggcgttcctgatatgcggggtcttttcgtcagaggagctggcacaggcggtcatattttaaatcaacgaggacaagatggttatggaaaggatagacttggcgtaggatgtgacggaatgcatgttggtggtgttcaagcacaacaaatgtcataccataaacacgccggtggttggggggaatatagcagaagtgaaggcccatttggcgcgtctgtttatcaaggatatcttggaattagaaaatatgccgactgggataatgcttcatacttcactaatgatggatttgaattaggcggaccgagagatgcccttggtacacttaatcgtgaaggattaattggttatgaaactagaccatggaatatatcattaaactatattattaaagttcattactaaggattacaaatgattgaattaaaagatttaccttttgttgatagcgttcctgatgaaggtcaggaacgtatttcatggattaaaaatggtgaagaaatactaggagctagcactaagtatggaaacgatggatcaatgaatagaccaattgtttccgtgtttaaaaatgttgaggttcttgacgaaaatataggaattcttaaaactgccattgaaacatcgcagaaagatattaaaacaattcaaggagttttagatgtatcaggagatatagaagcactatcgcagatcagtgttaataaaaatgacatatcaaatttaaagacacttactaatgaacacactgatatattaactggaactaataatacagttgacaaaattattgctgatataggtccatttaatgatgaagaaaactctgtttatagaacaattagaaatgatttattgtggattaaacaagaactagggcaatattctggccaagacattaacggtcttcctgttgttggtaatgctagcacaggaatgaaacatagaataataacaaatagtacattattatcttcacaaggcattcgtttaagtgaattagaaaataaatttactgaatctgacgtaggatcattgacggttgaagttggtaaattacgcgatgaacttggtaataaaccagtagattttggaccaaatatttataatagattaaacactatagatgataaacaaactttaataaattctgatatagcagaaattaaatcttctattggatacccagaaaatgtttctataataacagaaattaataataacaaaagtagcattgaatctattaataatgaattaaatcagagtgaaggtgttaaacagcgcttaacggctattgaaacttctataggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctataaaaacgaatgaaactaacattgcggcagtcacgcatgaagtaaatacagctaaagacaatatatcctctttacagagcagcgttcaagctctacaagaagcgggttatattcctgaagctccaaaagatggccaagcttacgttcgtaaagacggcgaatgggtactactttctacctttttatcaccagcataacatggggccgcaaggccccaaaggattttaaatgtcaggatataattctcagaatccaaaggaactcaaagatgtcattctaagacgtttaggggctccaattattaatgttgagttaacacccgatcaaatttatgattgtatccagcgtgccctagaattatacggtgaataccattttgatggacttaacaaaggttttcatgtattttatgtaggagatgacgaagaaaaatataaaactggagtcttcgatttaagaggttcaaatgtattcgcagtaactcgcattttgcgaacaaatattggatcaataacgtcaatggacggaaacgctacatatccatggtttactgattttcttttaggaatggctggtattaatggcggtatggggacttcttgtaatagattttatggaccaaatgcctttggagctgatttaggatattttacccagcttaccagttacatgggaatgatgcaagatatgctctctcctattccagacttttggtttaattcagcaaatgaacagctcaaagtcatgggaaacttccaaaaatatgatttaattatcgtagaaagctggactaaatcatacattgatactaataaaatggttggaaatacagtaggatatggaacagtcggtccacaagatagctggtcattatctgaacgatataataacccagaccacaatttagttggtcgtgttgttggtcaagacccaaatgttaaacagggtgcttataataatcgttgggtgaaagactatgctactgctttagctaaagaattgaatggtcaaattttagcacgccaccaaggtatgatgcttcctggcggtgttacgattgatggacaacgcttaatagaagaagctcgattagaaaaagaagcattacgtgaagaattatacttgctcgatcctccatttggaattttggtaggttaatatggctacttatgataaaaatctttttgctaaattggaaaaccgcactggttattctcagaccaatgaaactgaaatactaaatccttatgtaaatttcaatcattataaaaacagtcaaatattagctgatgtattagtagctgaaagcattcaaatgcgaggtgtagaatgctattatgttccaagagagtatgtttcccctgatttgatatttggcgaagacttaaaaaataaatttactaaagcttggaaattcgctgcatatttaaattcatttgaaggatatgaaggagctaaatcgttctttagtaactttggtatgcaagtacaggatgaagttactttgtccattaatccaaacttgtttaaacaccaagttaatggaaaagaaccgaaagaaggcgatttgatatattttcctatggataacagcttatttgaaattaactgggttgaaccatatgatccattttatcaattaggtcaaaacgctattcgtaaaattacagcaggtaaattcatttattctggagaagaaattaatccagttctacagaaaaatgaaggaattaacattccagaatttagtgaattagaactaaatcctgttcgcaatcttaacggtattcatgatattaatattgatcaatatgctgaagtagatcaaattaattctgaagctaaagaatatgttgaaccttatgttgttgtcaataacagaggcaaatcttttgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcgataaattcacaagaagatgtggccaaggttgaaactattctacctcgtataaatttgcatttagttgattttagctataacgctccatttaaaacaaacattttaaatcagaatttactgcaaaaaggtacaacttctgtagtatcgcagtataatccatctcctattaaaatgatttatgaattgagtatctttactcgttacgaagacgatatgtttcaaatagttgaacagattcttccatattttcaacctcattttaatacaactatgtacgaacagtttggaaatgatattccatttaaaagggatattaaaattgtactgatgtctgctgctatagatgaagctatagatggagataatttatctcgtcgtagaatcgaatggtcactaacatttgaagtaaacggatggatgtatcctccagtagatgatgcagaaggattaattcgtactacttatacagattttcacgccaatacaagagatttgcctgatggcgaaggtgtttttgaatctgttgatagcgaagttgttcctcgagatattaacccagaggactgggatggaacagtaaaacaaactttcactagcaatgtaaatagaccaacaccgccagaacctcctggcccaagaacatagaggttattatggaaggtcttgatataaacaaacttttagatatttctgacctccccggaatcgacggggaggaaattaaagtatatgaacctctacaattagtagaagttaaaagcaatcctcaaaaccgtactcctgacttagaagatgattatggagtagttcgtcgaaatatgcattttcaacaacaaatgctaatggacgcagccaagatttttcttgagacggcaaagaatgctgattctcctcgtcacatggaagtatttgcaactcttatggggcaaatgactacgacgaacagagaaatactgaagcttcataaagatatgaaagatattacatctgagcaggttggcactaaaggcgctgttcctacaggtcaaatgaatattcagaacgcgacagtattcatgggttcaccaacagaattaatggacgaaattggtgatgcttacgaggctcaagaagctcgtgagaaggtgataaatggaacaaccgattaatgcattaaatgatttccatccattaaatgaagctggaaaaattttaataaaacacccaagcttagcagaaagaaaagatgaagatggaattcattggataaaatcacagtgggatggaaaatggtatcctgaaaaattcagtgattatcttcgtttacacaaaatagtaaaaatcccaaataattctgataagcctgaattatttcaaacttataaagataagaataataaaagatctcggtatatgggtcttcctaacttaaaacgagctaatattaaaacacaatggactcgtgaaatggttgaggaatggaaaaaatgccgagatgatattgtatattttgcagaaacatactgcgccattactcatatcgactatggtgtcataaaggttcaattacgtgactatcagcgtgatatgctcaaaataatgtcatctaaacgtatgactgtttgtaatctatcacgtcagcttggtaaaacaactgtagtagctatttttcttgcacactttgtatgttttaacaaggataaagctgtaggtattcttgcgcacaaaggctcaatgtctgcggaagttttagaccgtactaagcaagcaattgaactgcttcctgactttttacagcctggtatagttgaatggaataaagggtctattgaactagataatggttcttcaattggcgcttatgcttcctctcctgacgcagttcgtggtaactcattcgcaatgatttatattgacgaatgtgcatttattccaaacttccatgattcctggcttgctattcaaccagtaatttcatctggtcgtcgttcaaaaattattattactacgactcctaatggattaaatcatttttatgatatttggactgctgctgttgaaggtaaatcaggatttgaaccatacactgctatttggaattcagttaaagaacgtctttataatgatgaagatatttttgacgatggatggcaatggagcatacaaaccattaatggttctactttagcacaattccgtcaagaacataccgcagcgtttgaagggacttctggtacattaatttcaggaatgaaattggctgttatggatttcattgaagtaactccagatgatcatggttttcatcgatttaaaggacctgaaccagatagaaaatacattgcaactttagactgttcagaaggtcgtgggcaagattaccacgctttacatattattgatgttaccgatgatgtgtgggaacaggttggtgttttacattcaaataccatttctcatttaattctgcctgacatcgttatgcgttatttagtagaatataatgaatgcccagtttatattgaattaaatagtactggtgtgtcagttgcgaaatcactttacatggatttagaatacgaaggcgttatttgcgattcatatactgatttaggaatgaagcaaactaaacgaacgaaagcagtaggatgctctacattaaaagaccttattgaaaaagataagcttattattcatcaccgtgcaactattcaagaatttagaacgtttagtgaaaaaggcgtgtcttgggcggctgaagaaggttatcatgacgatttagtaatgtctttagtaatttttggatggttatcaacacaatcaaaatttattgattatgccgacaaagatgacatgcgattagcatctgaagtgttttcaaaagagcttcaagatatgggggatgaatacgctccagttatatttgttgattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaacgaagtagatttagttaatacttttggtcaacctacagctgaaactgctgactattttatgtctgcaatgaatttcttacaatatggaaatgatttgcgagttgtgcgcgctgtcgatagagataccgctaaaaactcatctccgattgctggtaatattgaatacacaatttctaccccaggtagtaactacgcggttggagataaaatcacggtcaaatatgtttcagaagatgttgaaacagaaggtaaaattaccgaagtagatgctgatggaaaaattaagaaaattaatattcctactgcaaaaattattgctaaagctaaagaagttggcgaatacccaacattaggttctaactggactgcagaaatttcttcatcttcttccggtttagctgcagtaataactcttggaaaaattattactgattccggtattttattagctgaaatcgagagcgctgaaactgctatgacagcagttgattttcaggcaaatcttgaaaaatatggaattccaggagtagtagctctctatccaggcgaattaggcgataaaattgaaattgaaatcgtatctaaagctgactatgcgaaaggcgcttctgcattactgccaatttatccaggtggtggtactcgtgcatctactgccaaggcagtatttggatatgggccgcagactgactcacagtacgctattatagttcgtcgaaatgatgctattgttcaaagcgttgttctttcaactaagcgtggtgaaaaagatatttacgatagtaacatctatattgatgactttttcgcaaaaggtggttcagaatatattttcgcaactgcgcaaaactggccagaaggcttctctggaattttaactctgtctggtggattatcatcaaatgctgaagtaacagcaggagatttgatggaagcttgggacttctttgctgaccgcgaatctgttgacgttcagttgtttattgcgggttcttgtgccggtgaatctcttgaaacagcatctactgtccaaaaacatgttgtttcaattggtgatgctcgtcaagattgcttagtattgtgctcacctccgcgtgaaactgtagttggaattcctgtaactcgtgcagtagataatttagttaactggagaactgcagcaggttcatacactgataataactttaatatcagttcaacctacgcagcaattgatggtaactacaaatatcagtatgacaaatataatgatgtgaatcgttgggttccattagcagctgatattgctggtttatgcgcaagaactgataacgtatctcagacttggatgtctccagctggttataatcgtggccagattcttaacgttattaaacttgctattgaaactcgccaagctcagcgcgaccgtttataccaagaagctattaatccagtaactggtacaggtggcgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccaatacttacagggaattaaagctctcggtggaatttatgaatatcgtgtagtttgcgatacaacaaataacactccgtcagtaattgatagaaatgagtttgttgcaacattctacattcaaccggctagaagcattaactacattaccttgaacttcgtagcaactgctactggtgcagatttcgatgagttaactggtcttgctggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagtcggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagagcgctattgttcgtcaatatgctcgtgatgctaaaacagtaacaaaagaaattgaaattaaaggtctgtggcctactaacgtgggtgaacttcaattagattgggattcaaacaatgaaatccaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtagataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggtgctgataatactggcaatatggaagatattcgttggtttagacaagctctttacatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccacttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtaccaatgcttgaatctcatgatggaaaagacttaggtttaaaaccgggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccacggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgaacacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgccgcaggtcagacttctggcgcagtaactcagattggaccagctgttatgggtatggtacgtcgtgctattcctaacctgattgctttcgatatttgtggtgttcagccaatgaacagcccgactggccaggtattcgcgctgcgcgcagtatatggtaaagatccaatcgcttccggcgctaaagaagcattccacccaatgtatggtccagatgcaatgttctctggtcagggtgctgctaagaaattcgctgctttgaaagcaagtgatactcttgaagtcggaactatttacactcacttcttccaggaaactggtacagtatatctgcaagctacagcagctaaacaaattgattcaggcgcatctgacgcagacaaattagatgctgaaattaagaaacaaatggaagctggtgtactggtagaaatcgctgaaggtatggctacttctatcgctgaacttcaggaaggtttcaacggttctaccgataacccatggaatgaaatgggcttccgtatcgataaacaagttatcgaagctaaatctcgtcagctgaaagctgcttactctattgaattagcacaagaccttcgcgctgttcacggtatggatgctgatgctgaactgtctggtattctggctaccgaaattatgctggaaatcaaccgcgaagttgttgattggattaactactccgctcaggttggtaaatctggtatgaccctgactccgggttctaaagctggtgtatttgacttccaggacccaatcgatattcgtggtgctcgctgggcaggtgaatcctttaaagctctgttgttccagattgacaaagaagcagttgaaattgctcgtcagactggtcgcggcgaaggtaacttcattatcgcttcccgtaacgtagttaacgttctggcttcagttgataccggcatttcttatgctgcacaaggtctggctactggctttaacactgatactaccaagtcagtatttgctggtgttctgggtggtaaataccgtgtatatatcgaccagtatgctaaacaggattatttcaccgtaggttataaaggtccgaacgaaatggatgctggtatttactatgctccatatgtagctctgactccgctgcgtggttctgatccgaagaacttccaaccggtaatgggattcaaaactcgttacggtatcggtatcaacccatttgcagaatccgctgctcaggctccggcttctcgcatccagagcggtatgccttctattctgaatagccttggtaaaaacgcttacttccgccgtgtatatgttaaaggtatctaatctttgacgatttaagggaccttcgggtccctttagttgtttttatggtataaataaatcatataaactgaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaattggtgctacttacgccggcgaagctggatatgtagaccgagaacaaatcacagaattaacagaagagtctaaattaactctcaataagggcgatttattcaaatataataatatcgtttataaagtattagaagatacaccatttgctgatattgaagaaagcgatttagaattagctcttcagattgcaattgttcttttaaaggttcgtctattttctgacgcagcgtcaacaagcaaatttgaaagctctgatagtgaaattgcggatgctagattccagattaataaatggcaaaccgcagttaaatctcgtaaacttaaaactggtatcacagttgaattagcacaagatttagaagcaaatggattcgatgctcctaatttcttggaagatttgcttgcaactgaaatggcagatgaaatcaataaagatattctgcagtctttgattacagtatcaaaacgttataaagttacaggaattactgatactggattcattgatttgagttatgcatctgcacctgaagctggtcgttcattataccgaatggtatgtgaaatggtttcgcatatccaaaaagaatcaacttatacggcaacgttctgtgttgcttcagctcgtgccgctgcgattcttgctgcatctggttggttaaaacataaaccagaagatgataagtatctttcacaaaatgcctacgggttcttagctaatggtttaccgctttattgcgatactaacagcccattagattatgtaatcgttggcgtagtagaaaatatcggtgaaaaagaaattgttggatcaattttctatgctccgtatacagaaggtctcgacttagatgaccctgaacatgtaggtgcatttaaagttgttgttgatccagaaagcttgcaaccgtctatcggtttattagttagatatgctttatctgcaaatccttacaccgtagcaaaagatgaaaaagaagcaagagtaattgatggtggagacatggataaaatggcgggccgttcagatttgtctgttttattaggtgttaaattaccaaaaattatcattgatgaataaaacaaagggaccgaaaggtccctttttatttagctcaccaactcaatccaagccggacgaagtacatcttgtaccattttaactaattcctttttaatcaaagaaggattatctgcttgagttaaagtaataccttcacgagaagtttcttccaaaatatcttgaacagttagccccattacctttccaaaatcttttggaccaatttcgccaattttggaaataacgttatttactcggttcaatgtaacataacaagctaaaattccaaccaatttattatcagcttctgacaattcaactttagctttaataggcttatcagactttttcttttcactaaatttagaattcttgcatttgatggctacacgatttccattatgaagccaagaaggataacaaggtttcaatacatatccttcagcggtaaatacttcgcctttggcttcagctttccaaacacatttgttagcgtcaattaaacctgcattatctacggtaaaattataagacggaacaacagaatccaaatcatttggaagtttaataagatcttcaaatttaccacgacccaaaagtggagcgattttaaacccaaatgaattacaaaacgattccatcatgtaatcatcaacataagttacatcaccactttcggtagtaacaataatatcaaacacgtaaaaatctttattaccataatcaacatttttctgaataccaggaccagcaaattcgccaaatacctgataagtcacaacagctgaagtttccataatatcttgtactgctttaatggaatcagcgtaattctttagaataatttcatacccaaagaaatcttcagcaggaagaatcggtccagtacgtttagcgcaagttactttatcacgctcaataatcaatgagaaatttgtgccgtgaatcttttcacgagctacccattcgccgccagtcaatcctaagctataaagtttttcaataaatttagagttgtaatgattttcaagactgctatactttttaaacataattaatcctcaaaatgtaatttctaaccaatcaccatcacgctgatcactattaactttaaagatgaatccttcttttctcagccaatcaccaatttcttcagtaatcaatttatcacgagcagtacaataataactaaaatatgttttaccttgttcagctgctttattagcaagttccgaaaaatctttaataaaacactctagtttaaactgtttgcttttaagtgctttttcgcgtaatcgattagcaaaagattcattttcataaagatcatactgttccatttttcacctttttattgatatgtctttttctatagacaactttttctcgagtttcaaatttattcttagcagtcatagctcgagcccataatacagccacttcttttgcctgtaagttcaattcacgagcaatttcaatgaatgactttccagactcatgaagagtaaacaccacaacctcagttctcataatcaatctcatgttatcgagttggtgccattatatacatcattttctgattgtgttttgtgtgctttcaaaatgaagaaaggggccgaagccccttatgattatggataggtatagatgataccagtttctaaagcagttttatgaatgatgtatccattacgtgattcttgaacatcaacttctggatagtctttcatcatcttctggagagtgtaacgatgcaagtagtacttactatctggatcgtcagttttccaatctttaccttcttcggtcattttttggatttcatccataacccaccaaccacaccagatgtaagctgaagtacgatgtggaagaggatgaacataaggtaattcaccttctggttctggagcaactttatcagttacctgaacttgaccttctgctgtaatagttttgctatcatagtcagtagcagtaacagttgcagtaacttcaatagtttgacttccaatagatgaggtatcaactgtatacacattagtcgatccttctacaggagaagagtctttcttccatgaataagtaatttgcgcttcttctggagcatcagtgacattagcagtaaatgtagccgaagcatcttgttgaacgttaatagaaggaggagtcaatgtaacctgtggattcattgtcttcttattaactgttaatgatacttcattcgaagtaacttccttttcattgtaattttcagcagttacttgggctacgcatttaattctttttactccacttgtagttggagtatagctaaatgtagagttagtttctccaccaacttgtgaatcatctacataccactgatacgtagcagatgctccatcaggttgagaaactaaggcagcagtaaattgaactggtgttccaattactccagctgaaggactatcgggagttactgccaaagtagttgtctgtgtctttttattaacagtcaatgacacttcattagaagtaacttcttttgcatcataatctgtcgcggttacttgagccacacacttaattctttttaccccgctttcggcaggagtgtaattgaacgtagcgttagttgcttcgcccacaggagaatcatctacataccattgataagtagcgtttgcgcccgatggctgcgaagctaaagcggcagtaaattcaatagctgttccgattactccagcgtcagggctattaggagttacagctaaggtagtcgtttgtgtcttattttgaactgtgatagttgtcgcttcagccgtttccgggcctccttcagaaagtgtatttgttgcaactactttaatagttttctggcctgcaggtccttttagtacataactaaaagttgcttcagctccatcttgtggagcatcatctacagtccaagcataggtaatagttccgcctccagtttcaccactgggtgtagcagtaaactgctgagtctgatcgatcacccctgtaggtgttttaggagttatatcaactgtaaaagccataagttatccttaaatccctaacaactcattaagtttgttcaactcatcatcccctatgtaagaagaaacaatacctgtgacaattgcaatcccccagaaaccaagaggcacaccaacaataaaactaaacattaatgccacaatttttgccacacctacatcgaccgcacttttctccagcgtgacaaacaaaggtcgccagttaccagtttctattgcatttttaaaatcagaaccaacatcatatagaaaagatactcgactagtgattttaagcgactttgatatcttcgttaaattcttagataactcatcataattaacagactctaacgcattaaaaatagcatcccgatcaaccttactgattttcttatccagtacatttttatacttttcaaatgcagcaagagcttcatcaacactactaaatttactacccttcgccttttcagctaaatcctgagctattctggaatatttttccccatattgttcggttatatattgataaaacccaaccatagtatcaacagagtcttttacctgactcttctcaagagcatccttagcttcttttaattttatctcagcattctgaacatctgtttttttagcatctctaatgctaacagcagaattaagagcattcgtcactgacgaatattcattcttcttatcctgcaattgtctctccagttttttctgaacatcacgccatccaggaaatccggtaaccttcacatcaacacttttttgagcgttttcaagctcccctgcaactctggaaacaatcgcttgcttactctgtacatcgctttcggccttcgccagttcagctttagcctcagccagcttcttctctgccacttccacagcccgatgctcttcatcaagagaatcctgtcgatttttctcagcctctgctgcctccgccattgctaacaaatgcgcggtttcagcctgttggcgggcaatctcatcacgttggcgttctgcttcccggagcgctttttctgctgcttcagcttcttcacgggctttttgctctgccttcgcaaggcgcaaacgctcagcctctgcctgcattgccatattattggcatgagcaaggtcagttactgatggactacgagcggcattagcacgtaaagcgtcattaacaatatccttgagacgttgagtcagggcatcacgctgagatttcgcttttgccaatgctgcctcagccgcagcagcacgggcagcctgttcagcctgatgttttttcaactgcgcggtagaccatttagcggttgcatgtatcgcagcagaactttcactggccccaccaaatgctccaccgcctccaccaacattttcagttccagttgcaagcgtcgctgtaatcgtatcgccagtatcaaccccaacagttgggaatgacccctcagtagattctgtgctctccacatctggagaattatcagtgactttatccatatatatttacctcctcgtactttattttaatgttacgaaagaagagttgcgtgtttcacgaattaaaactgatccgtcacggttaatgtaataaattaagctaaataaagtttggtgtgctgacgcatgttcaaaactagttgggtgagatttccaatccggagtttcagcgatccattgataaatccaccaaggaacagtacagaatcctggattttttccaatcaactgaagattcgggctaaagttttccggaagagtaaatacagacggcttttcagattcaataatctcagctacagcctgttcgaatttttcttcaacaaaaggagtatcttcaatcaaaacatcggtattttcaggaattttatccgtttctactacttcaattttaatgtcagatttaactggagaatcaatcaaaagtgctgcttctggattgacttcttcatcgtcatattttaatccctctgcagcatcagcagcatcaattaagtctttaatagataacccatcagtctctggcataggttcactagcgagcttctggagggcttcttcaatatcaacaacgatattatcaaaagatttattctttttgacctttataccaaactgttcagcatattcagctaatttagctttagcttctttattatcatcaagagccttcagctctgcaatataatctttatctatcataatatttcctcagtataaatatagatatatttattactcggaaaatagtatgtaccactttgtatatgaaacaacaaatctaataaatggtaaaaagtatataggaaaacactctactgatgacttgaatgatggttaccttggttccggtaaggcaattcagcaggctataaagaaatatggtgaaaacaatttctctagaacaatactaaaagagtttaaaacttccgaagaagcgtacatgtatgaagaagaaattataactcctgaactaataaaaagcaaaaattattataatatgaaacctggtggaattggtggaattattatgactacagaggttatagcaaagatgaaagaatcttccgctaaaagatttgaaaactcaccaggcacggtattaggtaaaacttgttacactaatggaactaaaaatatttttattaaacctggagaacttgttccagaaggatttgtaaaagggatggttcatcctaatagaaagtccagaaaaggatgtaaagtcaaaccgactaccacaggaactttttgggtcaataatggcgcaataaataaattaatacaaccagacggtattattcccgacggatttattaaaggtcgtctcatgaaaagagattctaaaggcaaatttagtaaggcataattatggatattaaagtacattttcacgacttcagtcatgtacgcatcgattgtgaagagagcacgttccacgaattaagagatttcttttcgtttgaggccgatggatatagatttaaccctcgcttcagatatggcaactgggatggacgaattcgtcttttagattataatcgccttcttccattcggtttagtcgggcaaattaaaaagttctgcgataactttggctataaagcctggattgacccacagattaacgaaaaagaagaattatcaagaaaagattttgatgaatggctttctaaattagaaatctattcaggaaataaaagaattgaaccgcattggtatcaaaaagatgcagtgttcgaaggattagttaatcgtcgtagaattcttaatcttccaacatccgctggtaaatcgttaattcaagctttgcttgcgcgatattatttggaaaattatgaaggtaaaattcttatcattgttccaacaactgctctaacaactcagatggctgatgacttcgttgactatcgtttattcagtcatgcaatgataaagaaaattggtggcggagcatcaaaagatgataaatataaaaatgatgcaccagtcgttgttggtacatggcaaactgtagtaaaacaaccgaaagaatggttctcacagtttggaatgatgatgaatgatgaatgccatcttgctacaggaaaaagtatttcatctatcatatcaggtttaaataactgcatgttcaaatttggtctatctggttcattacgtgatggcaaagccaatatcatgcagtatgttggaatgtttggtgaaatatttaagccagtaacgacttctaagttaatggaagatggacaagtaactgagctaaaaattaatagtatttttcttcgctatcccgatgagttcactactaaattaaagggaaaaacttatcaagaagaaataaaaattattacggggcttagtaaaagaaataaatggatcgctaaattggctattaagcttgcacaaaaagatgaaaacgcttttgtcatgtttaaacatgtatcacatggtaaagctattttcgatttaattaaaaatgaatacgataaagtttattacgtatcaggggaagttgataccgaaacccgcaatataatgaaaaccttagctgaaaatggtaaaggaataattatagtagctagttatggtgtattttctactggtatttcagttaaaaatctgcatcacgttgttttagcgcacggtgttaaatcaaaaatcattgtattacaaacaatcggtcgtgtattacgtaagcatggttctaaaacaatcgcaacagtctgggacctcatagatgactgtggtgtcaagccaaaatctgctaatactaaaaagaaatatgttcacttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgcgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaaggacatcttcaccacacgggtgatcggccaggatacgaatatcctgacgcttgagattatactttttcattaagaattgaatttccgtttcaaattcttcttcataattaaaagcatcatcaatgctatatctcattattttccagcctcaaatgcccgcatgtcttgaatatgcttaatagcaaatccacgtgatttaatagcatcaagagctccgctacagaaatctaataaaatcccccaatactgcaacgaggtatcaacctttaaaacatccttatcagctgatagaactgtcttcatttctgatttctcgtaacgatccatactaaattcatcaccatctcctcgtcccgagtagtagtctaatttagctttaagagcaacttttttctgtgcatcaattctaagcatttcctttttaatacttgaatgcttattaagccatttactatataacatcacattattagctgcttcatactgtaatttagtcgaatctataaacacatctttcttcaattcttcttgaagatcttctaatctcatattgttctctattcaattgttattggatggacttagattcattataccacgtttatacgtgaagcattatactctattactggaagccagttgtagttttatctgctcaatatcatcagggttatcgatgactgaaaagcgtatttctactatcaaagtataatcatcataaaccggtattacattaactgctaatttatcaatacgtggctcatagtttcttactgcgctttcgatattacgctcaaccgtgtcagcagtaagaggagtcatattctcaaaaagttggtcagataaatcgcatccaaattcagggtcaaacggtcttgaaccttttcttgttgtaataattcctaaaagactatttttaattgaccttaatccaagtgatcttgaaacgtctttgttccaatccattttcatctctgggtcaatatcagaataaagcttattaatatttgccattacaatagctcaaagaattctttgagtcctcttattacatgagcgtgagtttttccacactctggacatttaattggaacagccaaataaacagtaggctttaaaagcatatcttttatagctacaatatctgactctgtgatgatagaatataaatcttccagttctttttcatttaagtcttcaactggaatgctttcaccgttagcatgaatcgtttctatacatgatactatcatgtgggctatatttttatcatcaaaaattttagggtaatggaatttaattttaatgtcacccagtgtataccagaggtcttctggtgcatccatttgtgtatgtaatagatttatatgggttggtatttcagttccacaggtgcacttccaggagttttcgtgattaacttctccaagagaatgcgcccataaatgaatcagtaatagttctgattcttggcggtttaaatcttttgcatttgtacagtctttgattagctttttaacaatctcttctactgaaccattctttttagcagtaataagttctagatattctttaagagtaaatgcgcgacagttgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagaacatcggtcaccacaagaacaaaaagaagtaattgctgatttaattgctgattattttggagactatccaaagacttggcaaccatttatatttttgcaggtatttgtaggttcaataggtaaaactaaagtaccggtcacatttgtatgtccaaaatgtaaaaaagaaaagacagttccatttgaaatatatcaaaaagaattaaaggaacctgtttttgatgtagctaatgttaaaattaaattaaagtttccttctgagttttatgaaaataaagcaaagatgattactgaaaatattcattctgttcaagtagatgaaatatggtatgattggaaggaaattagcgagtccagtcaaatagaactagttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgaacgcggattcgtattaaaactgattgagaaggataaacatcaatgagtatgttacaacgtcctggatatccaaatctcagcgttaaattatttgagagttatgacgcttggagtaataatagatttgttgaattagctgctactattaccacattaactatgcgtgactctctttatggtcgaaatgaaggaatgctacaattttatgattctaaaaacattcatacaaaaatggatggaaatgaaataattcaaatttctgtagctaatgcaaacgatattaataatgttaaaacacgaatttatggatgcaaacatttttccgtgtcagtagattcaaaaggcgataacatcattgctattgaattgggaactattcattctatagaaaatcttaaatttggtagaccatttttccctgatgcaggtgaatctataaaagaaatgcttggtgtcatttatcaagaccgcacattattaactccagcaataaatgctataaatgcttatgttcctgatattccatggactagtacatttgaaaattatttgtcctatgtaagagaagttgctctagcggtaggaagcgataagttcgtatttgtatggcaagacatcatgggagttaacatgatggactatgatatgatgataaatcaagaaccatatccaatgattgtaggtgagccaactttaataggtcaattcgtccaagaattgaaatatccattagcatatgattttgtttggttgactaaatcaaacccgcataaacgtgatccaatgaaaaatgctactatctatgctcattcgtttttagattcttcactgccaatgattactacaggaaagggtgaaaactctattgtagtgtcaaggtcaggtgcttattctgaaatgacttatagaaatggctatgaagaagctattcgtcttcaaactatggcgcaatatgatggctatgctaaatgttctactgtcggtaattttaacttgactcctggtgttaaaattatttttaatgatagtaaaaaaaaccaatttaaaacagaattttacgttgatgaagttatccatgaattatcaaataataattcagtaactcatctatatatgttcactaatgcgacgaaactggaaacaatagacccagttaaggttaaaaatgaatttaaatctgatactaccactgaagaaagtagttcttccaataagtaataaagaagtttctattcctaagatgggtcttaaacattataacattttaaaagatgttaaaggtcctgatgaaaatttaaaacttcttattgattctatttgtccgaatttatcaccggcagaagttgatttcgtttctattcatttattggaatttaatggaaagattaaatctcgtaaagaaatagatggttatacttatgatattaatgacgtttatgtatgtcaaagattggaatttcaataccaaggaaatacattttattttagacctcctggaaaatttgaacaatttttaactgtaagcgatatgttatccaaatgcttgcttaaggtcaatgatgaagttaaagaaattaattttcttgagatgccagcatttgttttaaaatgggcaaatgatatttctacaactttagcaattcctggccctaatggtccaataaccggaattggcaatattattggattatttgaatgaaaaagccacaagaaatgcaaacgatgcgtagaaaagttatttcagataataaaccaacacaggaagcggctaaatccgcttctaatactttatctggtcttaatgacatttctacaaaattagatgatgctcaagctgcctctgaattaatagctcagactgttgaagaaaaatcaaatgaaatagttggagcaattgataacgttgaaagcgcagtgagtgatactactgccggttctgagttaattgccgagactgttgaaattggcaataatatcaataaagaaataggcgaatcactcggaagcaaattagataaattaacgagtttattagaacaaaaaattcaaacagctggaattcaacagactggaacgagtttagcagtagtcgaaaatgctattcctgttaaagtcgtcgaggatgatacagctgaatctgtgggtcctttattaccggctcctgaagcagttaataatgatcctgatgctgattttttccctactcctcagccaattgaaccaaaacaagagtctccagaagagaagcaaaaaagagacgcatttaacttaaaattatctcaagctttagataaattaacaaagacagttgatttcggatttaagaaatctatttcaattactgataaaatatctagcatgctatttaagtataccgtcagtgctgctattgaagctgctaaaatggttgcattgataatggctgttgttattggaatagacctgctgatggttcattttaaatactggtcagataaattttcaaaagcctgggatttatttagcactgattttaaaactttctcaagcgaaacaggaacttggggccctttattacaaagcatctttgaatctattgatgaaattaaaaagttctgggaagctggagattggggcggattaacagtagctattgttgaagggcttggaagtgttctttataatttaggagagcttattcaattaggtatggctaaattatctgcagcaattcttcgagtcattcctggcatgaaggatactgctgatgaagtagaaggaagagcactagaaaatttccaaaatactacaaatgcttctcttagcaaagaagaccaagaaaaagttgcaaattatcaatataaaagaatgaatgacgatcttggtccaatagcaaaagggctagacaaaattgcgaactggaaaactcgtgcatctaactggattcgtggtgttgataataaagaagcactaacgactgatgaagagagagcagaggaagaagaaaaattaaagcaactttctccggaggaagctaaaattgctttaatgaaagctaatgaagctcgtgctgctatgaatcgttttgatgaatacgctaattcagctgatatgagtaaagactcaacggttaaatcagttgaagctgcctatgaagaccttaaaaaacgaatggatgacccggatttaaataattcaccggcagttaaaaaagaacttgctgctagattttctaaaattgatgctacttatcaagagctcaagaaaaatcagcctaatgccaaacctcaaacttctgctaaatcgccagaagcaaaacaagtccaggtaatagaaaagaacaaagcacagcaagctcctattcaacaagcatctccttcaatcaataatactaataatgttattaagaaaaatactgtcgttcataatatgacacccgtaacgagcacgactgctcctggtgtatttgatgcgactggagttaattaaggaataatatggcaattgttaaagaaataactgctgatttaattaaaaagtccggtgagaaaatttcagccggacagagtactaaatcagaagtagcaactaaaacatacactgcccagtttccaactgggcgtgctagtggtaatgacactacaggggacttccaggtaacagatctatataagaatggattattatttactgcatacaatatgtcatctagggattctggaagtcttagaacgatgagatctaactactcttcttcatcttcgagtattttacgtacagccagaaacactatcagtaatacagtatcaaaactatcaaatggactaatatcagataataattcaggaacaataagtaaagttcctgttgcaaatattcttttacctagatctaaatctgacgtcgatacgtcatcacatagatttaatgatgttcaagatagtcttattacaaaaggtggaggtactgctactggtgtgctaagcaatatggcttcaaccgcagtatttggagcgctggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatctagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgataaaacacctaatggtaactttaacggattagctattgctccaaatctccctagtacatttactctcgagattactatgagagaaattatcacgttaaaccgtgcttctttatatgcggggactttttaatgtattctttagaggaatttaataatcaagcaataaacgcagatttccaacgtaataatatgttcagctgtgtttttgctacaactccatcaactaaaagctcttcgttgataagttcaattagcaacttttcttataataacttgggcctaaattcagattggttaggattaactcaaggcgatattaatcagggaattactacgctaattacagctggcacacaaaaactgataagaaaatcaggggttagtaaatatcttattggtgccatgagtcaacgtacagttcaaagtttattaggctcatttacagttggtacatatttaattgacttctttaacatggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggcagatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtgatgcaggctggagcagttgatagacaagctgccattgaatggcttgaatctgctactataaatggtattcaaagcgttctcggaaatagtggaggtgttactggactatctaattcgctttcacgacttagtagattagggggaactgcaggaagcatttcaaatattaatactatgacaggaattgtcaattcgcagagtaaaatattaggagcaatataacaatggggacctttcggtccccatatttttatttacggaatgaaatgaaagcagcaactgaagcaactaaactgtcttcaatataaacttcaatttttaccggagcttctgactcaaatttacctgttactacaccctgaaaaatactttcagtctgttctggctttgaaaaattttcagaaggaaaaattccgaactttttatctgttccaaaaattttgataaattcatcgtaaactgcttcattaaaagcattatcagcaggaataatgccttcaactacaagttcttgacctaaaaagcgcaaagaagatttcattttgtgttcctcatgttatgtcagtaagactactataacacaacacgagggacttgtaaactacatcttgaactttttagacattccgttgatgttaaccaaagaagctaagatttgagaaacttcgttttcctcttcttttgattcttctacaaggaattgattaaatccagccattggacgaacttcaccagtttccatcaaatgatcgccatcatatactgattcttctaattgctcagaaggaggaacgattgtaccttcgattagatacttgttataagcagtttctttcataaagtaagtacttactttattaatcttcagtaaaattccacgcggtagaataacttcagcttctgatggaaatcctgataaatgacccggaacgataactttgattcgctcagctcctttaattaccatacccacgctagtttcagcatcttcattagcatatgtagaatgactacccatatgcatcaaatcttctgcatcaacggaaccttctccttcaccagaaaatactgcaccggaatcatctagagccatatagtttttaccatgctcgccgaagatatttggtttaagcgatgtagatacgaagttcttgaaatagaacattttgttttcaatgttatgacgcaaagttttaaaggtaacttcttgtccgcgataaagcgtagttcctggaggaagaactgaacctttagcgaatgcagaatccaacgtctcgatgtgcttaatagctcgttccatatattcttcacgggtagaatctggtttacccaaaaggaacgagttcatttcaacatatgaatctgcacaataatcttcaattacatcagattcggcctgagtcagtccttttggagttacttcagtgcttgcgtattcatatgcctgggcagcagattcattaatcaatttataaatgccattcatgacaaattgaataatagctgtcttttcatctggcgtagctttagaacctttaactaaatcattaataattttcttaataacatcaaagctattagaaatattaatgtcagcaagatcgcttaaaattttatcagttttataatcaaagaattctttattctttaaatattcttgagaaccttgatatgttatatcgctctgcaacttgatagatggatcacgtaaacgtgcatgggccaatgcaatatgatttcggaagttttctagttcataatcgctagatttaaaacgagaagcacttctcataccaccgatagctcctttgctgaagtttgaaccaatctggataacgccagagttcattggtccttctgctttatataccggaactttagattcaaactcttgatatttcttggcagcgaagctatcaccctgtagcgaagcatcgacagtagaatattgagcttgtgctgctaatcgacgactaattttagttttttgaataacagcttgatccgtgcgcttatcattttctaaagcaatagaagcagcaacagcgacagctttaggaacagcattacctgttttaacatctacataaacatcaccgaccttcgattcaacttttgtgaataactcagttgaaataggaggtacacctggaatgtcttctaaattggcatttttacggtaaaccataatatatgcatactttttatcatagtcccagatttcctttaaaagaacatatctacctgctcctttagtacgtactaaacggtcagcaataacttgcatttgacgagcagcgccatttgttttactctttagtacgcggaataagcatgcatcaattttatactgtttcattgtttgaagagcagtatcaaaaacagcgttaatgacgccaattggatttccacccaagtttctaagtttaaccagtgataatttctcgttgacacctatcattacgatatgcatcattttatcgcccggcttaacgtttttatttgtatcacctccagaggtgtatgtacaaaatctaaatccaggaagcacgctttcttcgccggcttgaatagcaaaaatttgaggtattttatgcttaggatttaagttaacaaccggcgccgaagcgccgtcaaataattctgtaataagttccatgatttatccttgaacgaacttgtaaggcatgtttgcaatatctatgcaagacgcaataattccaagagatgattctactttctgtttaacatttgatgaaacaaatgatgcaaagtcaactctatcttctatatcacctgtcattgtaaccaattcaccagtttccattaaatggtctccgtcatagattaccgattcggtgagttcttctgtggtcataacttcagcttgaataagcttgttgttagttttaactgttccatcattgtaagatgcatcggttattttattaactttgaccattaatccacgtggcaaaatgacttccatttcatttgaaggtgctaaacttccaccgggtaaaacaacattgaccttatcagccccagtaataacccatccaattccaactaaattatcgctagaatttactagtccttcatcagttttatcaatagaaacacttagacgcttttcgtctggtaaaacacctacagatgaatcagtcatccaagtaccaaaaatatttggatataatgatgttgacacaaagtttctaaaataaaaaactcgattttttaccattgcttcatatattgaaggtaacattcgttgtgaacgatacaaagtaataccttttggtaatcgttcaccatttttaaaggctgaatctaaattatcaatagctttttctatgtcagatgctgtcaaaatacttgtacgctcatctggattatataatcccaaaagagcattatttatatctacatatcctgaacctacgtattcacgaattccgcgtttttgcgccggtgtgtatttagatgaatctttattttcgactataggatgtaatgaccatccagctgtaagagcatatccacgtaattctcttcgaataatctttgtttttattgcattccaagaattttgtactaactcatttgcagcatcttggtttaaatgcgaatgtttgttaatatttctttcaaaccaagcacctttatatttttctaaagtatcatcgacgatagaagcaatagtttctaaagtttttattgaagtaatagattcttttcgtaatctttctaaagctttattttttatttctgtattaacatcagattctttatcttcaggaattatagaagcttctctgaatgccattccagctgtaacactattaagagcattctctaatgcaaatcctgaagtagaaataacagttaattcgttagcatcggaaattaaaggcgcatcagcgggtttatttaattctgctgctgaagcctcaaatttttgaaacatcggtgtttcaaatctagaagattccaatgactgactttgtgcaattgctctacgggaaattttaactttaacgattacagcttggtcagaacgtttatcattttcttgtgcaatagatgctgcaattgcctcatttttggttacttgagctccggtatctttattgatataaacatcaccgaccttcgattcaactttagtaaagagctcggtactaatttccggaactcctggaatgtcttctagtgatacatttttgcgatgtataagaatatatgcatactttttatcataatcccagagttccttaagaaggacgtatctgccacctgaacgactacggataagtctatcagcaataacttgaatttgtcgagcttgaccagcggttttagacttaagaatacgaagcatacaagcatcaattttatactgacgcattgtttgcattgcaacagtaaaaactgaattgatataattaattgggcttggaccaagaccttttaatttagcaattgaacctttagcggttaatgtaaaaggaacaatatgcatcattttatcgcccatttttaaatcgcgattagtatcacctccagatgtataggtacataaacgaaagcctggttgttcaattgcatcatcaacatgaactgaaaaaatttgcggtattttcttctttggatttaagtttgtaatcggaagagtagtatcttcgtcaaataattctgtaataagttccatcatagcctctctagtgtttattctatttataaaattaaaggcccgaaggcctttagtaatctagtggtaagagagtacgatatatttcaaactttggtcctttttcataggcatcaaatgtttctgtaaatttattataagcgtatgcatctacaaattcgagaatgacttgtgatacagaagtagaaacatctccaccttctttttgagcaatgacaattgtttctaagtaagctttcataaaccagttacctcatgaaaatcaccaaatacatcctcgaatgtattagctttagttttatcttcacgtaaacgaatcgcaatcggaagaaataatttaacgtaatcagtgcggccatcagattttaaccaaccgttgcattcgcactctagaatttttccaatataataattttggttttccataatgcgagtacggtcaagttcatgcgattttacaccggctttatcttttaagcctgaaccagcatttaccttaatttttccacactctgattcaagaataaatccacccgctttagtagggtctttacggtgaggataaattcctacaatttttaaatcaacatcaattacttctttaaatttatagagattttttgaacgagcattttcccacaatccatcggtatttttgagaataataccttcaagaccttggtcaatatactttttataaattaccttagcttcatctaggttatttactacctggttttcaattaaaattactttatcataacctgatgtcatttgttctagtttagaaaaacgtacatcatatttcaaacgaaatgcaggaagaccgtatatttctaccaacgggacataatcccagacctgaaacttcatgcattgagcttctttttcagaaatggttccctttaaagatttattggcgatgccattagatgcagtacgtgattcagctacttcggcgaattctttagctttactaatttcaggataagcatcaaaaagaaaatctaggccttctggctccttttcaacttgctcatggtataccaattcgccatcaattaacacaccttctggatgaatctggcgagcttctgcagtcattttgattaactcttccttaagaagatctaatcctagatattcattaccagctcgtgataaaagacgaacatcatctaattcatcgcctcggacttcagcaaaacaccgagctccatctgcttttaactgcgcaaaggctggaaacttgatattcttattaatgcctttttcatcataagaacttgcaagcatttgaggttgttcaggaattaaacctggccaaactttatttgcaatagatactgaagcaccgcattcaaggtctcgcatcatcacccgacgcaaaacttcaacatcatcttttttaccgtcagtaatatatccagttaattcctcaattgccgcatttccagtcaatttccgagtagctaacgtgaattcaatgaagtcaagcatatcggtaagagtcaacattccaaaactctgggtagcaatacccggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacgtaaatgaaaccttgctctacgcattttttaaaaattcgttcgtctttttgagctcggaattctggattgcatctaaaaaattgatttacgtgaccgtaatcacgtgtagtattaccttcattttcataaatagtgtgaacaacaaacattagaatgctccttggaaaatattatcaccacaagtaggtctattatacaaatactctataccgccgggtttaatatagttccatgtctgaaacggatgcgtctgatatggatgatatagatgattataaggattaaatccaggagttctccaggtagtgttccaaggaaaagaatcgtttttaatcatcttttcaattacatcttttatagctttttcactatcaaaactttctttattttcctttggtgaaaaaagcttattctctacatcgttccatatataaactcgctgagcagtttttggaatactgtcacgctcccctcgagccatccaataaacaggaacatttaatatttcactcgcatgatcgcagtggtgagcgagatcgtcaatataacaaattacgttatatttctcttttgcctttttgaacaactcttcttttgaagaatcatgaccacacatcagtacttctgagaaggcaccaggaaaaagagcattcaaattaaattgacgattcagcagagcgtcaatagaatcacccagtgctgtaacagctacaaaattataatcttcttttaatttgttaattacacacagggcatctttatatggcgacaagtaacgaataaaatctgaacgattgtatttttcaattagcttaacgccaagttcttcatcacaattaaaaagtttaccaggagaaataaatttctcatcctggatcatttttaaaatatgttctaacggaagattatatttctgagcaaaataaggaaggcctgattgccagcttaaacatactccatcaatatcagttaaaatagtaggcttcatagagagtctcttaataggtttaacacatcaataaattcagcttcggttagtattgtatcatcttttgttagaccactagccatgctgtgcttcaaaacttttcctttcgaggcttgtaatgcatcacggaagcccttgttttggatcgctgcttcaaaatatgcatttgtgtataattctttccacgccggggagtatcttgaaaatggaactccaagccagaagagggtcccacggtcctgagctcttgcataagaccttccagcttgttgggcggcaagcccggataacccaaatatacgacgttgttgttcaacatttttcactttgcatccttggaggaatccttcaagacctccaaattgaatgccatccataacgaaaggccaatgggcgaaattacttaatgcacatgatggccacctaaaattgcttctaatctctaactcagacattttcaatgcttataatttcaacatcagcccaatgaccatagcaaggaagacgaaattcaactggccagttagggtccttttctaatataatagactcaacttgcggttcttcatgttcatcagtatacggatttttatctgttactttatatgtgaccttaatgtactgaattccaaaaatcttattaattatattcatactatttcctttaatccgtagataggagataattcatcacccatacgaaggtcttcatttccatctacccaggaaacaatataagcctcttttatttgaataccactccatttaaatggaggtaaaaccttagaaattaatccaggtataccaactccctttaattcaacggtttgacctaaaaagaatttcattaaaacctcatctgaaaaccgtgcgatttaacattaccgccgccaatatcagaaatgttaatttcacgcgcaattgaagggtcaatgtcaatttcgcgattgagtttagtgatagctaaagtatcgcgcccatttacagtacggaactctaaagggcagactacattaacgtagtttttaatcgattcactggtaggttgcaaatgtgcaggaaggtctttaggcgcctttgagaaaactacttcgcagaagtttttacgggtatcaaaataagtagtcataaacataacattttcctcagtaaggggccaaagcccctcatttattttaaatatcaaattcgttaagaactacatcaaagattgcttcaagatgctcaggtttagctctgttactcagaatatgacgaatccaagttttaaccaaaagcttgcgattaacgccattccagcaaggatgagtccctaaatcgcgttcacggaaatcatcatccagagcgattttaaagttggaaccttccatcgtgattgaaaccgtgataccgttttcaaatcgcatataaacgtaattaggagtcatatactgctcaatttcgcatactgatccattttgatgtttccaaaggcaaatagtatcaatagaacctgcaataccattagaaacatatttacgttcaaagttgatgtagttcattttattctccaagatgtttaattgcggtacaggtatataatatcatatcctgtaccaaagtaaacaattattttactactttccaatgctgcatgtcaagtttaccaacttttttcatcttctcaattaagcgttcggcacgttggcgagctgtaacataataccattcacctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagttttaactgcagcgttcagattaatcgttttcattttattctcctttgtttgtgtaagataatactatcacaaaggaaccatactgtaaacaactttatgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcgacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggtttttggatatttaacgaccaggataaccataaacccgtcatcattcacattcaagaggtacaccgtaaaactgccggggtcttaaaactataatgattcgcaaatcattaatcagacagttcgacggctcctcgatttagctcacactaaggcagtgaatctccaataaattacttcaatgttaccacaaagtgacgaactgcttttcgcgcagcagaagccaaaggcttagcatatttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaggtaacgaatttttgtttaatttcttttggctgcttaagacccagagctacaaaaggatgcggaacatttcgaatttgaccaactggaagagaagtcaaatcgccaacttcgcagaaaccttcaggaacatcaggaccgacagagtgaactacacacagttcaggaacttcaccttgaacacgtttaccgataataagtcctgattctgtaacttcttcatcaccggcttgtgcaggttcagaaactaaaataacatattcaccgacagcacgaattggtagctgttgtacttcagacatcgtttttcctttttgttaacagatgaattaataataacaaataattcttaaagcatttatttaccaataaattgaagcaaatgctcaactttcataccattaacggaaatcaatttgtcaatagaaaaacctcgccatgcaccaagctcaacatcaaataccggaatcatgtcagtagattctttccgagtagattcagtcaatttgccagtttgcatggttggcataaagtccgcgtcgcgagtacctttcataacacgaatagtaccgtcagacttttcaaaaactacgtttgaaacacccatggacaatttagttttcaaaatttcacgaattgctactttctgctcagttgtcagtttcatttatttacctattacagttttaatatgagttgttccacgttctttaagggtggaaagtaatttttggcatttttctaaatcagatttccaactatgtggtctatcaatacaaacccagtttgacttataatactgcttccatttagagaaaaaatatttcttatactctacagcaaatgaaatgttctcgttggaataagaactaattgctgtgagctgtaccaaacgaaatttcattattcaccacagaattcgttgatattttcccagtttaacttatttaagtttttcttaggaacattaaacacttcaatacctgcatttcgcagaatatcatcccagccaggtttatttttatcgtatgtttcacaataaaccagctttttaattccagattgagctattgcttttgcacaatctgggcaaggagaaagtgttacatacatagtagcaccttcaattgaagaaccgtttcgtgcagcaaacaaaatcgcatttagttcagcatgaatttcatttttagacgaccattcagagtgcgcgctacgatgttctttcgccaatacaaaacgatcagttgaaccaaacgatacacattcaggcttatgaccttgaatgatagtatgtttaggcttattcagcaaccaaccttgctcagcagcataatcacagcagttcacaccacctgcaggtgaaccattatatccagtagaaataatacgtccattcttttcaattactgctcctactttccaggagcaacattttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcaccagtcatctttttgtgaagctcaaccggatacttcgtcacaataatagcatcatacacagaaggatgaatactattcaccagagtatcattcattaaagttattctaatgaactgtgctgtttcagaatcaagcgctctatgatcgccagtatcattttcaagacaattatcaattatatcagttaaattcatcatagtacgccatacaccctttgtgcttcaactaatccatcaaaatccagtttaagatgcgatatttgatcgccatcacctggattcacaattactaatactgaacgaggagtttcggtaataacacgaaccgacgtttcaggaaatcgttcagaaaccttatttaccaattcttgagcaaatagtttaactttttcttggaattctttaacagtaattggtttttcgcttagcatgttgatcctagctccttactttcaacatttttaactaatttgacagaaactaattcagcatcttgggtaatcattaccggaccttcttcatgctcttcaagatattctagagctttctttttagcttcttccttcgtatcagtttgagcatagatatagaacatacaaccagtaatacctactactttccacttaatttctttatcagttttaatttcaaatttacttacagaatcatctttttgaacttcttcgaaaaaagaatattctaacatataagcaattgaaaataacgggctaactttataggattcacccattacatcaacagctttataccaacaatcatcaatttcacgtttaatgctaataacatttttcgcaggatctatttttactttaaatgaattttccccaataaactgggcaattcgtttattagccccgcaagtttcattaaaaatatctttatatccagctttaaagcgataaaccttatcttcttcaaaccattcgctcatttcaatttcctcatttgttttggtagagctataatatcacaactctaccgtaaagtaaactattaaattgctttgaattctgatgtctgtgattcaaagcgaatgtcgcctttgataactagctcagcatcaagaccaaatacaacaatgatatgcgcggaacctggatacaacgtaatggcaatagaatccacctggtctggaagcaaagcgttcaatacatgagtcacttgagcgtggattcgaagttcagctgcattatcaagcttttcaaacatgttattagcgataatttggctaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccaactaaaccgctatttacaataacaaagcccaagtttcatggtgccaagccattaaaaatctcccgaagcgacttgccagcattcaacaccgatgcggcgccacatttcaactacttgagttcggtcatcaatagctaatttcacatcaaaatgtggtgcgatgtgtttccagaaaatttcttctttaactacatcatctttacgggtatcgccttgttcgcgttgacactgcatgactaatggaacaccagcaatgtcctcaacccatttacgggtcatacgataatatttcgttggatcttcttcggttccactttcacggcctgaaacgactacgatttgataacccataagagcatacatcttggatagttcaacgaccattggattaataatatcgatatcgcatttttcaaggtcataaggaccacgaccattcatttttgctaacgtgccatcaacatcaaaaataactgcttttggtttaccaggagtccctttatataccggaagaccgagatactctcgcatgcttttatacattgagcgtaaaacatcaattggtactgctttagttccgcgttttgagttacgtttaaccaattcagtccaaggaacatcaaacactttatattcaatttgatgcccaagctctttggcaaactcttcccaaaccttacgtcgttcaggattcagattagtatctgaaacaattacacccttcgttgcgtcttggcagagaatcatgttagcaacatcatgctgcatgtaagttacgataccttctttatttttggtatacttgtactcatcgcgttcttcatgtgccataatagattggcgatagtcatcacgattgatattataaaaccctggatttttagcaataaattcacgagcccaagtactcttaccagaaccaggacagccaatagtcaaaataatctttttcatcatttaattcctaagaaaacttcaagaatacgaatattatgctcacgccgccctttatataattcagctgttgattgattcaccgatttgctctgaacattagatgaaataaattttatcatgtgatttttaagctgatacatatcaaacccacgagcttttgcttcttttcgtagggctttaccagcatcatctaaagctttagcatgttcaatgtcttcgctaatgcttgatgcactttcatggcatacatcaatgtaacggtccgagcattcaatataacgttctagcagagttttcatttatttttctcaactaatgattgaatataatcatgcaagtctttagatgctttaccccacttattttgatattcatttttgagattagcacgtgattgagctaataaaacatcattagttggaggtaaagattctaatcgttgaatctgtcgtccataaatcattgcagccatctcggattcataaattaatccttttagatgttcaaattgataccatgaaatcatttacatttatcctcttttagctcttgacgataataacatatcatagttttctggtcatgtacatatcgttttacatcattaagccaaatacgaaattcctgagaatcttcaaatggcatacctacccaagctttaccatcaataactttaacttgccaagatagtttagcttcgtcatatgactttatttgcacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttatgagccaccacatccgccttctttgcgtctttgcgcagcttttcattttcacgctcaattgcagcaattgattcacgatttttattattcattgcatcaatataattatattgattttttaaatcatttaatgctaaggcgttttcattggccgtttttgtaatttctacaacagacgtttctaatctttcaattttattttttaaaattaaagaagttccgcccaatgcaattacaattaataacaatccagctgtaaaattacttacatgcataaagttttaataacctctataatatcgtcttgagaaagaccgttaattaaaatatgatgttcagctggagatttagaaattttaaagcatgcctcaacatcttctgccatatccgatgcactacgatttggattactaattccaagacgatgctttccagtcaaaggattaacgatgatatagcatttacaactattgatatgaacattaggttgagtctgattaataaatacatcacaatcatatttcgcaagctgattttctaaaaagactttcatctcttcaaccgcatcaggaagcatatcacgggcttgctcaagacgacgatttcgatattctttaatggtcgttttccgcttgacttgcttagctaaatctttcttaagatcggtgatatatccaactcgacggtttcctttaaatacagaaatcccatctgtagtatcaccgtatgcttcaacgaccatttcagtagtaatgagctgcaaatccatcataaagtcctcatgttatgtcagtaagactactgtaacacaacacgagggacttgtaaacagcttagtatccttctgggataaattttttataatttttcaaaaaattctgttcgatttcacacataaccttctcttgactatcatacccctggtataagctcatgatgataccgaacaagtgatccattccagcacctttagcaacaccttgcgcttccatcgcataagtctttctatccttaccacaatgcttattatgacagtcaagaactaaaaacagagctcggtctaagtacttcagataagtcgtttcaaatgcttcaatttttctgtatgaatattcatcgtcagcatacattgctttaagatcatctgatgcaccatcaataatagtcttaaacaatttttctggattatctaatgaactttttgtgctatgaagagacacataccagtcagacttaattttaaaatgagaaccatctttcatcacagcaacatagccttcgatgttttccgcatttttagcttcttctacccatttagggctatcgatttcgtatcgttcaactagatatggacgaagagcagcatctttataaatatcatcatatgaaatgtattcacccgtttcgttttcacgaacattcagtaaaataattttcatttcttggtaagcaagaacgattctattcgtcggagcaacgaattcgaagttagcagtaaatccatcttcagctaattctttaagtctatcacgcaaccgatggtgattaatattcatcaaaataccattagccattaaagcctgttcggatttgattgaaccctttgatttgaacagaatttcatcaccgtctaaataagttgataccaaagacccatcttcttttgttagaatgtaatcaacatcatttaaatcgatattcatcgtgaatggattttcattcaagttaaaaaacttttccataggacgagaagcaattcttactggtttttctccatccatttcaaacatgattccacgacattccaatgcgtctggaagtaaccaatcagaataagatgcataattatatgagaaaattctgtaagttcttccagacgcacttacatcatccgagtaaaaaaacttacgctgtgaatccttgcatagttccattaaattgttaaaaagttcttgcattgtgtatcctcttttgtgttttgaatatagtaccacactccatgtggaagcatcattttttcttatgttgaatattccaaggcgggttaaacagcttaatgaatagtggttcctctaggtcaatcgtcgcgattgtcattgtacctaactcatttgtcatagaaagattaaaacattggcgggcgtaaaattcaactttgcttccttcctttagcgcagcatgaattaatgcagatttagtagaatcagacgttttgtctttacggttaatagcagttctataatagtttattcttttgcgtaaatttttagtttttccaatataaacaagttcatcatttatagcaatagcataaattacgttatacttgtttggaatagataattgttttatacttccgttgtagtctaattctagctcagtatatttaataaatgaatattctgttgcaatttctttcataataaaatgggccttgcggcccactccttaaaagtattttttaaaactcatcataactttatcatcaacatcattatcaatctgtgcaacaaggtaagatgacaattctacttcttgtggcgcagattgaacattatcagaattaagatattcacgaatccaaggatatggatgtttaaccggagcatcggtaattgggcatggaagaccacactgcttcatacgagatacagttaagtaatcaataaagctccacatgctatttgtatttaatccaggaacatcaccatctttaaataaatgaactgcccaatctttttcttggcggttaacttccatgaaaatatcaactgcttcttgttcacactcttgagcaattttaacccattcatcgccatcagtgccaagttgaagttgacgaataatatattgggtgcctttaaggtgaagctgctcatcacgtgcaatgaacttcataatcttggcattaccttccatgatttccatgttcttatggaagttaaaggtacatgcaaaagatacataaaaacgaatagcttccaatgcgttgattacatgcaaacagaggtaaagagatttcattagctcacgcttccaatatgtctcatgctcaatagcatcttcaataacgtcttcgtctgcattaatttctttttggtattcgatatcagctttagcgttttcccaataacgagttttaatcagaacatcatcataataacgtccaatagattcagcacgtttcataatagcttcatctaatacaatttcatcaaataccttcgatggatcagtataaagatttcgcatgatatgagtatatgaacgactgtgaatagtttcactaaaagtccatgtagcaacccatgtatcaaggcttgggtctgaaatcaatgacataagtacagcagacggtgcacgaccctgaatgctatctagaagtgattgatacttcagattattagtaaaaatattctgctgatattgaggaagcttattaaactgtgcagcatccatcattaagtttacttcttcaggacgccagaaaaatgataattgcttttcggtcaaatcttcaaaaactttatggcgttgaatatcataacgcgcaataccaagacctgaaccaaaaaacataggttcttttaaaacatcaactggatttgtattaaaaactgtgctcataaattttccgcttagttaatagttggtgactcgtccgtgagtcaaattatatcataatttacaggatgaacaatcttcagcttttggagtttctatttcataatcatcagtaccagaaccatcacgggtattatgataatagaaattttttccgccaaaataccaaaaatacaaaaggtcatcaatcattattgacattggaacctttccttttggaaaaatctgcgggtcatagtatgtattcgctgaagctgattgacatacccatttcagcataatagctacttgcgtaagataaggtttattacctttcttagctaatttccatgtataatcatataggtctatgttatgttcaatattgggcacgacttgattaaaggaaccctcttttgattctttaacagagactggtccacgtggaggctcgataccgtttgtactgttagaaacttgggaagatgactcacatggcataagtgctgatagtgtgctattacggatgccaaagagcttaaggtcttcccgcagcgacgaccagtcacaaacgtattttggagctgcgatttggtcaatctttttattgtaccagtcgataggtaattcgcctcgagaccaacgagtgtctgaataatattcgcaaggtcctttttctttggcgagcttaatggatgctttaatgagtccatactgtaatctctcaaatagttcatgtgttaaatcgttagcatcttcataagaagcaaagttacttgccagccaagctgcatagttggtaacacctacaccgaggttacgacgctttttagctttttctgcttcaggaactggatatccttggtaatccaaaagattatcaagagcacgaacttgaacttctgccaattcattaattttatcttggtcttgccagtcaaaattatctagtacgaatgcagagagagtacacaatccaatttcagcatcaggactattcacatcatttgttggaatagcaatttcacagcacaagttactctgacgaataggtgccttttcacgaataaacggagtatagttattcgtattatcaatgaactgtacataaattcttgctgttcctgaacgttcagtcatgagcaattcaaatagttcacgggctttaatacgctttttacgaatattagggtctttttctgctgcttcgtataattcacggaaacggtcttggtctttaaaataagaataataaagctctccacccatttcatgcggactgaacaaagtaatgtaatcgttctttccgaatcgttccatcatcaaatcattcagttgaacaccataatccatatgacgaatgcggttttcttctacgcctttgttatttttcaaaacgagaagattttcaacttccaaatgccaaataggataataagcagtagcagcgccgccacgaattccaccctgtgaacatgatttaactgcagtctgaaaatgtttccaaaaaggaataacaccagtatggcgtacttcacccatgccaatcttagaaccttcggcacgaatcataccaacgttaataccaattccagcgcgtttagagatatattcaacaatcgaagcggaagccttattgatagacttcagcgaatcacctgcctcaataacaacacatgaactaaactgtcgagtcggagtacgacaaccagccataataggagttggtaatgaaatctgtcgagtagatactgcttcataaaaacgaataacatgttttaatctatcaacaggttcatcttgatgcaatgccattccaatagtcataaatgcaaactgcggagtttcataaatttgaccagtggttttatctttaacgagatatttttcttttaattgcatcgccccggaataagtaaattccatatcccgctcgtgcttaatttttgattctaaaaatgtaatttcttctgctgaatattttgacaacaattcagggtcatatttaccttcatttacacagtaagaaatatggtcaataaatgaacgcggttcatactgcccataaacatgcttacgaagagcgaacattagacaacgtgcagctacatattgataatcaggctcttcaaccgaaatagaattcgcagcggccttaatgacaatagtctgaatatcatcagttgtcattccatcacggagataagatttaatattttcatataattcataaggatctactgatgttccctcagctgcccaagataaaactttaataattttttgtgggtcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccgacatagacggcccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctagctcacttggattaggaagtgtaaaaagaactacaccagaagtatctttaaatcgtaaaatcatattgccattttccctttaattgctggatgcgattcataattttcaaggataaaatctttcggtttcatgtattcagttaaccagtaaagctgtgtttcggtgtcacaatttccaaactctataggccaatcaattttaagttcacatagttctttaggctcacgacgtaaaatttctttacattgctcagtatgattcatatagatgtgagtattaccaccagaaaatatcaaatctcctgggataagattacacatcttagccacaatatgcgtcaaggcagcgtacgaggcaatgttgaatggcaatcccaagaaaacatctacacttctttggtaccattgtaaatcaagataaccattacgcacattaaactgatagaacatatgacagggcggtaatgccatttgattgatttcagctggattccatgctgaaacgatttgacgtcgatcagttggtaattttttaatacgatcaatagtttcaactaattgatccacgccgccgaaatcacgccattgtttaccgtatataggaccaagttcaccactatgatatcctaggtctttagcctggttttcatagttatcgtcccaaatagttttaccttgaataagactaccatgtgtgcgaagacgtaaatcattaacattggtagaaccggaaataaaccatagaagctcagcaatgcatgcattccatgcaagcttcttagttgttaccgcaggaaaacctttagttaaatcccaacgtaatttagtaccgaacaaagcaattgttcctgtgcctgttcggtcatcggtttcatagccattttcaaaaatgtctttaattaaatcttggtattgtttcatttagtaccttatataaattataatacattttatgaagctaaataatcaatacggtttagcatcaaattttctctcaatttcaggcgtgaaatataattctttaccgcgtttggaaaagcgaccaataatatgataattattctcatcaaacgtgatattaccaatatccatagctttcaaccaaatatcgatatttctatccagctttatgtcaaaattccaatacagagaactattaccgaaaatactgcaagcggattcagtgaaacaactgctataaatcttgtctttaggaactactaattgatagacacctttaataaactgaggaccctgccactttggctgtttcgtgtctttttctaatagaatagggtaataattaaaattcatattttccgccacgtgttatttcatttatatactgattctgtaagggttgttacttcatctattttataccaatgcgtttcaaccatttcacgcttgcttatatcatcaagaaaacttgcatctaattgaaccgttgaattaacacgatgccttttaacgatgcgagaaacaactacttcatccgcataaggtaatgcagcatataacagagcgggtccgccaattacactgatgcgattttcgctggaatcgataaacgtttcaaaagttgtattaggactagataattggatacgtccaccggctactaaggtaacatactcatcccaggtaatataaaaatgagccaaatcaccgtctttagttacaggataatcacgcgcaaggtcacacactacaatatgactacgacctggaagtaatgtaggcaatgactggaacgttttagcacccataatcataattgtaccttcggtacgagctttaaaattctggaggtcctttttaactcgtccccatggtaaaccatcacctaaaccgaatgctaattcattaaagccttcgactgttttagttggagaataagcgaatactaatttaatcattacgcaaaacccctttcaataaaccattcagtggctttatcagcatcaaagaataattcttcgtaagtcttttctttgttttcaaagactgtcacacaaacacgttgacagtctccgcagtattcttctgacatactcaaagcgtcagaaaacatttcattaaactcatttaaatcaggattatgcaatgcgttaaaaattgcataatcgaattcgtcattcataaattcaaaaacaaaaatcatattattttccttaaacagactttttcacaattttccaatcagctttaaactgatcgacgtcagagtgataaatccaaaatcctgcgctttcaccgtcttcataaagcggacacccatcacattcatcttcccatcccatgccacgtaaaaggtgttcagctttttcaacaagttcagaatctttaccgatgatattaaaataccatttacctctaacttctgaatctttgatgctctggcgttgtaatctcattttattctccttagcaagctttaatcaaaagatataaacagaccaacataactgctgccataatataaggtgcgaacattttcttttctccattagttttgatagggtaatagtatcacactactacccttctgtaaactactttttgaaagtttttcgcaaaagttcaatgatttcatctacattgttttcgtcaacaatgcagtgaatttttgttacgccagaaactttgtctttgacttcatcttcttcagaagtcggttctttatactcacgaaaacaatgaaattcgtcttcacaaacgttaaagtaaaaatgctttccatttgcgcattcaatgtgttttattactctaaatccatcaacaaagaaagcttctttaacttcaaaccatccgccattttcttgaataattttaactattgctgaattagaacgtgggcgataattaataaatgtatcaataagtcttggaacaagttcatactttttaccgatatacattatgttttcctcattttaacggggctgtaatagccccttgataattattgttcaatcaatcccatgtaaaattctgcgtcttcagaatccataccatcacaatattcattagccataaagcgggtgaggtcttcaagaggaccttcaataacgatttgaatactccaaaacttagaatcttgcacgcttgtgatactaagttcaggataacgattacgaataatttcttcgatatattcaaaatcaacgatgtcaatatcaactttagccatattattttcctctttaatcatcagcagtattgccgatagttgtatagtaccatggaaggacaaggatgtaaaccgttttgtgaaaaaatttttgaaataaaaaaaggggaccctagaggtccccaattaattagtaatataatctattaaaggtcattcaaaaggtcatctaggtccgtgtcatcagcactagatgaactgccagagcttgagctcataaaatcatcttcagtttttgtattgaagtcatcaacattgaatgcatccaaatcatcagcaactttatcagctttcttagcagcagttgcagcggcaccgcccatcacagcagttcccataacttgaccgaatttagtgctcagttcttcaaacgatttgaatttatctttagaagtcatttcagaaaggtcaaccatttgttcgaacagttctttctggaaagattcatcgtcaatgtttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttacaacaagaatattagcccagtaagaagttttacgtttaacaagaccatactctttattgtcagtgttgtacagatcatttttactgatgtattgacatactgggcaagaatcgtaatcaccgtgggtagatgaacagttttcaatataccatttaccatttttcttgaaaccgtgatttacaagaattgcgaatggtgcttgttcatcatttttagacggaagaaaacgaattactgcttgaccgttacccgcattatcgagtttcagtttccactcgcctttatcttcagaagaaaaaccacctttatttccagccagtttagccatttgtgcagcgagttcagcagtagatttacgtttaaacattttatttcctttttaatttaattaacagttggtgctatgacgatgtatgacctcatagctggtcagtgagataattataatctatttataataagcaattaatacttgcaggatttcacagtttcaataaaaacttttttagcttcctgtgaatcaatatttaaaatttttctataagcctttaactttatagaataattattccagactaaattatcagtctgttcatcatgtttatcaattatatttaaaaacgaatcaagcaagataaacgtttcaaacgaaattatgttcgactgaagcagtttaaaaatataacttgattgaacttttggattatattcaaagatttctttaaaagcagaaacttcaacttttttactaaaataataaatgttgcgaatatcttcttcaaacttaaatttaatttgctttaagcgtccgatatattcacgataaaacacaagtgcatcagcgtcagagatgtcgccaatccaagcatcttggttagcaaccaaattacttataaagattaaagcaagttcctttaatttatatttttctgataacttctggaaaaaatacttatcccttcgcttttgataagcggcatcagacacccgcatgcaccaattatacttaataacatcatactttccattcatatgttgttttatcattaagtataatttataaactgatttaccatcaatgtatctttcaccaccagcaggcatgcggagtttaatcatagcagaaaatctaatgtattagttttttcacaacgaacaacagaaggacgtaaaagattttcgtcaatggcttctgactgaattttttcaattatacccgaaggaataaatttagcaaattgagtttcaggaatagagttttcttccaagaatgctgtcgtagcttcaagataactcattccaaattcttctaccattttttcaataataaatccattttcttggcggtcaagaagctttgcaatttcatccttttctttcttaattgaaagttctttttctgaaagaccggtctcatcgaccgggcgaatatcatttagagaaaactgtgtcataaagttcaactacctcttcagtttcagcttcaaacacatcacggttatctttatgatacaaagctaatagacgattaaacatcttaccatcaacgccaagttcatctttagcacgaattcgaatatctttaatcagttcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacgattgaagttttcattgaaggggttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttatgcatcggtgaccattgcttaacatttggatatttgtgaagctgtgtaaagtcaccgtccgatgaaatgattaaaatcttatgtccttctaaagagaactttttaacaagaacagcaatgtggtcatctgcttcatacttatcaatatccataacaatgtatggcatataagctttcaattcatctataactttatgactggattcaaaataaccttcccagtcccaagtagattcttctcgtgcttttccacggtttttcttgtaatagtaagcaaaatcacgacgccagtatccagatttcgcgttatcaatacacagcacaattttagtgtatccaagcgtttttgcttttttgacattaaacttaattgagttcaatatcaaatgacgaaccatcgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttgggcagcaacggataatattccaaaacctgctggaaattttaatagaattcgttggaaagcattacgtactgatgctgtatatacaactgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaagtacgttcagttttaatgactcatccaaagtcacagatgatattcatttttaataatcgtttgtggcaaatgtatgttgctgattatagcagagaagctgcgattgttactccatcgactgcgtatcaagcacaatctaatgattttatcgtacgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaaggccgtacatcgattgacggtttcttgatgtttgacgataatgagaaattgtggagattgtttgacggggatagtaaagcacgtttacgcattataacaactaattcaaatattcgtccaaatgaagaagtcatggtatttggcgcgaataatggaacaacccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaacggtgaaactaattatgttccagttttacaacttgcttatatagaagattctgatggaaaatactgggttgtacagcaaaacgttccaactgtagaaagagtagactctttaaatgcttctactagagcaagattaggcgtaattgctttagctacacaagctcaagcaaatgctgatttagaaaattctccgcaaaaagaattggcaattactccagaaacgttagctaatcgtactgctactgaaactcgcagaggtattgcaagaatagcaactactgctcaagtaaatcagaacaccacattctcttttgcagatgaccttatcatcactcctaaaaagctgaatgaaagaactgctacagaaactcgtagaggtgtcgctgaaattgctacgcagcaggaaactaatacaggtactgatgatactacaatcatcactcctaaaaagcttcaagctcgtcaaggttctgaatcattatctggtattgtaacttttgtatctaccgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacaccagaaacgttacataaaaagacatcaactgatggaagaattggtttaattgaaattgctacgcaaagcgaagttaatacaggaactgattatactcgcgcagtcactcctaaaactttaaatgaccgtagagcaactgaaagtttaagtggtatagctgaaattgctacgcaagttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttaataactcctaaaaagcttttaggtactaaatctaccgaatcgcaagaaggtgttattaaagttgcaactcagtctgaaactgtgactggaacgtcagcaaatactgctgtatctccaaaaaatttaaaatggattgtgcagagtgaaccaacttgggcagcaactactctgataagagggtttgttaaaacttcttctggttcattaacgtttgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgggtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattaacggaaattatggtttcattgttcgcaatgatggatcagtaacgaattttatgcttactgcatcgggtgatcagactggtggatttaatggattacgtcctttagctattaataatgcatctggccaagtaacgattggtgaaagcttaatcattgccaaaggtgctactataaattcaggcggtttgactgttaactcgagaattcgttctcagggcactaaaacatctgatttatacacccgcgctccaacatctgatactgtaggattctggtcaattgatattaacgattcagccacttataaccagttcccgggttattttaaaatggttgaaaaaactaatgaagtgactgggcttccatacttagaacgtggcgaagaagttaaatctcctggtacattgactcagtttggtaacacacttgattcgctttaccaagattggattacttatccaacgaccccagaagcacgtaccactcgctggacgcgtacatggcagaaaactaaaaattcttggtcaagttttgttcaggtatttgatggaggtaaccctcctcaaccttcggatataggagcaatcccatctgataatggaataataggtaatcttactattcgtgatttcttacgaattggtaatgttcgcattattcctgacccagtgaataaaactgttaaatttgaatgggttgaataagaggtattatggaaaaatttatggcagagtttggacaaggatacgtccaaacgccatttttatcggaaagtaattcagtaagatacaaaataagcatagcgggttcttgcccgctttctactgcggggccatatgttaaatttcaggataatcccgttggaaatcaaacatttagtgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtatcatatgctgctttttatacttcttctaaaagagctattgcattagagcatgttaaactaagtaatagaaaaagcacagatgattatcaaactattttagatgttgtatttgatagtttagaagacgtcggagcgacaggatttccaaaaagaacttatgaaagtgtagagcaattcatgtcagcagttggtggaactaataacgaaattgcgcgattgccaacttcagctgctataagtaaactttctgactataatttaattcccggtgatgttctttatcttaaagcacagttatatgctgatgctgatttacttgatcttggaactacaaacatatccattcgtttttatgatgcatcaaatggatatatttcctcgacccaagctgagtttactgggcaagctgggtcttgggaattaaaagaagactatgtagttgttccagaaaacgccgtaggatttacgatatatgcacaaagaactgctcaagcaggtcaaggcggcatgagaaatttaagtttttctgaagtatcaagaaatggcggcatttcaaaacctgccgaatttggcgtcaacggtattcgcgttaattatgtctgtgaatcggcttcacctccagatataatggtacttcctacacaagcctcttctaaaactggcaaagtgtttggacaggaatttagagaagtttaaactgagggagccttcgggttccctttttctttataaataatattaaaataaaggggcatataatggctgatttaaaagtaggttcaactgtgggtggatctgtcatttggcatcaaggaaattttccattgaattcagccggtgacgatgtactctacaaatcatttaaaatatattcagaatataataaaccgcaggcagctgataacgatttcgtttctaaagctaatggtggtacttacgccggtccaattactattaattacggggtaaatagttatcttcaattaagtaataatgaaacccctatccgaattcgttctggtggcggcactggtaatactcttgtagttggcggctcttccggtggtattagttttagacctgcaggtagtgaaatcactactggacaaattactattacgccagaaggtttgacaacatttaccagggctgtaacggctccatcggtaactgttacatctactccttccgcagcatctgatgttactcgcaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaactgcaggtcaacgtcctgctgcttcagtattagccgaaggtgaattggctataaacttaaaagataaaacaattttcacaaaagatgactcaggtagtgttatagaattaggtttaaaatatggaggaactataaatgggtctttagaggttacagaaaatataactggaactttaattggaaattctagcacagctactaaattgcaaacacctaggaaaattaatggtatatcttttgatgggtcaaaggacattaccttaactccatctgacataaatgtcaatagcacaacatttataaaaaataatggcgaattacctactgatgctaatttagatacgtatgggcccattgaagaatatcttggcgtttggtcgaaatctacttcaacaaatgcgcaaccagcaaataaattcccagaagaaaatgccgtaggtgtactagaagtgtttgtggccggccaatttgctggcactcagcgttatactgtaagatctggtaacgtctatattcgttccttatctgctaaatggaatggcgtcgatggtccatggggtgtgtggcgtaatgttcaagcgtcaactcgtccactttcacaaacgattgaccttgatagcttgggagaattagaacattgtggcttatggcgaaacagttcaagcgcaatcgcatcatttgatcgccattatccagaagaaggatcagccgcacaaggatttttagaaatatttgaaggtggtttatacacgagaactcagcgttatactacccgcatgggtatggtttatactcgttgtctcgctgctgcatgggatgctagtgcacctaagtgggaggaatggaagcaggttggtcatggcacaccagcgactttctatgatggagatctgaatgattttaaaactcccgggttatataatattttaggcactgatgccgttattaactgtcctacaggtgaaggtttgccgactgttattgttggtttgctggaagttaaacagcgtgcttctggcggtgctattttccaacgtttcactaccgcaggaacgggtgcaactactcgcgatcgtatttttgagcgtgcatatactggtggtgcgtggggtgcatggaacgaagtatatacatcttattctctgccaattactttgggtatgggtggtattaaagctcaattagcggagttagattggcaaacctttgattttgtccctggtagtatgtttagtgttcctttgaacaaaataaagaatatgccagcaaatatggattggggcacgattgatggaaacctggttatgttttctgtcggtcctagcgaacataccggaacgggtcgaactgttcaagtgtggcgcggtactgtatctcaggcgaactatcgttatttcgttgttcgtatcgctggtaatccaggaagtaggactaatacttgtcgtcgtgttgttcttgaagacggatcacacacttggactgctcaacaaaactttaggggattgctgaatatcactgctgctgttaatcttggtgctaatcagaaaatttcacttgctccaggagcatatattcaagcccctgctagcggttctggttctaatacttacgcaaatcagaatactaccattgcgccattatatcaggctattgacgattcaaataaaaaccagtttgcgccaattgttaaacagaaaaacactgtaacaaatattactatggcttctggtatggatattgctagttcagaatatcgtatcgttgctcagggtgatttatccgctactggaactacagccactaaattagctacatggcgtttcttgccgtctggccgattcatgtcacaaagccgagtttatgctggcgcagcattcttgaacactgatggtaacattgctggttcaatctggaagaaatacaacgatgcaaccaatttagatgctgccttgaatactcgcctaggtaaaggcggtgatacgatgacaggtcggttaacaatcaatgcacctaatgattctattgtattatcaacaactgctagtaattctttgcatattcgcggtgacatagacgggactggtaactggtatattggcaagggtggtgctgataattcgctagcattttatagctatgcttctcaggcggcagtacatatcacaaacactggtgagattgcgttaaacccgcaaaataccgcaatggttaacgttaaccgtgaccgtgtacacattaacggttctggatggattgctagacaaccgggtgattggggcaaccaatggcgagtagaagctccattattcgttgatcatggttatgttggtcaagatagttattatcctattcttaaagcaagaagcgttataaccaatcaaggatatagcaccgctgttgactttggtatgcgtcgtattccatcacagtgggggcaagcaatcattcgtgtcggatccacggaggcttctcctgatgctggacacccacaagctgtgtttgaattccatcatgatggattcttttatacaccaggaaatggtagctttagcgatgtgtatattcgttctgactcccgtctcaagattaataaagaagaattagaatatggagcagtcgaaaaagtttgccgactgaaagtttatatttacgataaagttaagtctattaaagaccgtagtgttattaaacgtgaagttggtattattgctcaggaccttgaaaaggaattaccggaagctgtatctaaagttgaagttgatggatctgatgttctgacaatttctaactctgctgtgaatgctcttttaattaaggctattcaggaaatgagtgaagaaattaaagaattgaaaacgcctctctttactaaaattgctcgcaaaattagtaaatattttaaattctaacaacaagggggaaatgccccctttggagtataaattatggcagtagttggtgttcctggttggattggaagttcagccgcaaatgaaacaggacagcgctggatgagtcaagcggctggtcaattaagattgggtgttccttgctggatgagtcaatttgcaggtcgctcacgagaaattattcatactgtaggagcaaaccacaattttaatggtcagtggttccgtgatagatgctttgaagctggcggtgcacctattgtattcaatattgttggtgatatcgtttcttattctaaagatgttcctttattcttcatgtacggagatacaccaaatgaatatgttcagttaaatatacatggcgtaacgatgtatggtcgtggaggtaatggcggtagcaatagtcctggctcagctggaggtcattgtattcaaaacgatattggtgggagactaagaattaataatggcggagctattgcaggcggtggcggcggtggcggcggcggatattattctcctttttcacaaatgagattgacctttggtggtggtggcggtcgtccttttggtgcgccaggaggatctattgatatgcaatcaggcgcgactggcggtactatttctgcacctggctcaggatccgtgaatggtatctataatggtggaaacggtggtgaagtaggttccgcgggaggtagatgcaatattcgcggtcaaggatctgaatataatggcggcgctgctggttatgctgtcatagggtccgctccaacatggcaaaatgttggagcaatatatggtccaagagtataatgtgaataaatacccttaaaaggagggtctatggcagcacctagaatatcattttcgccctctgatattctgtttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacaataaccatgtactggtatagaaatgatcatataagtaatgaccgccttgaatcaatatgtgctcaggcggccagaatattaggaagggctaaataattatttgttcgtatacatctctagatatcgatatacaccctcaaaaccctcgttgaattcgtcgatgagggttttcttatcttcttgagttaattcagaaacaattttacggaatgaattctgatttaactttctaccttcatgcgttactccaatctcattcagaaatgcaataaaattagcgcgattctcaacaatatcttctctggaaaatttaatcaaaatagacgcaacagtaataatttcacgaactgtatcaatatttttattcattaactataccactcaattagttgactttgttataatatcatcagacgtttgatttgtaaactggtctgtgttattttcttcaaaaattttttctacgaattccttgaacgactcacgttcctgagctacattatgctcgattaccatttcaagattataactcattcgaaataatcttcaatttcataatcatggacataaatcattatagtttttaatacatcatcaatactttttcctggagctggaattacgtaaaaatatcctgcttttgagaggtctttataagttccaatcaagaaatcattattctcaagatgtagttcttcaactaattcattaacaattgagtggtataaatttggtagaaacttatatagcttttctagaatatcaattttgattgtatattgaaccacagattgagaatcaataatcatagaccttccccttatgtttctgtttgcgattagattctttaaacgctttcttcttatctttatggacagaagctttattaaaattatgttttgcgactaaattgttcataatgctgaattacctctcttaaacatttgcatgtgaatgaaaactttttagctacaccacattcaaatatatgttctcttaaatcacgtgtatcagtatatcccatctcaacaataaaatgccgtattagatttttatctttatcattgagagaattaaaataatcagattttgaattaatttccctggccaaattgaatcaccttcagttgacgttttaattcttttatcatttcttcgttcatcgcaatataaagatcgcgtaaagcaggttttagcattccatttaccggaaaactaaatgggcatacataatcttttcctacgagctttttagtgaattccatatcacagaactgaaatgccggttcatttgtataaattccccaattagttgacatcattttattggcatattccaacgcctggatttgattcttaattccatcaatttgaaactttttaatattcattagtaaaggtcctcagagtaaagttctttttcactaccaccacgttcaatacgcacttgtccagcgtaagttgcaataatcattgcttcttcacgtgtccagtaattgctatactggtcaataaatccttggtcttcaccacaaacatggtctgatacaagtttatcacttacctggtcaagaacttcagccatatctttagaataatgacgagcaccaggaataaccagagtcccaccatcttttaacttaaagcggttggctgcacacacaattcgacgttgatatttttcattattgttccaatgagctacttgccaacagatttcaggaacctcttctaaaacatcctcttccgtatattcggtgtagtcgccataggcctgtaatttagctgctagactttctggagtttcacgtaataaagccaggtctaataattcaagacgctctttgaaggttttcatttggtttcctcaacacttttaatttttatagcttgtttagaactttcaaagcattgacaatatactcttaccgcatcaaactggttggccgctttaagatggactacaccttcgccgttataaaattctacgacaattttaaatgttttcatttaaaccatcctttaatacgttgccataaagttttctgttgagctttgttaacaccaattgagcgaataactggttgagattcatggaattctttataatcagcaaggtaaatttcgtaagctgaatccataaaggaacttatagctgccatgaaattattgcgaatacctactggagcatctttactttcacgaataatcatgtatttgccagtcttaatctttacgatagttccaagataagctccatggtaccagatgtcccaaccctcttgagtaggttctacacaacgacgaagttcattgacaatttctaacttgttcattatttattcctcacagttcagatgctacagtgattacagcttcaatgttttctgccgaacgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactgcggtaagtttcaacctttttaagaacaaatccattttcatctaaaagttttaacatgaagtctttatcttcttccatatcagaagtaatttcgcgagctttacgagttgctcgttttttcagcagttccggagcgttttcctgtgcgtataaagttgctgcatttgaaataatatcctgagcttcaccagtaatgattaatccatcaccagatttctccaccaggccttttttaatcaataccccaatattactattaactactgcattgcctaaatctggatgcacctcacgaacttctgcagctgtaatgaaatctttcttagcaatggtaattaaaatcgcagcagttttttcattcagaatatcgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcattttttgtatctccgggttgtttgtttcagttcatttatttgatagttgtatagtaccacagtatgctttggttgtaaaccgttttgtgaaaaaatttttgaaataaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagcttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatggcgttcttcttcattatcgctcaaagagtattcttttcggaatttaactttgaagccaaagccatgctcaccacaagcatcatcccatgtaatgaagcctttatcttcaagcgggtctaagattttactcacataagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgcagtacagctttcttgacagaagaaacactatgaggaagaatgtaagttgcataaccagttgcaataccggaaacgccattaagaagaacagtaggaataataggcaaatagaaagcaggcggaatgtgttctttatcttgatgtactggagcatattcagtatctttatatacgttatagaaatttttacttacacgagcaaaaatataacgacttgctgctgccttttggacagtacgagaaccaaagtttccttgaccgtctaacagaggaaagttattattccaagtgttagccatcaaagcacctgcgtcttgcgcagagttttcaccatgatgatatccaaggtccgctacaccgcctgcgatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcacgattattcagttgcataaatttaccatactagtgaatgtagtgccataataacatcagaaatgaaaagcacgacttgaattaatccgaacattattccgtaatataatgctatcaataaaatagcaagggctaatgaatagcccaagattttcttaatcattagtagataacaacacaaatgttaaatatgcacacataccctgagctaaagcttgcgaaaacacactgctgacatcaatacagatagttaaaacacatgctactatccaacaaataaatgaaataactcctaataattttgcaatattcatattttcctcactggcgtccgaagacgcctttagttttaaaattattacgatagaactgcatcacatgttcgttgtggaaattactcattaatatgcctgcaaaacgaatttaaagttatcagccaacatacggttcatttcttcaagtgtttgatactcagaatgatgattacgaataaacgccaaagctaactgaccttttccaaatcccgtagtcagaggtttcatcttagaagcaggcagataaaatactgtgtatggaacattgttatttgcaatagtacgcgcaagctgagaccgacgttgacgaatatgacttagaaccgcactaaatccttgcttagaacgctgattacctacataaaatcgtgcagacacacatggattactaaatggacgaccatctaatttacttactaaaaagtaaaatccaggtttagataaaatatctttatgtggaactcccaaaaaccattcaccgttcttgattgtaccaataacggtagcgcctgcattattcagatcagtaacagtcatgtatttcatattaatttcctctaaattattttctactccaaggccgcatgaatacacacggccattaaattaatcgtcgcagtcgacgctcaattcccaaaactcttctacggtataagtttcagtatcattttcaatacagaaacgttcattactattgtttgctaaagtagcgttaactgtcggtttctcgctagtgctcttaagaggtgaaatacgaattaactgatcaccgttatctaaacagaaaatttcaccaacttttacatctttaaagattttcataattcacctcaaggagtataaaatccaaacgcagttgttgaccatcccatccaatatggaaaatttgcgccaatgtaaaacataagaatataaaaccaaccgctcagcaaattcatcattttacaccgttccaaattgtttcaactacggattttaaaccattttgatgaatatcaattccgactactgtcatcaaatagattccaactacaactgaacctaaagcaaaaatcagcatgaaaatgaataaagccggaaaaatattatcgaaaaaccattcaataaatgtaaaagcactgcgtttacgcttcatattttcctcacataaatccaaagtaagcgtttaatacatcaatcattaaaacgattgggaatatactcaaaactattagtattataactacattccatatagctttaacaatctttttcattttctgttcctccgtagttgatagggtaataataccacggaagaacagtcttgtaaacaacttttttaaaaatattcgtaataaatgtgaataccaactactactgctgaaacttgcgcaacccaccacgcacaagcaataagcacagaattcaaaattttcataataacctcatcacaaaagtaaatgttaaacaaattaatggaatactaattaaccaaacgaaacaccaccataatgaactcatagttcaatctcaacgatttccaagtgtttttgttttattgcctttttaacacaatcatggactaaatatgaccatgaatcattatattctccattaactaatcgttggagatcttcacgtgatgataagtaaggttgatctgattcccattttgataaaaatactgcagtaaaaatatctccttcatctgtagttgaagtcgtaaatgcaataaattcaccggtaattttatgtttagcgtaataaaatttaaatttcatttttactcctccgtagctgatagttgtatagtaccacagtccttgtggtatgtaaaccgttttgtgaaaatttttaaatggaaagataccatccattgtagttgctttttcttacaaccttacgaaggtcttctctgtcaccgatgaacttcggagtgtactggatgacacctggatgaatttctttagtgttgaatataattatacagtcagcaacttgatgatttagaatgggccctagatttattccagaaccatatggatactctccgctgcatcctgttgttaccgaaatccaacgtgagtcagtttgatgtgtcttaacttctacacgaagcccgcagtattttggatgcgccagtacatcccatgcgtatgtatacgggtcattaacatcctcttggcctttgttaacataccctcttagccaatctgccacaaaaaactctgcgtacacagcgatacgacatctttcgataacttctgctttatcctggttcgggttttgttttaaagagtatcttgcagtatcagcaattttgaccttcatttcactagtcaagtcactgttcgatagggtaaatgacggaatctgaaatagtctctgcaaacccggattcgttttctgcatttaaactttcctttatgtcggaatcataatttcccttaaaacaaaagggccgaagcccttattttatttgaattgtgcaattcttttttctaaacaatctgcgtaagatttcattgagataaactgcgaaagtagcaattcttgctcaactgcactaaccgttagaaactttgtgctttctaaaaaattgctaagtgcattaattttgagcattaattgatcgtattcttcttttactcgtgcttgataacctaacataattttccttagttaagggccgaagcccttatttaaattgttcagtaacgtcttcaactacttcgtattggcaggtacgcattttagcatcgttgtaatcaatcggaattgatactacatcacgcggatgtactttaacttttacgactcggctggttgaactgccaaagtgacgaatataagatttagaacatacatgcaaaccgcgggaacaagtttgcgtatcatcgtcattcacacgagtacgcggcattttaactactttaccaggactgttatcaaaagtgtttgagtgacaatcaaagtaattgctacgaactactttccaagcatagaagtaaccatcttctgtaatttcaatatcgtttgctaccaagaaatcaaagagtcgagataccgctttctggcttgggttttccagcagattttccaagaacggaaaataaaattcaaagttttcgcctttttccatcgaatcaagaatacgatcaaccaaaccagaccgcaattcaatattttgatagaataagcttccaccttcaattcgaacatcgccggaaatatatttttcaacagcgcgacgaacattaattttttgtgccgcttcttccaacttatccgctacaagcagattaagaatttcctggaagtttgaatgagtattaggagttgcgttataagttacaccgtcaacagtaattgaaatgaattttttagatgcattccaaataatgccagatttagcaactggagcaataactgcatcgctattaactttaactgtaatgtcaccgctaatagtaactttagagcgttctgcttcttcagcatttttcaaaacacgacggattgtgtcaaccgatacaccttgccaatcagccaattcctgctgggtgtaattaccacttgaatacagtttaacaatttcagcttgttcgtttttggtcaggcatttaatattgtacat

SEQ ID NO: 24 - DNA, 167219 bp, synthetic construct
  source 1..167219: mol_type = other DNA
aattttccttattaggccgcaagggccttcatagttttagcgatttgggaaacttcatcatcacttaaagagttgcgatatccgatgaagtcggaaacaatacggaatttcttggtaaactcagcaaccattttatcactgttttttgaagcattatttgataatacatcaaaaagattagttactgtccagatatcatgaccgatggtatcttttccaccattaaaatatacaccgcgcaatgaactaactatattagcgagtcgtgtatattcttcagaaacttcatctgtactgaagtacttcatcataaaatctagttcaggatacttgataattttatcaatatatcgttgagctgaacttgaataacctacgtacttatcataatctacatcatcaaaagcatctacatataaatcacgcagagtttcaaaaatacattggcactgaccgagttcttttacctttttctgcaaaagcggacgaataacataaaactcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagcaaatcaatctgcgattctacttctggattaataaacagaagacgctcattatgatgaatattcaaagtgttattaaattcactatcatctaacgctcgtgctaatccacgaacaatattaacacgatttttaatattatcaataacgatattaatttttgttgtattaataccaaacagacgataacttgatgcaacggctgaagtttcatgactttgcttaatgcgcttcagtcgaggatcaagatttacttcatacacaactcctgcattacataacttattgtcaggttcaaacatgctctgcatctttttatatgacagatttttagtcgtgaatttgactgaattactaatcatataatctcgagcagaatatcccatcttcatcaattcacgatatgtgtgacgaggagatgtagattctttaaatcgttttacatcttcattaaatgctttctcactgagttctttaactcgttcaataatatttttacgagtacgatcatctagtgaaagagcttcgcgtgatggagcaatatcaagcgaacccattggaaacttaatgtaattcacttcattacgaatgcttagccagttacggtctttaataacaccatcgataggataaacaataccgccatagatagcatataatccaccacgatcaggccagtatctttctggatttatgccgtaataatcatcaaaatccggaaaataatcaatttcgcggtcaagaccattaatgatagccaaatctttgaatggtcgcatgatataagaaacttcataagcaaagtttctaaagtctttttcttcaactggaactacgatttcaataccagttttatcatctggacccatttcttttacgaatgtaggtttaatctgtgggccatcaccatccatgtaagctacataaccacgaatttcacctttatgatacgaagtaatactaaacgtatcagtataactaaacggagatttagaacctaaaccaaatccgccaataaagtcattagattcagctttagatgaactgaagtatgaattatacaacccaggagaattatcatcaccctgaatatcaaaatcactcatacccggaccaaaatctcgacaaacaaatcgtgggtctaaacgtccaggaacttgaatgataaatttttcaggatttccattgagagcatgggcatcaatcatgttggtaatcaattcacggactactgcgcgaatcttgtttgtgtacaaatcagatgatagaattttaaatactttaggagatgctgtgatgctaaatgcttttgatttagaaccattaccaagaattgtttctttttcagtggtgataatcataatttcctcattaattcatattgcgtttaataacttcagcaacttctagtagttcatctttagttgcggtgtcggattgaattttatctctaatatccttaaagcggtttttaaactcttcagcttctcctatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactgggttttgaatcatctcacgatattcagatttttccaaagagccaagtcctttaatataacggatgctatgtttaggtagagcatctttggcactctcatattcagcgactgtataaaaccattcttgttttttaccgacctgagcgatgattacaggagttttgacgaagcgaattcttccttgctcaaacagttctggccaattactaaaaaatccaagcagagaaggataaatgcttcctagaccatcatggtcagcatcagtcataatagcaatattatgataattcaagttttcagctttttcaccgagaactaatccagtgattgcgcaaatatcaaacagttctttgtttttaagcatgtcagcatatgacataccccaactgttgagaactttaccacgtaatggataaccaccatgaagttctttattacgaacatcaataagatatccgatagcagaatcaccctcagtcaagaacaatgtagtatcagcatctttaccacaaagattcgctttgatatgtttatgaaccttagctttagatgcctttttagctgctttagtttctgctgctttttctgccgccaatttacgagccaaagcagcttcaataattggcatcagaattgcttcattattcaaaatagcacgtgaaatctttttagcatcaagctgaatatgactacggatttcaccaaatggagaagtcaaacgctctttagtttgagaatcaaatcgcatgtttttcatatcacgaacaaacataacgattgtcaaacattctttaacgcgtgctttagtcacatcaattttgaacttacgtttgatttgtggaataaggtcttcacaaatatcatccataacacagtcaatgtgatggccaccattcttagtatgaatgttattaacgtatgttaattgacgaaaaccatccggtgaacgaccaactgcaatagaacagttttcttgttcttgaacgatagcatgctcatcatattggcgtgcatatttcttaaaattgccctgaacctttttaccattaaaggtaaattgaatatcaggataaacaacagcaagtgtctggagacgatctaatgtaatgtcaagataaacttgagataattcattagtttcaaatgacataaaatctggaatgaaagtaacacgagttcctttccattttccaggaatagtttcccatgatttattttccatgccatttgaacaacgaactacaatattattttgaccatcgccagtttcaccgacaaacatcacagaaaaaatgttagttaaactagaaccaacaccattcataccaccggtgacgcgttctttatcatcaccaaagttaccacctgcttttggaatagtccacgcagcaactggaccaggaatttcttcaccagtaggtgttttaaccatcgcttgtggaataccgcgaccgttatcttcaactgttacttgattgtttttaatagtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacgaatagttgaatccttaaagaacagcccagaacatactgttccttctactttctgcccagtaggtccaatagcacgaaatccagtatgttggaaatcattttcagaacaaccgaaccagttatatccagtgatttcaatattagtaaaaccgcttgaagacaaaactttggttgcattatcagcatcagtacatcctactaaagacactgctaatactaatgccgcgatagaacgattaatatatttcataattttcacttaaatttaatggcttgaagaagactaataattctcaagcgacttccttcatctttaactgtaaaagaaagagggtcaccagatttcatagtgatagtgcattcaaaagcaaaaccttcgggaacttcttcgaagaagtcaaattcttcatcataaattagaacattactctgaaaactgtgaagaatttttccgtcatttccagatgctgtactaatcattgtaacattattacctttcatatcttcaacgataaattcgcttgtagatattacagcattaatagaaccattcctataaatagcagaaaatagatatttcttttcttcaccttcgcgaatgcgatatttcttaccgattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccatgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtaccatcttcagtgatttcacgaaatacaccgtaaattggttgtttatccccaaccttttcatacacataaaccgaagtcaagtgagtaaacttgatagtgtgttccttttgaactactaccaaatctggatcgaataatacatcttcaaattcatcattagtgcaattctgaacaattttacgtttcatcataatttcctcattaattattagaagagtatcagcgcacctttaacgaattatccattttattctccaagttgttttctgtatcagtagttgatattgatatagtaccataatcaactactgatgtatatagttttatgaaaaaattttaaactttatgcatagagagcattgctgtagtgtttaatccaactttcaggaatgactttatatgttcctaaaaataccacgttgtacaacttaacgccatcttctacccattgatcggtaatgtatccacacatagcgcgagtataaacagcctttccatcatctttgataaatttaaattcacaaggagcaatgaacttgatagcttgaccgagtttccacttaaagtctacacctacatgcgaagtatcaatcgtttcaattcctttagcaggaacagctttcaaaaacgcaggctcaagaaatttccatcgaacataaccaaactggggcttagacattccatctttagcaatgatacgtacttttacttcagaatcttcatctttaacaccgtgtttaagctgaatgcttacaacttcgaccaattttcctgctgctttagaacgggatttatcagatacacgagcaatttcaccaatattaataatcatagttatctctcacttgttaaaaagattttatactccacaggaccattatactctggtcccaagagtttgtaaactattaattcaaaatagctaccaccgcactacgaggtactacactaaaatctcctgcatggacaacgttcagaagctcaacaccatcttcaatccactggtctgttacccaaccacagataggattatcaaaaggacgacggatagacacagcagcacacaacaggtctgtagggtcttgttcttcaacttcttggaacaggatgaactcatcttcataaaccaggtttttctttattttgttattatctaaccggcgaccgtggatgacgtaagatttgtcaaaccactcacttttggcaaattcttcaacaataaattcgccttcgccaaaaacatcagtcagagttttatgaccagaaatcaaggcattagttttaattttaggttcaaccagtttgtaggttttgccgatttcaatagcggtagtcatagtaggttccttaatttccagtggtttaacagggcatacataagtacttacaacgtcaaaatcaatcagtttagctgccggattcggtgtgtattcaggattataattaaatttcataattatctcatttcaataaaatctacaagttcagcatgggatttacggaacattacttgatgcccgccaacgataacttggtcatctggtacttcgtatacagcaagataaaatcctttcgaagctaattcttcacgctcttctcgtgtgaaccatctcatcatatcatattcgctagcgaaagcaaaatgataaagagctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacgtgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcaatcttcctctgatggagcatcttcaagacccatagcatatcgcaaagcgtacttcatcatcaggatgtctttcgcgcagtcatgaatagaatcatgcgcaacgaatccatctaaagttccttttggaagaggacacgtggtcatatcacgaacaagcagaagtgcttcaattctggtacgaatatcacgctgattccagaatttacatggttctaacttaaatgtgtcaagttcattctcagaaacaccattaagacgttgaatatcacgaatgagatcgactaaaattggaaaatcaaacgacattccacggcaccagccttgagatttccaaggatcgatattatgtgcattgatgtaatcattaaatttcgcaataccgtcgatagtgcttacatcttcatcggacggtgcaatattttttcgagcttcaggagactgatttttccaccattcgatagtgcttttagtaaaaagacgatgtcctttttggctttttaaatcaaatttgattttaatgccgcgtgaaactaattcatcaaatgtttcaactacttctgggttagggtcaaaagcaattacagctaaatcaataacagctgctttttcaccacttcccattgtttcaaaatctataataaaatcaaacattaaattttcctcgctaaatcgcgaatttggcctacagtatagtcttgaatataaactttattaataggttcatcaataaattttgccatagattcaatatctttttgcatctcttcaagactgtatattatctttaaagctttttcgcgaatagtaatattttcaggaccagaatttttctcaatgacagctttaacatttgtcataagagatttaaactgacaccaacttaattcaatcattaataatcgccttataaagatagctaatttcacctaaaacataatcactgattgtgacagttttcacttcaccacaaaagaattctaacgcaattaaatctcgttcaatttcttctaattgaagcatcaacttactagattcaatttttacagtttcacgatttttactataagctatttcataaatttcgctcactttatcttgaagcagataaaactggtctttagttatttccacgaatagcttcctcaaatttaattagtaatttacagacactttcatctagtgtaattaccgtatctgtattactgtgatatgattgtttttcaattcgtttaattgctaatatagtatcacttataagataaagcttatgaaggagctcagctcctgttaccataacatcgagattatcttgcttattagtatgcttccttatacaatctattagacgatttaaatattttgaattgatgttaatcatatatcctcacacataaaatacgtcataacgaccacgggtaacaccaacataaagaagttgttgagccaattcagcatctgcataatgaatacaaggtgtatagatgaaagcacggtctacagacataccctgcgctttatggaatgttgatgcaggaagtgctttcactttactaaactgtgatttagcatcccaaaaatcactccatggagcttttccacccttattccagtttttataagtttctgctgttttacctaaaaataggttaaacttatatagctcttcatcagatgaaattattttaatcttttcacgataatattcatcatcgccgtaagtttctactgttaaatcccaatgacgaattaagtattctccagaaacaccacgagctttaacaaatgttgatgtatactctgcttctataatacgaactaattgtccgttattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagagatttgacgattgaaaaataatttaccataaaatcgcgtaaagcggtatcaccagtaaatccacgtactccatgcccgtcaacaactttatcataaatccacttaccgttacgaacgtcagtagctacatcaataataggagcattactgcgtttaacttcagtgagttcacactgataaaaatctttatgtgtaaagaatggactgatataagcagtattttctcctggatcaacaggtctaatttgcttattatcacctattccaattatagtacaccaaggtggaatagttgaaagcagaattttaaatagctttctatcatacattgacgcttcgtcgcagattaataccctgcatttagctaaatctggtacttccttctgttcaaaaagaacgttttcttcatacgtaactgggttaattttaagaatactgtgaatagtactcgcttctttccccgacagttttgaaagaatctttttagctgcatgtgtaggagctgctaaaataataccagtttcacccgtagatattaaagcttcaatgatgaacttagtaagagtagtcttaccagtaccagcaggtccattaatagttacatgatgtttcttttctttaatagccctcataacgatgttaaaggcatttttctggccttctgtcaaatcatcaaatgtcatcggaaagtccctgcaattggaatactaacaatacgcccagtatctagaattcgttgatataatctttgtgtatctacatcaggcttaacatgtttaacttctattttattaaaccaaaacttgcgtggagtctcaactagtcttggaattcccatacctaaagctagtttatattggtctttgagagtagtaaaaactctatcagcaatctctctttcaaaaaacacagcaggacgatgttcatcaagtggaactggcgccgtaaatccgtctttgtctcggtaaactatcgcatatacataaaccatattatcctcggataagtttaaaaattgaacaatttagcgggtatcctcttttcagtttaagtttatcaataaaagacaagttttgataccgctctacaccttgaataattttatcacacatatcatattgcatttctgcttctgacaactttttcacaattttccaatccgagcctttaagaagaacgttcagtttaacaacttcagcgccttctgctatgcgagaaccatcaatacgagctttaagtgctataattcttagcttaatgtcagaggtctgttttgatttagaaagctgagaaatgtgttcaattcgattttcacgctttttctgtatagctttaatttgattataagtctttttgattttagcccatttcttttcatctaaatttagtttatgaacttttttcgcagatgaacgaccaattcgcaaagcaaataaatcccgtttttcaatcaactcttctaaagtataatcagaacgaaatgtattatactttttctttactgcaataacattccctttaatgtatccaatgttattatcaaaacgttctaatgataatttctctccttcaatacgattatcaaaaggttctcctgaataggcacaaactttttgatctaaaatattcttaatgtaattgaagtctaagttaaaatctttagaacgtctttttgcagatgcctgagtgtgctctaaacgacgtttaattttacgaatttgattattagacagtttcatatttttctcacatcttacggacgattgactactatactataacatttttaccttggcttgtaaacaattttatgaaaaatgcttcaaaaatttcatggtataatgaatctaagtccttccattatagattaaatccttcaaaatcaagagtatagatagtgtatgttgaatactttttatactcatatctatctgcaattctaaatacacttccagctggtatcattacttcttgttcatctgaaactaattccatattacgataacgatggctatccggaaacttaaagtttggattgtattctttacagcgcagagcttttatagcatactcctggaaattgaataccataggagctttgaattcaaaaataacttgtgtgttatactctaaaccggaagcaaaatgtagagctatatttttatcatatgaagctgatacgactttatcaaatgtaataatatcaattccttgatttaatacttgtttagtctcagctggaacacctctccaaagaggtttatcgtttggttccaaacgagatttgattatttcatttaaccaagtatggtcatctggtttattagtaatacaatgaattaaaagttcaatttcagataaattaaatccttcagaaagtaattcttcacgaatagaagcacgcaccgatgcatccattgatttgattttaaaatcttttaattgcattgctgaatatttcattcaactacctcaatatcatacactttaaatgttccaaatgaatcgtgtaatttttcttttgaaatagaagttattttatactttccaattggaatcatccattcttgttcacgtacaatcatcattaagttatcagtacgctctgaatctaatccatcagtatcttcatacgtgtacttaaactcagtattaggagaagaaagtataatatcgctgatatggtcagaataattaaaagctttattagtttttaagcgaagtattattttagtaaaatattcagcgtaagaaaaagaacatgctgtgaacaaactagtagtaaatgaatctactctattcgttgaaaacacttctccaacttgtaaatctttaataagttcttctgttgattttgatataccacgatataactgataaggagatttagttaaatgctttttaatgattttattcaactgcctatgaagagcttcattctttttggcttccatacattgccaaagaactgactgctcaaagtcagtaaatttttcacagacctttttatacatatcatattgaaaatcaacgctttcagcttttatagataactgttcaacatctgcaagattaataatcatgatagcctccgtatacttcagaagctatcatatcatcgttagaaaggaaagtaaacaactttttgaattattttgcccaaggagcccaaggcggagggtcaagatggtatgaagctagttcttctagaagagcatctggggcttcaattccataattctgtaatactatacggtactctttcttataatcactagaatcattctggatattcgtagaatgattatcttctaacatctcaaataaatccatactaattcctagcgataaaaaccaaattgacgattagcttcaataatctttctttcttcttcggacattctccagcgtagtccaacatcaaaatgagcccagaccatcttaacaaatgcatttatatctttaatatcttcaataatgaatgttttacttttagaaggttgacctgctaaattaagtgctaatttaactttatcgtcttcaaacagggcaaaaagaccatattcatgagctcttttatagcctttaatagttaaagcttcagaagaagaaaacggtgaatcagtattctgtaaaatatcttcagtatgctttataattagaataacattttctggatattttctttcttttatatctttaattaaaagatccggattttctgctaaaggaataattaatgagcattttttatcaagtgcatttactgatttaccttctttagacataaattctattgaataatgttttgctacttcaatcatgcgatttcctcttgcctactaatggaccgtcaggaattttgttttcctggatatatttctcattttcttccatcattttactgccaattttaagaagcaaatccattgcttcatttgctttagctttagcctcttctaatatcatatctctgttcacgatttatccccatagatgtctctcattaatttaagcgctgagcgttctaatttcttttctttctcagcactaatcattgatttcatccattcttctgattcgttctgcatttctttatttgcttgttcaacccaaccatcatcaatatacatcgagtttggtctattgaaccattcaagcatcttcttcagagctttcatttgttttacctaaaacaacagtaggagcatcatcaaattcatgaatttttagcaaatttggatgtaaactattccatacagaagaaataaagtatgataacgcatcttcacttgcaattataaatttatttcctttatctattttccaactatatagtgaatcgtacgaataaaaagataaaggcttatcattatattgttctgcgctaacattaatgtattcggatttagtaaatgcttcaattgctctaaatggaatatttggtacagtttcaataataccaatctttttaagttttatttcagcatcttctggaactggcattgaaacgaaattttctacgagatacattgggtcacaataacccttatcaatcattactgctacggtaattggaacgtctttagcaaacgacatactattactgctaatatacatttcaaacaaaatcgcttccataattttcctcaatcacaagatgtagatgaacaactagaatcacaagaacttccacatgaatcgcccgtccatacatgaacaggaacattagtgtcatatgaatcagaactagactgtgtattctgcgtattagatgatgtaggtgttgaccaacgccaaggatttttataatattcctgggcttcttcataagtcatagtaaccgcttctactgttccatctcccatataaacatattcaactacagttaaaggaaggtagtcatttgaaataggaactacaccttctccgggagttgtagagaaaaaatccgtaaagaaacttttaaaccaattaaagataaacattacaaaaagcctcttttgaattcaacttgcttctcgccataatcatatcgaatctctgcattaaattcaacagaaccatctgcgtacatcataaatgaatgcacaacaacttctgtagaccatggctgtagttcatatttcttcattacatgccgtgaaatgataatatctaaatcttcatttggtttaatccagcgatttaacatagtgctctcctctataagataattctattataccatactcattttggaaagtaaaccggtaaaatgaaaaaaggactcccgaaggagtccttgaattattaaccacctatttctgtaggcgtaaacattgcagcattcttagttttccaagttgttgcatcggaaactacatcagaataagctgctttttctgacggaaagatttgataatgagaatctgcaatacggtgttcatttgaatatacatcaaatgctacagaaacttccatacctttaacttctttgccttcacctgctggatgagtaaaggtcttgatgttaacgaaaccacccataataaactcctttattgtttaattacaggtgtatttatatcagtcttcaatgaaaacttgtgccaggaattcgtgttcatcttgaatttgtttatataaagccattacagcatttatattagagctatctactttaagttgataggcataccactcgtataaattaattaaagctttttgtcgtctaataaattcttctttggatattttcattttgaatgctctataattagttttaaggcttctttactgacaaaaatttcatcaagaccttcttctacaccccaatcaactacacgaagctgattagataagagctcgtatgtgagctccttgtcataatttttaaatagctggtcaatacgtttcttgtgggctttcttaagctggcgtttatttaaacgagccattaataacctcggtcttgacgagcgaagttttcagcatttttcagataataaagtttaaagatttcttcagccgtaagaccgaggccttggaacatgttcagaacgaaatgaagaatatcaatcatttcgaatttaatttccaactggtcttgtggagacaaatcagtaatcagagtttcacgtcgttcaccatgttgagctttccaaggcttccatacagcagatgcatctttttcaccattgctcataccaccaagagaagtcaatagttcgcggaattcatcatcaatataatctttctgattacgcagccaatcaacaacttcacccgcagtagccaaatcatcaggatgacggttatattcaggtttatctttagctaaacgaacctgcagagatttctgcatatcaagcataacttgcaacgggtctttttcatcaccgagaatatcccagtattcattttgagctttatcagcgccttcaatcagttgtgaacattcattaaagtatgccattatttttcctttcaattcatgggttagtagattaattatacaataaatatataaagcaataaggaggacatatggtacaaaaattaatggcacttgttaatgccatcaaaggtaataaaaagcgtatagcttttactatttctgctatggtaggaattttactctggaactttattttatcacctgttgcaattgcacatggtattaatattccagtagttactcttgatacattcgtagatttagcattcgctttagttgggttaatttaaatcttagcatatttagataaccgcattttagccatcaacccctgagcaatattatttttcatatattccataatttgttcagtggttgcaccttcctttctaatcatatcattaacatcttttgatttccagggagatttatcccaaaacataaccctttctcctgcatcaactaatttagtcattcgcttaatagtgtcaggatgacgaggttcattatctaaaacccacacacgtctatctttaaatggaacaacttctaggtctaattgaccacctgtaatagctataccattttcaataaaaagcgaatctataggtccttctagaacatatacatcaccatctttgactcgttcgactccatagatttttgttgcctcaggataagctttgatggtgatatatttttgaggagcatctttctttaatgcacgtccttgaaaagactcagcttttccgttagcattataaattggaataacaagacgaggctcaggtgtttcctttttatatgttcctggagctatactattaactaatttaggccattcagttgtaaaccaaagatatttccatttatcctttggaatacaacgagcttttacatattttataattggatggtcttccgccaatttatctaatctgatgcatgacggaagagatttaattattttcttctcaggttgtttaggaagttctttaggtttttctactggacgacttttacctttttcttttcttatttcaaagatatactcacgatataaatcaggttcaaactcctttaaatatattccgattggtgcatgatagttacagttataacaatgaatatttccttcattattatcgccataataccatccacgggctttattttgatcggtttttgaatctccacaaacgggacatctaaaccgtaatttaaaagttgaactattatttacttgtgcgaatttaggtaaatgagccaatgcacggtatgcaaactcattatcaatccaaggtattgatgacatttttactcttctttttctttagattcctcttttttctttttaggaatctgttcaggacctttatttactacagcacctgacgttgttccagtggagatattttcaggattaccacctgaatctccagctaccatatcttctttaataaattctttatatgttttcatattaacctctattcataaaagcattaaaaatttggtcatcaatagaaacatctactttagactgtttttctgatggtaattcatatccacatattacaattttgtgatcaatatcaaaatacacagaagcaatatgattaatgatgttttcagtaaagtctaaatcaacatcaatatctttttgaccacagcccaaaggataaataatgcgagtaattcgattatctttaacaaagattccaccgacatactctgtgctgcgtttaaagtctacacgccaacgaaatgaaaaatattcaggctctttatgagctctgctcataggacacaacgagtaactagaataagagatgtcaaatcctacgccttcaatatgagccaaagtatcatgattaaaccaattataatcgtacgccaaatccattagattataatatgtaaaaggcaccggattaacgtcattaatcacaagcatgtaattagcaactgctataatttcattgtttttaacgaatacaaaccgtgattgatgcgaatgacctggacccgcgttttcacgattaatgatataacactgggcacctttatatttgtatgtatctttgcacttgtgcatttgatagagcattattcacctaccacttcagcgatgatatttttattattaaagtttttatcgcaatacagaacataattatactgcattacaccaccagacttaagctgtttttgcacttcagctttcatttcggggcgatcgcgctcaacgatattcataatatctgcttcaatttgagtttcaacctcagtctgatccgcagtcatagaccattcgcacaaatctttatcatagcctgccatggcaggttgagcagcgcaagaagctaaagcaaaaattgcagcaaagataaattttttcatgataatctcctcggtagtttatgtttatataatatctcaatttccaacaaaagtaaatagttattttaaaacttctgcgtaatcacatgttacaaactgtttctctagcttaacgattttacgaaagtatcttttgcattggcgaatctgcctcttcgtaggacgtacagcaaacttaataaattccactcgaccaaatggaggactttcttctgctggaatatctaacaccaattcccacgtatctgcaacaagtgctttgaattgcgtatttttcctgacattatacggagtaggtttaaataaaacaatatgcatattatcctcggcaatctacttcacatactttcttgtcatcaatgaaagctttaactaatgctttattaacttcagcatactgagtagtaacccattgaacatcatctttcatcattgtggtttctttagtaaacatgctttcattcttaaaccaccccataaaaactacctttaccaattccataacaatctcctcatttaaccaacaagactactataccatagtcttgtcagcttgtaaactaaaattttaattcattcgccaaagcatctaactgagctcgagtggattcatttctttgatagcgattctgctcagcctgaatctgttgtgaacctgctacttcattcacttcagttggagtagaatcttgatcaatttctacccatttttgatttcctttttgaacacccatcaaaaacttattccatttattcttatcaccatatcgtgatttgatttgcttaatgagttgttgttcagcagctgctagctcctcggtttcaatgaccgcaagcataaaatcggctgttgctggaagaccagcagattctgcgatatcgctcatgttaacatcggaagagtcccaagcttgtttgccgacctgcgctgcagtccaaagaacagtttcggtttcaacagcaagagcacgtaattcctcagcaatggctttaacagttgtgtaactattttctgagtaaactctaatgcggcaagatttacaaatacccagatagtcgacaataatgattgttggaacaaaattcttcttgagcttcaattcgtttaaaagtgatcgaaatgtattagcgtctgctccaccagtaggatactgtttaacgattaaacgaccaagagtagatttctcacgccatttttccatttttcctttatactcagcgtaagaaatatgcccatcatcaatgtcatcaagagaaacatcaagcatattagcatcaatacgcttagcacagacttcttctgccatttccatggaaatgtaaagaacattatgtccgagctgcaaataatctgctgccaatgaacacaatcctaatgacttaccaacgttaacgccagccattaaaacgttcagtgttccagtctcagctccgcctttagtaattttgttcagaattctgagtttaaatggaaccttacgagctttattcatataagatagccaacgtgcttcatagtcatccatccaatcatggccaacgtagctatcaaatgaaattgataatgcttggcgcatgatgtcaggaatagcacctacatctggcattttcttatttcgtttttctggaggaagctcagcattagtttgaatttcgattattttagacgtagcattaaacatcgccctttgctgaacatatttttctgtttcttttattaaccaactgtggtcttccggagaatcagctagttttgaaataagtgtttttacaccagaatattctgtttcagtaaatgaactattttctaatgcaacatttaacgcattaatagatggaacgctatgatactcattgacatgagatttaattaatttgaatgtatttttagctggaccactttcaaaatattctgaatccatatatggccaaacttttgaaaaataagcttgatcaaatatgagatgagaaagaataatttctaccacacttactccttaaaagaatttaaattttttctttgaccttttattaaatgcatcttgcagttgcattgtaatacatttttctacatgaggagctaactcagcttttctttcttggtcaagaacagcaaagtccattacaacctttccattaacccaatccagttttgttacatatactatatgcgtagaaccatcttctagtttaatgacaatctcctggataacattttccatagcggatttaattatcttaagagattcattaaaaagacgttcttttctttcttcttccccctccgaagagggggattcatcgataatttctagatctaagtctaaatcatctttattcattaaattcttccatatcacttaactgctcgaggtcagtttctaaatcagcagctgatttacttttactttccggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttggtatcttttgcgcgccaagatttttcttcgcgaatcatctcgccagtttcttcatcaagaaattcacgagcataccagccatttttaggttttactacaaatcctaattctagagccatatctaacaatccagaataaggatcgataccaccatcaaatttaacatcaataaagaatttacttttttctttaacggtacgagatttttctacatttagaacaaattgatacccctgaagatcagaaccatctttaatctgacgcttaccgataatgaatacggtatcagccgaatacattacgcctgtaccacctgtcatcacggttttactaaacatttcaattgtttcaattgtatggttaaccgcaacacatggaatatttttaatgctaaaataaggagtaacaatacggaataatgacttcagtgatttagcacgagtcatatctgccacagatttttcattcaaggcatcttcagtttctttcttagaagccatattaccgattgagtcgatgaatacaataactttttcaccgcgctcaatagcttcaagctgattcaccatatcaattttcagctgttcaactgactggattggcgtatgaattactcgttccgggtcaactcccatggatcgcaaataagctggagtaataccaaattcactatcatagaatagacaaaccgcgtcaggatatttgtttaaatatgccgcaaccatagtcaaagacatatttgatttaaagtgtttagaaggccctgcgaaaatagttaaaccagactgcatgccgccatcaatcgcaccagaaatagcaatattaagcattggaatttttgtacgaattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctatcggatgaatagcattaaacttatgaaatgcttctgatttttctttgcgcgaaacacacatgcgaagaacctttaatggctcgtcttcttcacccaacgattttcgtttttcgatattagaagttttccaacgagcttgctctggaaactctctattgatttgctcaagcgctctattatgtttagaattactacgaattgaactacacccgccaggagcttgtgcttttccagatacaaccagatatttgaacaaggccaaatgcggataaccttgattaattaaattgagaaatgcatacatatcttcgcataaatcaatttttccatacccaatttgttctgtcgtaagttttccgaggtcataccatgtattcgtaaatccatatgaattttcacgataattaccccaagatgaagtaattttaaaaattggtagacgagcatggccatgataatacccgcaatccatggcatcctcaacatattgaatcaattcatagaactgttcacgagtcaattgattgactttatctacacaacgacggtcatctctttttcgcattgaactcatacgaatagtagtatcatcgtcaatcatccagattcgttgacctgcatacatatcagtaattgctttacgagtaccggcaattccgtttacatcatcaggaatagttataattttagctctagacccataggcatcataataagctttttcttcatgttcacgtactacgatatgaggttcataatcagtcggaaacatatcaagggcagaaactgcccctacacgttgatagctcggaattacgaattgaatcatttccactcaccgttataatcttttttcacaatatgagtttcgccagtattccaccaatgatcaaccaagtaaaaatgacgagaatatacatgaagacttccaacattccatataatagaacctgctttatactgacgagttgaatcgccggcattcaaatcagatactaatttatctaatacgtatttttgccatgcataatcattacggaatccgaagaccacgtcatttgagcgcatgcttactactgcattgactttcttatcacgaatcaggtactgtactgtattagtacacatgaaatctgacataccatctttattgtagtcaaattgcatggatggacgagtataaatcatgataccacgtcgagaatcaggattttgaccaagttcagctaaacacatatcatactgggcatagttatcttctgaccagatagcccaaccataattcgagttaatttcgcctttagaagatgctacctgctgccaaatctttggtgtttcacctggaatatctttaacaaacaagctcttagatttataccattcaagttcacgctgaatgtattcatcattaagagcgccaaaaataaacggttcatctgctacaaatgatgcgccaataatttcaatagttttaacaccagttttatcaactacgaaatctttttcctttaatgcagttcccaaataaaaacggatttcttcaactgtcatagagtcattaatcatttaaacctcaattgatgcattcatatttaaattgtaacagtaataaaccccaccctatgataagagttggaatcatagcaggaactgttacgctatagtatatacttattataaccatcaagattaaaagcaacactgctataattttgcttttcattccttctctctgatgataattacctgatttggctgcgcagactttttagtttcacctgcaattgaccaaataaatgtaataaaccaaccaataattgaccagttaaacagtaaagacgtgaaaaagattcctactgtcgattttgacccacgcatcaaggcaataaaccatggaagcatgtatataataatagccaacacacctgaaactaaaaccataaaaattgaacctgctactaaagtttccatgttttcctcacttagtcaaattttttacacatgaattataagaattcactacatactccatcggagcatttttaccggtacgccattggtaattattagcccaatttgcccaaagctcggcgcagtagttttcaattttttcttcgcgtgtaattacatcagaattacgatatgcttgagcagattcatctggacgaatagcctcgtcaaaattcgcctgcatttgttctactgtctgttttggagcttctttataacacttgacattaggattataaaacttgcttgaacagtttacaatttttcctacatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacagtgctagattcaatcacaggttgagtatcattttcaacactaacaaatggaactgctgctaatgcaactaaacaaactgctaagcatcccataacaattttcattttattctccaaatccgtatcagtagttgatagttgtatagtaccatggaagaacattcttgtaaacagttttgtgaaaatttttttagggaattctaaatgtccagaatcatctgtttttcataagtatagatttatattacttgtatgaaaaagggacccggaggtccctagatttattctatcagccaaacaggaagtctaacgaagctttttcttcatagtccatacctgccgattcacacataccagcaagcggtttaacaaacgatttttggaacaaagttgagtagtcaatccaagacagtacatcagaacgaatttcttttggaagttctgtacccgacggccaagcaatgcacttatcaccaaatggatttccttcacgcaatggaagaaccattaccttatttccatccaaaattggagctacacctaaaccgctaacagctcgacgataagttagcacaccacgaatatggaacggacatttaaatcctggccaacctttatcatcatatttcgctatatcgttcgcagtttttacttcagcaataactttatagtcaagttgacgatattctttctcgaagttcttgtaatattcttggacagactcttcaccttcctgaagaatacgacgaatactttcttcgagagcttcttggaccgctttaggcgttgaactctgctgagtttccatacccatgatttttagatgcggttcagcaaatcgcttatcttccatatcataaacgttcagagcataacgctttttcgctttccaaaatccaccaacgccctttgaaccaagtggagggcaagaaatagcttcacggtccatatgcatcagatgctcgcggttattcatataatcacataactcacgatatgcaacatcaatcataggttccatctttttcttaccgaactgattcatgaattcaactaaatcgttctgctctttgaatcggtcaagaccaactttttcaataactttatctacacaaacatataccgaatcagtatcacctgctgcgatgaaatcttcgccattagttccacatactttattcagatactcattaattttacgagcaatccactgaataccgacttgaccaaaaattgtaatagcagtagcatttcgcaaatcatagtaacggaaatgaatattaccaagagcaccataaagactgttaataagaattttacggttcagctgatttgtgttagcaagtgtagctgctttttcacattcttcgatcagactattaagaacagattcagtataattcgatagttcatttaagaaatcatcactgaacttaacatatcgttcaacttctggtttagttgaacaagaccctgcgcctttcataataatctttttaatagcttcggcattcatttcttcagcgaacattttctttttccagtctttacgctggaaaaatactttagcgatttcctttggaatgataccttcttggtgcttatcatacatccatccattcggagagcaagaatattcatcacttggcttaggagctgttcctgcgatatattcatgaattggatgaactttaaactgcccacgaatagtctcaggactaatgttaacctgacgaataatgctaggatacagagacgtcaagtcaaaactcataatgtatcgacgagcaatcggtttaggttcaaacacaaatgcacctggaaaactctgtttaacgtgcgaaccttgttgaggaataaccttatgttcacctttcagtgagttaaaaataatagcatcccaagttttaataggactcattacaccagaaaaaggcattttagcgtaataagacatacttaaaactagatcgataaacccacgaattttatcaattgcttgaactgattctacgtcaatgatgttataactaatgtatcgttgatgattagtctcacgaagtttattaataggaccatcgtacggcaatttaccttttttggtttcatgttgagcaactgattccaaagagaacgatggcaaattagtaaatgcgaacttcttgtataaatctaaataatcaagaatagatacgccatcaatagaataaatttctttgctaccgtacatattttgaattagtttagattttactcgaccgattggagagaagcgtttcatactacgttcaccgagaaccattttaacacgattcatgatatacggaacgtcaaatccctcaatattccaaccggtaaaaatagcaggtcgtttctgttcccagagattaatatattccatgagcatatcacgctcattatcaaatggcatataaattactcggtcaagaatttcttgaggaacttcatcaccaccttcacagtcaagcttagcagctaactttgcatcccattttgatactgaaccgtacattgaattcaacaaatcaaagacgtaaaaacgatcgtcaattgaatcataatgagtgatagcatcaatttcatattctgctttcattgggtcaggaaatttatcaccagtaacctcaatgtcacagttagctacacgaacaaattttcggtcataagcaatttctgaaccatatgtatcactgatataagcgagtttaaaatcgttcataccgagagcttcgagaccaatgtcttccattcgtttcatccagtctcgtgcatctttcattgatggaaatttttgaggagcacaatttttaccataaatgtctttgtattttgactcttccttacaatgcctaaacatagtcggaagatattctacttcacgggtacgttcctttccattttcatcaatataacgttcaacaatgttatttccgactgtttcgatagagatataaaattctttcatagatattccttagtttatagcccgagttattaggctcttgatatattatactccaaataaggggccgaagccccttgcttaaattaataccagttgtcggtgaaaaattgttaatccatctgcattaattgacttaaccactgcggtaaagtgtttttgttctgggtgaactaatttttgaaattctacctgaaattttagttggaggttttctggtaaatcaaaaagtgtttctgttgcagaaagattatatttttctttaagagacgccatgtattcttgcggagttatagcagtcatattaattaccaatcgtatatttaggaacgagtttccattcatgcttttgtttaaaagaaataactcggaagttattagttaaatctttcataaaagttctttgaccaggaacgatttcaatcagtccccaatcttctaatagccatgcaatcgaatcacgacgaacttcatcttcttctgtcatttcaacttggcgaccatccatacgaagcatttctttaaaatgaacgatataatatagtccttttttctgaagaatatgacaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaaacctttaagttcttttaatactaaaggtagttttccatttttagtaagaattgatttatagttaattgcatcatttgtattaacttgataccgtttagtaagtaacttaataatcaatacttcggtggaatcttcaaccagttttgcccatttaccatatcttttaccacgaggaactgcagccattagataattaaaatgagcttcatcacttaatccagaaccgattaaattcattgcatatacagctggcatgcattctggaaattgtgataatgcattttcaaccatgaattttgaataatctttttgagcaatagagcatttagttttattattgatagctccaattatttcaaaaaattcattttcggctttttctttaaaagaatcagcagcggattggacagctgtccaatcttttgaataccaagcaatctgatgctcgtttaattgaatatcatcttcaaataagctcatatcacttccactgcatttcgcacgctaattgaatgaaaagatatgctaaatgtaattccgtattagccgcaattccatgatactgattattttcgccaacaatttcgtacatacgaataatactctgtggagttacacgtgaatagatttcttcggcaagtttacccacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaatgtaataactcgacagcgtgactgaagtggtttaataataccatcaatattgttagcagtaataataatactacagtttgaactataagcttccataaaggaacgaagatgtcgctgagattctgctaaacctgaacggtcaaattcatcaataacgattactttttgacgaccatcaaatgaagctgcactagcaaaattagtcaaaggaccacgaacgaaatcaattttacagtctgatccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctctattaaaaatcatgggtagaatcagcttcaagagctactacataattcgcatgttcaccttcaaatttagcagcgccttgtttaccttttgcccaaagcagaagtttataatttcctggttgcattttcatatttgccatattgataatgaaattaaatgtgttttcaccatcataatcaccaagagtcaaagaatatttaacacgagtcaaagcagaatcttctactttattaaaaccgttaattacgattttaccttcttttaccgtgatagcaattgtatcaatttgcagaccacgagatacacgcaacagttgttgaaggtcttcagctttaatttcagtaacaacagatgctaccgggaatggaattggtttattaggagcaactactgtactcggatcggctgctggccaaaaaattgttgagcgggcatcagcaattttaatatttccatcttctgactgggaaatttctgcatcatcattaactagagacagaataccgagaaaaccgttcaaatcgtaaattgctacatcaaaatcaataacgtcagaaatatttgcttccgcataagttgtaccattaactgcgcgagtcataataaattgaccggatttaagcataataccagagttaatagtagcgaaatttttaagcagagcagtagtatctttagacagtttcatgtaatttccttcaattcaaatgagatttaattttataactaatttaataaagcaattaacgattaaaatcagctgcgattgtttcggcaacaatttgagcggcaacaatcagacgttcatctgcattgccacaatattcatcttcaaggcgttcaccacatgaagtcataataaatttagcaccagcgtttagggattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcatttctattggacattatttttgtatattctgctttaaatgcattcctaagcatagattcagtaactatatgctcttcattagaaaaattatttctcagaatatatcgttttatttcaggaatagttaatagatgctgtccggttgaatattccatgtttttcctccatagagattatactctaataaattaaagcataatctcttataaattaaaccattacagtaaatcgaccaactttcttcatttgaagatgctgaccgtatgcttgcgggtcatggtctctatgcgaaataacaaaaacgttagtattttttaaactatctaaaatagttgaaatagcttttacaccttcaacgtcggtcgctgaatcaaaaacttcatcaagaattagtgtgtttattttaacacctgaaactttttcagcaatatcacgccaagtaaataaaagagcaatatcaattcgtgctttttcaccttgactgaatgaagcataactaaaatcttcacgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagccgctttaacttttttagctttatctaccgtcgtgattagagattgctttttattgcggatatcatttgccaacgactgttgggttttaatattatctcggtattcatcaacaagaacttttaaattatcacgatgcgttgaaagctgttcaaatgaatgtgtgcattcagaaactttatctttaattttagaaacaactttatcaccggaacttaattgtgacaaacaggttgggcataatccaccttcgtgatacatattaatgactttattatacgagtcaatttttgatttaattaaaactgcttcttgaccgattttattaaatgcatcagtcgggtcttcgtctaaaacaatattaactaatctttcattagcttcttctatttccgattttagcgttctagcttcttttgccaaatcatcatacatattttgcagacgagtaaggttgtcacccgttaattttttctggcgttcaacgttatcattatatattttaatttgttggataatactatcttttttaacatcaagcacttggttttgtgaatttaattcgcgtattagtgctttattaagcttatccatttcagctaatgttcctacctcaagcaagtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcgaaaacgttcggtttttgtcctcttttgatatagtactttttctcatcatattccatccacagttcaactaaaagttctttcttatttgtgctgtttattaattgacctttctttacatcacgaaatggcttgccaaaaagcccaaatgtgatggcttctaacatagtagacttaccaccaccatttcgtccagtaataagagttttttgaaccttatctaattgaatgtcaataggatttccacctactgacattatattttggtacctaactcggtttagtttaaaattcttcacaaaagattccttttaatgtatcttttagaccattctatcatatcatcataatctaaaaagtattcatcaaattcagccatgcaaacaacaccttgtgctgtttttgatgtaatataaattattccaacatatctagaatcttcttcggtataatcaatgtttgctatgaattcatcattaatgtcaaatgtcgaaaacttcacagtatgcatccttaatacaagatacggacatatctcgcaatgatttaggtgtgtcattatctaaaatgttgaagttaaaagatacagcccaatctgtacagaccgtaacttttttaatacaattatcttcaacctctagcggttcaaaccaatattcaataatttctttatgaccaatatcatcttttacttcgcattcaaaatgctgactcatcataacatttttaaattcatcaaaagtcattgtgttgcctctacatataactgatttgcatattgaataagtgcttcacggtcagaatcagtgatgtctggaattgcattaatgtattcttccatcaacgtctgaagagattgaacttcaacttcttcactgtcatctgactcgacagagttatcaatctttgacacaactcgtaatgaatgcacaactttttctagttcagattcgaacttcgtcagatttttgtctacttcagttactataacacgtactgatagatttgtaaaatctttatagtcaatttttcctttaaatggataatgaattctacgatgccaggtagtattgtttggaataaattccattcgttctgtttctgtatcaaacatccagaacccacgagggtcattctcgtcacctgcagttagtgtccatggtgtcccaatatatctgacgttagcagcctcagagatagtatggaagtgaccagaccacacctctttataagtcttaaggaaatcaggttcaagaccgtgagatttcattcctttataaaaataaaatccattcagttcccagtgaccaacacaaaaagaagcagatgaagttttgatatgctcaagaatttcaccagtattttcttcacacatccaaggaattaaatcaattaaacatccgtcaaaatctactgtagtaggcttatcatatactttaacattaggatatttagccaaaagctcagtagaggcatttggagttaaagtatttttaaagtgcatatcatggtttcctacaatagtatgtagggtaataccagcatcatcaagcatttgaactatttcacgggcgaactccatagttttgtgtgtgattgcttttcgcacatcaaaaatatcaccgtattgaatccaggtagtaattccatttttcttagaatattctattgcttgtttaattccatccaactgaatggattgaacccactcatcatcggctttaacgcctaaatgccaatcacctaaatttaaaattttcatatatcaagaaccgtcattgaaatgcaaaataaaattattgaaataaacccatctggcgtgctaaagaacccaatccaacatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcataagctttttcgcgttcacggtcataaagagttcggtcagatgacagttctttaatacgttcaaatgttgattccatgtcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaatccggatttactcatgcgttcaagcatttcgctatttacataacggtcaagaatttgcgttggcaaattaggagcaattttaatttggtctacttgatgaagacgataatactcgtatggaattcctttttctttaataggaatgaacgctggagaacgttccagaccttccataatagtacttagtcctgcaggtttaagatgtttttcatgaaaatcaaacatctgataaaaacctttccatgtagtcgtacgaccaatccaacggttgatattcatgttaatttcagaaacatctttccagtaggttgaccgaaccttcgcaatatccataggaggctgaaagttatatactgtcggtgcttcttcaatatcatcaaacagagaaactgtttcaggataccattctttcatcagaactttattaaaatcaccattatcagaatggctaaaaataacatcagctcgacgaacagtttcttctaatcccaaatttcggcgcaaagaaagagaagaatggtcatgttgataaactacaacacgaacagaaggtttaatgttatcaataatttttttatagttattaatagtgtcttcttcaaccgaagtagcaggaactgaattgataattagaatatcacaatcatttaccagcttaagtgttttatcgtattcttttgctaataaaaccggaattgaaaatgatttataatcatgcgcacaattacgagtaaatgatttatctttagcataaaccaaagttacttcatgaccatttttaataaaccaatcacgctgctcaagagaaaatttagttacaccgcaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcataactgccaccattttttgacttgataagaatcaacccacactttcatattggggtctgctcttacaataggaggattaacttctttaattgaactatcatggtattctttttcagaaattttcacacaaagatgaccattcaaagattcagtaaatcctgcattaattttaagacgcttgaattttacgtgtgtaagcatcaatcatatcctcaatctgcgatctagtagtcttccaaagaatactgatgagttcatcgttatatggctgtttcagaatatcccgacttttcttgatagcatattcgtattgagcaaaattattgttttcagctgcgatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgataccgatagtttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgttggacaaatgcattaaaacaagcttgagttatatacgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaagcagtatgcttggaacactttctccatcatctttttaaattcatgaatatctatgtaatgatcattaatatcagcgcgatataaaaagtctaaaaactttttatgtgtactaacatattcactttcatttaattcagaaacatggctttcccaatatccaacaccagttttatttgggaaaaatgaaattttcatgtattggtcaacatagaaaataccaaaattttcaatagcaatagaaatattaattaatttcatacattcatcaacttagccgcttcaagagctgcatctagtgaatcaaattggtcaacatattcaatcaattcgccgtaattggcatataaccaccattggctaaattcatactcaaggatgaatccgtttccttcaatttgagttaaaccaatgccatttgtatttacttcatatccggcaagacgcaaatcgttaataagagcttcgttcataattataccttagtaattttcaggtctgcaaattttttcttgcgttgatttttcatacgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcagagaaactactttatcatatgcgtaagaattgatggcgtttttaatttgaatagtcatacattatcctcaattgcattaaaattttattatccaaaaagggccgaagcccttagctaaactttttggcacccttccagccttcgtacatcattgcgactgacaatgacaaagctccttcgcatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattaccattttcatcaataaatttaatccagtcatttactaaccacttagttgtatctccttttggagtagcatttaaagtatatagcccttgcttaaaaagcatgcgtttgatattcatattttcctcagctataacgataacactcgtttgatttgcgcttagcaactcgttgagaagtattgtaatcaaaatcatcgtcaatgtaaactgattttttcaactttcttacttcactacgtaattgacgatttagctcatctttaacttctgaatcaatgcctttcattctacgccatttatcagagcgaaaaatgttttcaaccatatctttatgacttacaccatcaggagctttacgctttccgaaatagtcataatcacgtacttttaaatctttacgacgatacgttttacccatggagtttaatttccttagcaactgaactaaatacagcacgatcacaaatcatctgtttatgtaacttgagtataaaagataataaacttcaaaaccgtttacataagtaacacgaacaacattaccattaataaaataatattgtccctttttaatctctttatcaaccacaaccatatcaaatcctcaaaggcaattcatatgttaataataccacagtttgaacttgttgtaaacaactttgtgaaattattttagggaatgataagaagggaacgatagcttagaatggtaatatacagaatgtgagaaagaaaggcccagagggcccgtcttagtcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagtggacgatcatactcaatcttaccattatttgtaagaactttatagaaagtaaaaggagcattgagctcctttagaagttttgtaactgattgacatccaggacaacgacctacttcatctggaattccatagacttcaatcttattctttaagttcgagttttgttccacgagaaataattccttggtaagcccaataaggaggattaacagaatcctcaccagagttttcttcaggaaaataaacctggataacgaagccggattcatcaaaggtgaaataagtagtaggcagttcacctaacaaatcggcacgagcgttgatttcttcgaggtcttgttcacgtccagcccagaagcttgggttcagactacattcatagaaataatagtcattaccgaacatatcaaaaccattccaactctctactacataccgctcaaaactaatcataattaagcctttttatcaagaacagcattcagcttgttagtaattttatccagacgctcattaaactcactagaagataagcccttttctggagaaattaaactaatcacgaaaaatatagcaataaaaggaataaggaaaatagctccaactgccataaacagaaagaatgttacagttgtaagaaaatcagctaaacctttacgaaatttatacatattttacccttaattaattaaccaagcattgataagcactaaactatattgggaataaaattctggaccaaaatgaaaaatcatatcatttatagtatccataatataattcaatttaatcatgtttccacaccccataggtatttgaccaaagtcgctgattatctgatcctcgccacagctttttagtcggaagatttttctcatactttccatcaataataacatcaacatatttaagcatttctagttgtttaatatcttcaaacttatatcctgtccacaaccaaatgcttttattgggataaagattttttactgtttgaacgatgcaatgaatcacgtctctgttatcaggataaagagggtcacctccggttatagttaatccttctatataatcattattcaaacattcaattaattgttctagtgtttcaccagtgaatggaataccatttctagcattccatgttgatttattataacacccttcacatttatgcaaacaacctgtaacgaaaagaacggtcctgcagccaggaccattaacaaaatcgcaaggataaaatctatcataattcattggtgcttaaccctatgcatgatttctttatttttgccgagattaaatccgcgttcgttcggatttcccaaataaccacatgttcttcttattgtgttcatctttttaggatcagtttctccacaaatagaacaaacaaatccgttttcagtaggagtcatttcatgggtacttccgcatgtaaaacacttatctactggcatattaacaccaaaataatctaaatgttgtgcagcataatcccagacagcctcaagaccttttaggttatttttcatatcaggaagttcaacataagaaatgtgaccacctgtcgcaatgaaatgatatggggcttcgcgagaaatcttttcaaacggagtaatattttcttctactgaaacatggaaactgttagtgtaccatcctttatcggtaacatcttttacacttccatatttttctgtatcaagtttacagaagcgataacaaaggttttcagcaggagtcgaatacaaactaaaagcaaacccagttctttcagcccactgtttaagacgagcattcattttagttaaaatttcttgtccaatatcacgaccgacaagaatattcaattcatgaataccaatgtatcctaaagacactgaacttctaccgtttttaaataactcaattatgtcgtcatcaggtttaagacgaaccccgaatgcaccttcttggtaaagaataggagcaacagtcgctttaactccttttaaggaactaattctacacatcaaagcttcaaaacataaatccattcgctcattgaacaattcagtaaatttctgttcattgaactgtgttccaatataagaatccaacgcaatacgaggaagattcagtgttacaacaccaagattattacgtccatcaagaatttcattaccggttgaatctttccacgcgctcaagaaactgcggcaacccattggagaaacaggaatagatgagccggtgatagctttattgttcttagctgaaataatatcaggatacatccttttgcttgcacactctaaagcaagctgcttaatatcatagttcggatcgtctttataaagattaacgccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggagtctgtccgtttgaactaaagagagtatttacttcatattcataagcttggaatgcatcgtatacatctttttctgttttagattgagcataatttaacgcatcagcgatttgccatttttctgcatcctcaatatgttttgcataggtgcgtttaacataaggagaaagtactttatctacattagcaaaagtcgttccgccgtattggtgagaagcaacctgtgcagtaatttgcgccataattgcagtagcaacgccaattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaattgtgttttggtgtcagattcattatattcaaatcctctttgaagcatctcggccatcatttcctcttttcctaaacgagaaaattcctttgatttatctccaacaaagttaggatgaatattattttgggtgtaatcggattttaaataagtaagtaaattttctaaccattcaagataatcaacaccttgtccctttaagccagaacgattaaatttgtgcttcatttgaccttctgcagcattgcagagattacaaagcaatccacgtacctttcctgcttttggtccatttaattcatggtcatgatcaagatgattagcttgaacgtcaggatttagttctcgttggcaaattaagcatttaccattttgtgcatcataaaatttttgtttttcttctttgtataatttgccagtcaataacataataaatacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgtcctgtcagaaaaagaattttgagtttttttcaagtattgtaaaacatttgatgcaatcgcttatattgccgaatcttttggtcagaaaaagaaatttgagtttcaagccattcaatgtactctgcggcagcttgcatcaggttaccttcatagccatcgttattttcttgcgcagctaatttagctaatgcgtatgaaatacgttcaccttgaaaagcggctttaggcttctgaacatcttggctagttctctctacaacttcttcaatttcgccattttcaacggattcagtattccacaaacaccagtatgtaattggcttatcatagatgttaataatctttccgtcggaaagttcaatttcaataattccagtatcaggttctatatcatcttcgcattcttttgcaagttcacgaactttaaagacagtacctgcactaagttccggccagtaattacatagccctgtatcaacacgattaattctaaaccacttatctactgtaatcatgtcccatctccatatcaattaagtcatttatcgttggttcattatatactgtttcttcatcaatgtaaaccggttcttccggctctggctctacagtttcccatctagccgcccaccaaggtttaaccccgaagcttattaagttcttcataatcaatccaggattctaatcctgatggcaaatcagattcaatttcccaaagaagctcttcaattttctgaagacgatctagttcttcggctggaatagtaaccattgacggagttcttgatacattaatatcgtaaatcatatttaccccaatttaaccatacaatcgccgtatttccacttagaaatagacttttcaccattagaataataaacttcgagtttagcacgattatttttaatttgaataaccttggctgtcatcaaagttccatacccataataaactgcaacttcatcacctacatataccgcgcttccgcggtaatcatgaatatagtcagttccttcgagcatcatttaaaatattctcgcagttggtcaaatccaccaatatgacttccatcaggagcaaatacctggggcattgtcaagccgatttgagtatcacgacctagtttagtcagaagctcagcaattttctcatcatcaaaaacacctttttccggcataatgttgataaattcaaacggctgtttcttcacggtcaaaagacgttttgcattatcgcaatacacacatttatgaatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccatgttcattataataagctattgctaattcacggactgccttttcagcagcctccatatattctttacgcttggtcatttttaatccaaaatattattaggcattggttgaacactcacaagttctttaaagaactcagtagagtcaggcaatttaaccatttccggagcatgcttactgaatttatgtttacattgacggcatttatattcaagctctggtttacgccagttaatcaattgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgctttggcggttaaagccttaagaactttagtatactcttcaatctgtttttcaacttcaatcaaacgggcactgagatattcgcgttcttctttcatagtatcatttccatgattggattttggtgtaggtttaaattcactagggtcctttaatttaataacaaatttagtttcaaacagcgaaagaccataattcgtattatcatcaaaggatttgactacatccatatcagataataacacgcgtaaattataagccaaagaactaatagtttcattgtgtttattagcttcgcgtggtttcatatacggaaggtttttatatatctcgtgcggagcacaaatgataattgacaattcaaattgcccattctgggacgatggagtgaatttagccgtaacccagtcttttacattcacattaatagtacggttatcaccatgacaaaacagtctacgagaatgcttaaaaagcatattcacgttattattgaattcgtgtgaaaattcactagcaaatttttctttactatctttagaaaaccattcttctaaataagttcttttcacgtcgttaataatattaaatgtaacaacactagcatttgatacattagtctcaatgtagcttggatacataaattttttaacattattaacagctatcacagaagatagtaatcgggaacgtttgaaccactcgagcaaagaaccaagagaatgtgaatacgcattttgtgtatctttacaaatatggttttcccatccaatatagtctaaaaaatcacgaagaatattattgattactgctctgtgtcctatctgataattacgatgtttagtaataagactgtcaaaataatcaatataatgtttacgagttttcatgttcttctcacttggttaatgatttatactccgagccatccttggctttaaattacttaattaactgtaaagcttgttccagacgatcaagacgattaacagattcttcccaaatccttttagcctgctcatattctttctgcgctttattagaaatttctagaacttctttataagctttttctagtgcaataacttctggacgaatttctatcggttcaggtgaatcatcaagacattccattagttcctcaagggtagtttcttctttaggagtattcacaatttcatcacatttttgttggtaaatttctttatcagtaggtgaataagcacatttcacttcacgaaggctaattacgagtttatatccttcccaaccgcatatattcttaaaaggatatgtatgaatattttctactgtttccatacaaagtaatgcggtctctaattgacgagttatagtgctagcaattgagaaaaatttattaatattcttttggttagtttctggtgtaaaaaatccataattcacaaaaatagatactttatttttatcaagttcatattcttttatgataatcatatcagaagccaaaggatgaatttgacgataatcgccataacataatttagaagctgattttagaatttgtttcttaaaaagtctgaaattactgatccaacgacgagtaaaaatattctcagggtcttctttaatattaagatgataagaattaacatcaccgaaccaattgtatcctactacatctttagttcgtttaatttctttcccaaaattaccaagaatatcccgattaaccaaatatgaaagaagacgagactctttaaaggttttcttgataacatctttatctacacggctagaaattttacgaatttcatgaataaatttagtagaagaaacaatacttgcatcaacactattgagccattgattgataatagaaagaacgctattttggccaaacatcggtatagctttatcatcaataacgctattgaatgatttgatatattcgttacgagtcataataatctcctcagtagaaagtaaaaacattataccacatccttgtggcaaagtaaactagttcagtgcatttagtgcattgttcagtttagaacgttgctttgtcagattttgaacccttgactgagcttgttctaacgccttttcagcttctagcacttcattggtcgctttaacgagttcatcatctactgccttaagagacttctcaatcgcgtcagcgtgccatttttctacaggtttaaaatttgaattttcagtaggaagaaaactcactttattaagtttacatgcatctatattgcttgagctatacatccaaaatttaggatcgtttgataagtaattggataaatttaaatttaaggtatcttgcacttcctgctttttctcttgaacaatttcatcctttctcaaaaattcatatttaaatgaaacgatcatatcaagttcatatgttgttgtatgttcccaatttcgctcaaaacgaggtaaaatcttagattgaacagcagcaacaacatccatatacttaaatgcttctgtcagctgtgatttaagacattcacaaattgaaagagaatttttagtattaggcttaaagctaattcgtgcagttctattattttcttttaacggtcttacttccatctgaagagtataaccatcaaatttcaggttctttaagttaatatcagagccttttaatcgactagcagtagacaaaatttgctttaattgtttacggaatagagcaataaatctccattcaatacgataatgatttggattgaaaaatccagatgataaatcgaccttactttgaccaacgccttgaacaatcaaaggatttttataatcaatagttttacagaaatcggtgagctgttcacgagcagtcatttgtgtaatataccctgctttactaaaattacgcacccattcactgctattcgtatacttaaagtgatgaataacacgattaactttatcagggtctaaattattttcacacaaaaatgtcataacatcacgagtatagctggcattacgaaccatatcttcaatttgagaacgagttttcatggtgttccttaagatttaagtaaatcaacgattttaattaatttttcacgctcagatttagctttactactcaatccagatagtctgaaaatttcatcatcatattgctgaatagaaatatttagctcttcaatctgcttattaaaataagcaatttgttcagaatgtttttcattactgcgaactggtacaggttttgtaggtaatttagttgaactggattcatctgggcgataaattaaaatgcaatttgaaccaatcggacatttagcaccagacacatattctaatgttccggcttcttttaaaacttcaaaagctaaacagagatgatgccccatattaacataatctgtagagcgagctctgatgtaataatcatctccacgagtactaaatttaaagcatttaaggtcttctgtattattggtcttaaaaatcatttgtttatctagacctttagctaatcgagcgcctaatgctaataatcgtcgttgattttcccacaaatccgcaatcatttggtcaaatgataatttcggcattagtcgaccataaaggtcatatcctttattataattgcgaaggatttcactcgcattaatacgagacaacgctccaattttattaagggctttcatgatgcgattagataaacccattccagatccgtttgttcgttgcaaatgtttatctaacccaaacccaatatcaactttaaatttatctaaaatttcagcgtgaacatctctgtcaataacattcaaatccaaagttgggttaaatctatgaaaaaatttatctggctctccacgacgaagtacagtccattcatttaattttttattaactaaagatttaattactgcattgacattattaattactactgacatattttcctcactcaatttcaattttactaaatatacagaataagatggaacagactatataagcaccacacacagattgaactaataccattccaaagaaccaaacaatattatcaaacaatgtctgttttacgtcgaaaggacgtaaacttacagtaatattatcacctttttctattgatgaatacatctctggggaaatatattcactaaatctataaccatctttgagttcatatacggcaataaacgataaactagacccttttccttgtgttcctgtaatggtattaactacagtaacatcataatctttataatgcatataatcattaattgcgtaataaccatatgcaattgctatacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattctggcgttcagctctttgctttttgtaagtttcaatacgctctgaaatgagagtgtatcgttcatttactgattctttcataaaatcaggaatttcacgagaagctttaatctcatcaaatttatcaataacagcttgctcttcagcaattaagttatcatacatcaaaatatctttcttgatgaactcaatatcttcttgagttacacgagataatttagatgctttatcctttttgtactgttcgttagtatcacgagaccagtgtaatgtacgatttttattcgtattcttgtaaatttctacaataccaatctcatcgataataacgatccaattccaacgagatttgtaaatttgtcctccgtcaaccgtgatttcacctccgattgagatgtcattaaagaacttactttgtgcttcagatttaaatttaccatcgttgtaatttaccaggttgaaaatatctttagcgttcattttgtgttcctccgtagttgatagttgtatagtaccacagaggaacagtcttgtaaaccactaaaagaaacttctttcacaattttttccactgaaccatgcgcttaccgctttcttagtctcaggagcagtgttatccataaaccattcaaaggcagcctttttatgattctggagggcttctcgggctttaatctgctcacggtctattaacactaacatatgagcctttcttgtcaccatgggcttcttatgattttttgaatactcccagtcatttgtccatcgcattgtcgttgcgaacttaaatactgcttctttaattttagtttcgtaaatttcacgagcctttgagtataacatcattacctccattcaccagtttaattctagtcatctttttaatggcagtccatataatctatttctgaactgcctttttgtcatagaagtcctcttatgaattatttcagaagagtaacctcagcaatttcttcccaaccgtttttgtcggtcataataaagtcagcaagataaagagcagtacgcagtgaaacattgcgtaaacgattaacattaactttcatccatgataatgctttataagtttcttcatcagaaagaccgcgcttttgcatcatgtcagttgaaagaataacatcttcaaccctgaccataatttcttcattagtgtgaacacccaaatccaaataaaccgagcgggacactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagatgcggtgctccagcagactttacgggtctctccagtgtccagagcagctttcagaagattaagaatgtccatatcagagaaaacatccacatcatcaatcaaaaggacagaattctcttcacgattattccaaagttgttcataaagaccgataccggagattttaccgttaatgcttttatattcaatgtatccattatcatttgctttattcaaagctttatctaaagaatacgttttaccaatacccgccgcaccagagataattaatgaacgaatgtttccgttaataataccattcgtcatcattcccataacattaaatcttttattaatgcgggttttcatatcttcatatgattctttaacttcttcaacttttacaccatcatatgaaatgtctgatttgtaaacccaaacaccgcgacgcttaccgtcaatttcaacaaaaactttaccatctccttgtgcatctaccggagcattatctgggaaccattcacctaagagctcaaaagttccagagatttctttaccgaagtagatacccttattgatagttacagttttcattttattctccaatctcacatttgttttgatagggtaatagtatcacactactacccttctgtaaacaatttattttaacgttcgccaaatttttactgcttcacggcgagatacttctacagctccaagttctacagctttttggcgtcggcgagcgtgtaagtcataatgtttaatgcgtttatcttgaaaccaagaacgtttcattcctattgcttctgccatttcatgaagctcttcaatatctccatcagtgaacatatgacaatttttagttggatgaccgcgaagtttccatccatgattcattaaaacatctacgtaaactgtcattgattcttctccaaataagtttcgataattttctgggcgagataaaccgcgttatcttcagttgcgtcttctaagaaactttcaaaacactctgaaatttcttctgtatcaatcaacttttttacttcaattggtgtaattttcattttgttttccgtttaagtgtttgttttgatagttgtatagtaccataaagctttatgcttgtaaacagttttgtgaaaaaatttttaaaataaaaaagggagcccgaaggctccctatcatttataataacttcgatggttttcaagatagaccttctcaaggaagtcatcccagaaactcatgtctactttttgctgcataccgttcttagaagcttcagtagatgctgcttctacttgatcgaccacatcttccaaaaactcttgaaccgttttaaatggatgtttacccaacttcacgtcgagaataaatggagcatcttggagtggataaaccaagtcaccagttttgtaaatttccaatagttggagtccaccacggcaagcatgactcagagctttccagtcaataccttcattggcttcggccttacgagcgcgttcaccatattcagcatctaatttgttcagtgactgcttaagctcaataagagaaagcgttgtctgatatttacgacccaacactgtgtagaacgtctgtgggcctgttttctcatgattatggaacacccattcacagaattcgttttctggaagacgatgcttaatatcttcaactttagtacgacgctgcttaatagaaccatcttcttggtaatcaacccactgctcagggatttgattaactactttcaatacatcacgtaatgcagccaaacgagaacccttaacgccgtatttagaagcttgcttacggacatatcctaaataggatttcatgttagtcgtataaaaacgagaacggttgtcttgaataaacttccacacatcaggcaaatcagatttaaccactaactcaggtggagtgtgaagcatatctaacgctacagtttcaccatctgctgctaatttaaagaaatatttaagactgtatagttcatggtcaatatcatctttagtgtttttagatgatgtgttgttagtgtttttactcatatgctctttaacatttccgataagaatatcgcgagcaggaggaacaaagatttctttaaaatctacatcagattctggagtagaagttccataaagatgactaccaaaatagcttttcattactgttttcatcattcagccttatattcaataacaggacatactttagctttacgcgcttttaaaaattcgacgataatagatttcttgggttgaataggaggtaaacctttatacgccctatcaatattttctacatgtaaagcataatcctttttccatttataatctttatatttttcatgtagttgtgcaggaataacaaatgaaccgataataagtaaaacaagcaaaatggcaagtataaatgctgatggaataagagtccataaactaccaaaaataagccatttctgtatgatttctgcacagataatagttagacctgcgagtatagtacatccgaaaaaagaaacgaaaaatgtagggataacaatagaccaaaaatatgcacaaagtgtcttaggtcgtttccattcgtcgttaaacattttgaataatttataatgccaagagttttcattaataatcataattatcctttcattgaaggtgtaacagttgttaaatacttaatcatagcttcagcttctgattttgataatgaaatttctccattattttgacgaatagaaataaaatccggatgacggtcaccaccagcttttaaaacacacatataagtatcagtttcatcttcaatatttgaaatgattgaagcagttccacatgaatgtggtttttgataaactaatacagcttttcttccaccatttgactgttcataaacttttaatacatcaaacaaatcacttcttttatcaatagctaaaatgttgttttcatcttcaatgttaaatccttcggatacttcataaagtgtcacccataaatcacctatatcgatagtagcattttcctttccatgactttcaagagcatgacaaattttcttgatttcgtcataactcattttaataatatcatctccttgactaagaaagatgtcatttttaaattcaacacgaattaaaccgcttccacttgaaataaacatatttcctcactttgaaatcatagttggaatgacagaatcaagataagtctttaacgcaatagcttcgtctttggtaaatgtgacaatatgtgatcgaaaatcgtcaatttggcgaatagttaagacatctccctcttcataacattttgatacatttaaaagagtttcatcattctgattgcaagcgttagtaataatagcattgcaatttttgagccattttaaactatgttttctttcattagaataataaaaatatttaatcttatctataaaactatcccaatggataactgataaacacattgactcacttttaatattaaatcctgggcatgaagaataaaaatgaattttgtgctcatcattgatgcttactattttatcagtataaggatattcaatttgggttaaatgaatgatttcactaggcgtaaaatatagcatatcgtcttcttgcgtcaaacgatacatgttatttactttttctatagccaattcaccaaaaagcggactaacttctaatactaatcgtttcatattaatcctttttattggcacgaatttgttctaaaattttagaatattcctttgtatcagatttacgtacaattgatacactataaggcatactatcggtgtcttttataaagcgttccaaatgacactctaacaaaatttctggattataaatcgtgtacatcaaattacctgttgctccacgatattggcagatttctactgattgaacaccattccataattttgttaaaactaaatcacctacttctaatttaggaaagcccatgttattcaccaattaaagtttcaatataagaatcaagatttactttagcttcttccataagagttttgtatttaatcttgttagcatgtccggagaaagctgattcatcaataactgttgctgtatgaacagctttgctatatgtttcaattaattcttttaattttaaaagcctgctcacttgtcattacatactcctttgaataatatcaataatgttgttcaccagattataagtaaacattgggtaattatattgaatcatcacatacacaacaaacaaaactttcattctcttctccttggcagttgacaagattactatatcataaccttgccaacttgtaaaccattaaatgacgttttcaataaaattctgaagctttgtatgagcatcaaccatgattttcaattcttctttagcgaaagctgtacctctttcacgagaagaacattcatagtcagaaactgcattagcatattcttcaattagcttcattaaaaacatctgcttttcagttttcattattccacctaatcatttcaagatattgaactaacttagctttagatttatccaaatcctttttagctgcttctataccatcgtatgaatatccttcacaatgctcaactgctaattgatatgaatctatttcaatatcacgtgctaatttaatgattttttcaaactgttcgcgtgttagcatacttacactctcgtattatgatcgataatttcatcaagaaacatatctaacgcttctaaagcattatcaactttagcttcaaatttttcaatacctttatttgcaatgcctgccgaaaaccaagcaaagtcactaagttcctcatctgctttgcgaattaaagctaccaattctttaattttatctgcttgttcaattctagtcattattccaccacatatgaaagagagaatattgcacacgccatatgagttgcagcttcatcacacatatcataacgtttcttaagaagttctacaagttcttcactagtaacttcatccatgtcgacgaaaaaatcaccattaatgatgacgtagatatttccttcttgattaagtgcttcaattttcatgatgttctcctctttatccgatagttgtatagtatcacagctcaaatggaaagtaaaccggtaaaatgaaaaaagtctcccgaaggagactaatgttattcgagggaaagaagatatttactctggtaaaacatcccagtaatatcatctatcgtgctttgaatggctggaggcatttctttataaatgctgttagattggtctagtatgcgatcaatcattttaattgtgtcggtaggaagtttactggcatctggaatagaaggcgtgtattttctaccagaataccccaaatattgctcaccaaatttatcaatcaaatctggcaactcagagaaaataaaatcgtatgctttgtgtctagcataacttttagtttcaaaatgcgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgctctatacattcaaaatcggaagagcacgggtcatttttataagtcgttcgcataaaactatagaactgttcagatgattctacgcttttattttcaaaaagcatataaacgtgtctaataccagattccataaatttatcaaaatgaggatcgacattcgcttcaattggtggagataaagcaaacgctaatcctagcatggcaaatagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagaacagtaagattgcgaagttgcttttcagttaattgtagcatatatacccctttagttagataaacctatttataacttttgcactaaccgagctttttagttaattcgttccaatgttttctacacaaagaaacataaatttcatcaccaatacagatttgattaccttctttaactggtgttccatcttccattaatcgagctgtcataatagcttttttaccacaatgacaaactgcctttagttcaataagtttatctgcaatcgccaaaagttctttagaaccttcaaataattttccagcgaaatcagtccttagcccataagccataacaggaacattatatgtatcaacaattcgacttaattgatgcacctgttcagtttttaaaaactgagcttcatctacaaatacacaatgaatatctttttgtgcttcagcccatttatagaactcaaaaatatccatatcatccgtaataatattcgcttcctgcttaattccaatgcgagaaacgacttcacagacagaatcgcgagtatcaatagcaggcttaagaactaatacacccattccgcgttctttataattatgtgcagcagtcaaaagagaagcagattttccagcattcattgctgcgtaagtaaaaattaaactcgccatatcaccttcttaaagcatattcacataagctattaattcgttttctttcttatcaaaccgatcagcaaattcttcttgctgttcgggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattgacagcgagttcaattaaattatcaagctcacgtaacacttcatactgtaactcaaaactattcatttcggtttaccttctttaacgaaatcaggataaggataaaatcctgaataaaatccttcacctttatgattgatgcatcctttattagaacaatagcaccaataatcgaaatcacaagccatttcatcattacataaagcaaaaacaactggccattcacacttttcgcagtgggcatttttaagaatactagtttggctcataaccatgtaacctttaaacaatattcttctacatgttgtttacgacctttcctatcaataaaggtatattcaacgaatgttccaatatagtctttatctacatcatgtggactattaattgggcatttagtacggcaaatgcgttcccattgacgaataatttccactttgtttttaggatcaaacggatgcgggtaatgtactttcataatccaccactattaaatcaatatcaggagtaaacatgtcgattaatttagaaaccttatcccaatcgccgccagcaataccgcaacctatgcgtggaatgtaaattactggtttaaacaaaagggtttctgcctgtagatttaattctatcatgcagtttactaaagcaccataatcaagattaggacccggttcgtattgtgtatacaggttatagcatataccaaatcccgtaggactatgtttaaaaacaatagacatatcgcctaatttatcacgagaaccgtactcggtagtggttttatctatttctaaaattttgggataggctcttgctaattgacccgctacgccagagcccattgtgtggaagcaattgcacccgtgcgcaataatattaccttgaagaaatagggcgacaatatcgcccttgatatattttacaatcatctagtactcaatcctcgattataagaatctactaaacggtcaaccattgaatgacaagcggctttatctttctcctccgcaactgaacattctaaggtattccactttttagcatatcgttttaacaatgtatcatttttgtatctgcttgatttatctctttctccgtctttatatgcatatattaatttctgcgcaaattcagcttggcatgctttatttttcccgcaataatccgctgcagtacggtttacatactctctaatttcagtatatgatgtatctgctaacacagaaaatgaaattaatcctatacataaaaccaaaattttagtcatttactatttccaaaagtttattatttttaaggtaattagccttttctaggacttcagaagcatatttagaacctgctttaacattccatcccgaattataagatgatattgcttttcttatatcacccttatgtatatttaaccaataagaaagttcaatgtacgcccaggaagctgaattggaccgtttattcaacattctttttatttcagcatcggtcatattataaccaagttccttgactctcgctcgcatagtaggcaaataattttggaacattccataggcatgatgctttggtttagattttaaattaactccggcagagctttcttgccacaaaatagcagccattatatgacccaatccgctcttatggatgtttttgtgtgttttatattttccatccttagaaaattgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctacattgaagtgacgggtctttgaacttcgcgttaggtttacaaactgtaaatccaagccaaagatttccatctgtgatttctaaacgtccaggacgatattcaaccccatcaataaaatcctcgtcaatgtcaggacgcggaggcatactcaggaattcattaacttctaaaacatggtcttttattttatggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaagtgacgacgaagcttatttcgacggataaaaacttctgtattgatagtcatgttattctcctcttaactgatagaaaaattataccacagtcaagaggaaaagtaaacagttattctttaaatctaatcaatttattcatagactttgaaacttctgcacgaacctcatgtagatttttgagctgttcaagacgctgctcatagtaagcaatttcatcttcttcgagacagtcctgtgaatcttctttaagataacgtgcatagtcctggaaagcgttacgaactacttcctggaagtcatcaagactttgaattttcttaggagcaacagatacacgacgaggggcagtataatactcataaccaaaccctgcgcttaattgagccattagtatttttcctctggttggaacactgcgcgacaagcccacatactggcttctttgagtttcattttagcaatagttaactgatcgaggctttcggcgtaattcttcgcgagttcatcatcttcacagctatcaaatgcttcccagaattcatcatataaagcatcaaagataagccctaaacgaacttcagcatctttgatagcattcactttactgattttatcgtcagtatgtggtttataacctttaatgtcttcaatcatattttacttcctcacctgttcccaaatcatattcaactaaacgaataggttcatgaatgccatatccttgaacagaaatttctgtcgtaggataaattccattaatatcacccatgttccatgcttcgttaaattgctgttcgcctgaattactaaaccactcggcgaaagcatttagcacatcttcagaaccttcaataattatctttgccattacaaactctcggtgaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgttgaccaccttcaattttaactgtaggctgttgctcaatttcaatttcacgggcatgcaaaccatagaaaatttctgggtctacaaaagagtcctctttaaaggttttagagacaataattcgtgcttgaataccatcttcaaaataaatagtacctttatgtgtgccttcaagaatttgatatgctttcatataacctcaattaaaaaataaatttatccaagattgttctttaattaaaaatggctcagaatcatatgccattaaactctgtgtgattagtcctttaaaaggcccatcaataaattccatggtaaaatatggaattttattcattagccgtgcattaggagccgtgcacaaaactctgcatcctttgaatacgcctttttgtaatttgtattgcttgggataaaattcgctcaaaatgttattttttgccaaaatttcaaaatgattcaccaatttatttttaatagtttttggcgaaaaataaagatattcgaaaagctgagtgtctgtcatcattgcattccgattacgaaaaactgtggacgagtaataccaccaatgcaacatttaatattacagcagcagtgtacagtgtcaatatggacactataaatcttatccatatcaggagatttgacaggctcatcaattatatacaaaattcgcgaaagcgataaacctctgaacttgcttcctttattaccaataaaactgcgcacagaatcagtaaataaacgaaaacgtatatcatcattagaataacgcgaaaattcctttttaatattatctgcggaaattttagcgtaagctgaagtattagaaagaacaataactgttccaccgtcatacaaccaattagcggcaaaattagttactgcagttgatttaccagattgacgcccaccatctagtcgaagtgtacaatactgtttaagtaagtcttcaaatggcgggatatattcgtttttacaaatttcttctactctagcatcagaatggtgtgtaaaagcattcatcagggatagataaggaccagttaaaaatgttctcattttgttctctctaggtttgggccattccatggcgcatgaattgtccatttctgtatttacccattaccgcacttgggctcgaccttattacaggttggcgggaatccctcacagaatcatgaggtccaggttattcccatgttatttaaatgtaaatatttttgccgtaatacttataccagtgtggcttcattaaaattttttcatcgagtcgttgttgactcaacttaatagctgatttgcatggattataatcatttttccattctactggaatatcgctgatgtcaggaacttcagtatcttttatactgaacccgcgttttaagcattccgttataatgtccgattgacgctttcgcaaaaattctaacttatcgtaaaagaaagtaacatgaccagaacctaaaataaatttagaagatattttaaaatctttaacacgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaacaactttatagatttttatacgcgtcccaagtgccagttctaaacgttgcaatgactcgttttgcgcgattaggtgtttgattataccatctacttttagctaagttaactgctgcttcatcccagcgtttttgctggagcatgcgtaaagaattagtaaatcctgctacgccggtttcccccatttggaagaccatgttaatcaatgcacagcggcgaacagcatcaagagaatcataaactggttttaatttagcatttctcagaattccgcgaacagcagcatcaacatcctgattaaagagtttttcggcctcatcttttgtaattacaccattacaattacgcccaatagctttatctaattcagatttagcaacacttagtgatggacttttagtaagcaaatgaccgatgccaatagtgtaatagccttctgtgtctttatagattttgagtctaagaccttcatctatacgtaacatttcaaatatattcataatacctcctaagtatttatagaaggtatttataaattaaaagaggctgttcattattcggtaaagtgaaggacccatcacatattgccactgagtacgaggaataagagcaaaagcatccatctctggaatcataacgccatctttattttcaaaataagactcgcaatggcaatttctaaacatctcatgctctactggaatcgtataataaaataactgtaagtctttattactagaatatttaaatacacctaggtcttctagaaggtctggattataattgctaaaaccggtctcttctaagcattctctttttgcagcttccagtgcattcaaatcagaactttctacacgtccctttggaatatcccagcgatgtgccatcattccaggcttacgagaaccagtaacccgacccataaataaatctttatcttctgtcatgaagataataccagctgataatgttttcattttaatttcctgcattcagtgataaagttatttaaattttgagtatatttcttttcatcaaaaatcttttgttgtctgcgtagccgccatggcatttcaatgaacgtgtaccatatcccagataatattgatgctgtaaaaatattaacaagtatggttaaaagaatccaatctcctattctgtccattggattttttataaaaaagtaaaatacgaatgatgacacaggaagactaatgatataccacagaatcataatcttatctgtgaaccattcagcattcgttaacttagcacgaccattatgaatacacacgaatttatcatctgttacagtagatggcttaactgcttgatatcccattctaaactccctaattaatcgtttctttgtatcttcagaacagccgctccagtcaactctatcaactgaaatgccatcgtccccatcatctaaatcataccagcgagtttttaaaatcatttaattttcctacaatcactcacaaactcttccattgattctttttcaatataagacatatagctattatattcctttaattgtattttgtaatccttttttctttgccaatttattttaaaattatcataatgaaaatataacatggtaccaaagaatgaaaataatgaaatcgctatagtaaaacgaagttcactccaaacctctgttataattactgtgccgtcgatatttaaaataaaacagtcaattaacaatccaataagactacccgcaagagctgtaaatactgatacagcaagaattaatagtgcctcaggaaacgaatatttgactttatttagttttggcttttgcatcgtgattccttaacaaatttcataatttcatcaaattcatacatatctagcttaagctggtgttcctttttaatctttttacactgagctttccaatcacgtacacgtttacgataatgtcttccttgataccagtatcctacccaatttacgggtactaataaaagtggaactattaatggaagaattagcattaacacaagtatttcgccagaatcaatatcagtcataacatctaaaacacctccaataatcaatagaattacaaatgatatgagtataacaggacctattaacacatcagtagaaattatctgacgctttggttcatacttcacaggtttacttggaaggtatagtgatggttttgacatattctctacattccttaacaaatttttctagtaataaatcactttcaaaattgggattttctacaaatttatcaaaaagatcatcaacaatagttaagatattctttttactaagaatacgtttattttcatgcttcgtttcagaatcaactataagagtaaagaaatatttcttgccctgaaattttacagtagtatcaatataaaataaatttgacttttgtaaattacgtttaaaccatgcgtcacttaaactataaacaccgagataatcaaaatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatgcgtttaagagcatttagtaattggtctggaacatcaacctgtctttggaactcttcaaacattgaattgaaatcactttgcattttcattttcattcctatttactccaagtataaggggccgaagccccttatcattatttcagagaattaatgtattcctgaacatcggcagaggtagtttcaaccccagaaatattaccgttaaaggtttcaactcgagcaagggtatcttcaatatcaaccttagtcagtgctgcaatttcaactacatcatcagcagtactaattccaagggcatttgctgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcgtcaaattataggctcataatatctcaatcatgagcctgcgtaaacttatttcatattattgaaatattcttctgcgatttcgtcgttatcatggtaaactttagaagacagtttaacataaccttctgctgtgaacatattaatcacaacttttacagtataccactgaccgtcttcattacccattactgcgtaagtttcaaacatcggatgatcaggatcgataactttaatatcattcactgtacgaccgaaatattctgaaacgcatttcataaagaagttgaacagttcgccgtaattatccatttcattctccaagttgttttctgtatcagtagttgatagttgtatagtaccatggaagaacagagatgtaaacagttttgtgaaaaaatttttagggaattctagggcagggatgggcaattaaaggataggataatatattataaagggtataaactaaatgatgcctagagaggtccagaaaggcctagataccaaaaagccctatcatttagatagggatttaaaattatttacctagtttacttattatagcttctgcagcagcttttagcttagatgcagtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccacttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtaacagcgttatccgagtgattcaaactaaaaagccccaacctttcggtcggggctaagaatgtcatttgatttgtttagcagaccaaatgcggtctttaataattttttggatgtcttcaacatactcaagagagtgaacatgtggattatctttgaaactataagcacgggctaacttttggccttcggttttgattactaaaagctctttaaggatagcttcatatttagcgataattcctttaacgatatttttttcttgtgccgctttaggatctgctttaggagcaggtttacccgaagcctttgcaaaagcagcgccagtagcaactaaacttttccaggccatactaactgcatttcccgtaaatccttccgctttcatgtcgcgtgcaaactggaatcgcgattcatcagaagcatctttataggaatatttacccgcggcaatggcagcttttgcaacagcttgaatttcggtgctagatgcttcatttaacaccgcttcatttaaaaattgagtatatgatttcatcttatttcctgttttaatttgtagatttaatatactaatatttataccaaaaagccccaacctttcggtcggggctaagccttgcggcaaccttgtcggggttccacctgctaaggcaagtgtttgtacgaaacgccgggattcgaacccggttattaagtagttgacgctactcaatatttttaaaaggccatatctcgaccatatccgaacgttccgtcaaaaacgctactcggcttacggcaaagatatttcctcgaatcgataattcggtgcgccgtttctgctgtgatagtaaagagccagaacacagtaaaactgtgggaggaaactatactccagggaacatcagtccgacgacttaccggtagcgacccggtttcttaatattcttttaaagaatcaatatattcacggcgtttacgccacaaatcaattgcttcatacgcggattcagcatttcgaattagccggcatttatgtaaagacttatgattttgatattgtgtagatagcggaattgtatctaaaaggtctttacgatcaaaatattcgtaaccatctaaaccaaatgaacgatttttgagaaattgccaatgaccatattcgttttcgacataaacataatctgcatgctgataaagcaaattaattacacgttcagaaataacagtatcattatgattaaaatagaatgttaaatcatgaactactaaataaacattacctttcatattttcctcacttataattggtcgaggcagtagggatcgaacctacgacctaggacttagaaggtccttgctcttccttctgagctatgccccgtaattggggtgaccgatgggagtcgaacccatgactacgagaatcacaatctcgagttctaccaactgaactacggccacattaatacctactccaacaatcaagatgtcttcacacgaaattaagagaagagtgatcagttcaacccctataatcgcgtcaagtagatattaatgtgacagttgtcacaaatttggcggacgtgataggattcgaacctataaccaatcgcttaacaggcgatcgctctgccattgagctacacatccaaattggtggggaatggtggagtcgaaccacccgagtcgcaatgataatggatttacagtccacaccgctacctctacgggataactccccaaattaatttggtggccctgggtggaattgaaccaccatctggcgattatgagtcgcttgcttgaaccttccagctacagggccttggtgctgattgacggaatcgaaccgccgaccttctcattacaagtgagttgctctacctactgagctaaatcagcaaaactggcggaggcgataggatttgaacctatgagtcgccggagcgactgccggttttcaagaccggtgcattaaaccactctgccacgcctccagtctccgtggcaggatttgaacctacgacattctgctcccaaagcagacgctctaccaaactgagctacacggagtaaattaaattggagcggataatgagaatcgaactcacatcatcagattggaagtctgaggtaataccattatacgatatccgcaaatttggtgcgagaagtgggactcgaacccacaaggaaatcattccgcagcattttaagtgctgtgcctttaccaatttggccattctcgcgctgggaataaaggactcgaacctttgcatcctggaatcaaaatccagtgccttaccaacttggctaattcccaattattaacaaaggctcttaagcaagaacccttgatgatagagggtattaatcagtgcgatatgagttaataataacaaataattcttaaagcatatttaccatttataataatacatatttacgatgcattcaagacccaaaggattcttgaaaatatcatattcaagaggacctttttctgtttcaataaagaaatcaaaatttactgtattaaatttacgttcttccttcactaatttaacttgagaagatgaacggtcaatgtaaaccttttcaacttcaaaacatgttaaaatgccataatcatcaatcaaagctttagccgcgtcttgatcatatttatatccattttcaatggatgatactttcgcataaagaatcattatcagccttcatcaacaatagtgtgagtattagcatttacgatttgccaccaatcaaagcgattagaatccatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaaaacattttctgccgtagtcaataatccgcatataaatccaacaaacattgaaaaactgaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgaccgcagcagcaagttctttaatacgagagaaaagacgctcagcttcagctaaagccattccaagctttacttccataccgtgggaagattcagtgatagtagtttttgtagcaaactctttgaaagttttcatttttattttcctaattaattttgatgaggtaatagtatcactacctcatcagtatgtaaacaactttgtgaaattattttaaatcatctgcccaatcgagtttaagaggctctttgtattcacggtcaagtacaaccggaatttgtacatcaccgctaaatgataagggcccaacattataagacaatgttatatgcggtgtgtaatcatcaaaatcgtgtgtagcacctagtgcccgcgcatacatgtgtcgacagcgcagatattcagaatctagcacaagtacaagagtcgatccatcttgtgttttccacacttctaaatgtccagaagaagctacttcaaaacttccactcgatggaacatatggaacatttactcttgaataacatatagtcgaatgaattttttctctaggaactggattaggaacacgtaaagagcgctggagttcttccagcgcgtcaagtgttaattctgaaaacttagctgctacataaagacccgttgaaaagtctttaaattccatcattcttcatctgcagattcagcagtaagattcttgacagcttcaacgatttcttcaactttaatagtatcgccagtgatacctactgcatgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattactgtagcacccatcgccctagccgcatccatttcatgatcttgacgggtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgcccttcgtcatcaaaaacaaacacacctttaattgggcttttaccattaagatagcaaaatgcttgttccataatcgtgattacttctaatttagttagatttaaattagtctcacgatcatagtcaattccttcaaactctttacgagttaagcaaggatagtcggtatttgctgcaaatactccccatgcataagccaatgcatccttaataggaccagcaagttggtatttaactgcagaataattgctcatgataaaatcagcagtagtatcttttccactacgctttacaccgcttaaaaagattagtttcatatgtttctcctcaaatttagttaagattataacacatgaaactgaagcattaaacttccgctataatttttccatctttttctacttgaaaatacgtataaggaatcgttgctgtacatactaaagccgggtctgaatcttctgtgtagctaaattctacttcagacaggtcagaaacccaaggcttataaaaatttattgacatcacgatttcagttttgctattatctaaaatgtaaagcgtaatgtattcaggacctgttttttgggcagtattttcacctgtaagatagttgctagttcctagcatccattcatacattcctatccatgacttaagttcttcatcaactataaatctcacgatgagtggatcgtactcaaatgtagcacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagtgcttgcgacatatattcctcataatgctttataactgttggtggtataatgggtctaagtcccttccattcaattccatttagaacaaacaacagaaaagaatggaagataatagaattagatatttgaccagactttgtttgcagagaaacgttttccttttgaaacgaactgctgaagtggcattaacacaacgttcgcccagtctttcggggcgatttcaacaaggctacccataatattaccaggtatatatgccttaatcatttggtctgcacccctaaatcctttcacttgactccaatcaatttttaatttcgttttattagtaatagtaggtgtatttgcatattgctttaaaagctcttctagaaactgttgacgagctttaggtggaatatagtgcaagttcaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcgcgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgattcctctttcttcagcaaattgctttccggtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgttaaaattctaaattttattccacgcttttcagctaaagcttgagctgctttccatttgtcagtattaacggaatatgtataaatttcattcataaatcttttcttcgctgcagttgttagatgtgctggtttaactggtggttgtgtttcttttttaggttttatttcaataaaaaattcttgtccagaagaatctttcatccaaatatccatgaagtatctacgttttttcccttctgcattacaaaaataaggaattactgctgtttcactaccccatgcaataatttctggatttttatctaaccattcaaaaaagaatttttcccaatttgatctatacgtaatttttttagggtcacctctatactttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttacggggaatttggaatcatatggtgttgaagtgaaaaccccagctaggtctctatcagcaatggctgctactgtagctaaatcttctgacccggctgaccctcctattccaaatgactcgagaattttattcaaagaaccagtttcttcatataaaggtgaatatccttatgtgcatacaatggaaactgaaagcggacatattcaggaatttgatgatactcctgggcaagaacgatacagattagttcatccgactggaacttatgaagaagtatcaccgtcaggaagaagaacaagaaaaactgtcgataatttgtatgatataaccaacgctgatggtaattttttggtagccggtgataaaaagactaacgtcggtggatcagaaatttattacaacatggataatcgtcttcaccaaatagatggaagcaatacaatatttgtacgtggcgatgaaactaagacagttgaaggcaatggaactatcctagttaaaggtaatgttactattgtagttgaaggtaatgctgacattacagttaaaggagatgctaccactttagttgaaggaaatcaaactaacacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtgtttggatttggaaatgacgcgttgaaatatcgtttaggcgatgaatttaaaactgctgcttcatgggaagaacttcctactgattctgatactcagttgtatttatggaaagctcctcaaaacctccagaagacattcacttacgaagtaacattaatatatgactaccaagaacaaagtgaatctgggggttctggcagtaattctaggtcatcctctgatactactgaaccgacggatcctcctgctccagtaagaaaaactctagttaaaaattacacaaaaactatagttggaaattggagtcgttgggctaataaattaagaagctatgtgtatgagaggtcatagatgtcaggattaagttatgataagtgtgttactgctggccatgaagcatggcctccaacagttgtgaatgccacacaaagtaaagtattcactggaggaattgctgttctcgtagcaggtgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacgtttgctgaaataaaacaaaacctcattgaatggcttaatggccaaaatgaatttttggattatgattttgaaggctcaagattaaacgttctgtgtgaccttttggcttataatacattgtacattcagcagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattacaattcctcgcggaactcgctttttagcatatgcaaaagatacttctgttaatccatataactttgtatctaccgaagatgttattgctattcgtgataaaaataaccaatattttccgcgtttaaaattggctcagggacgtatagtaagaactgaaatcatttatgataaattaacacctattatcatttatgataaaaatattgatagaaaccaggttaaattatacgttgatggagcggaatggattaactggacaagaaagtcaatggttcatgctggttctacatcaacaatttactacatgcgtgaaactattgatggaaacactgaattctattttggcgaaggtgaaatttccgttaatgcttctgaaggagctctaactgctaactatattggaggtcttaaacctacccagaactctacgattgttattgagtacatcagtactaatggtgctgacgcgaacggagcagtcggattttcatacgcagatacattaacaaatataactgtcatcaatattaatgaaaatccaaacggtgacccagattttgttggggcagatggcggcggtgatccagaagatattgagcgtattcgcgaattgggtactattaaacgcgaaacccagcaacgctgcgtaactgcgactgactatgatacattcgtttcagagagatttggttctattattcaagcagttcagactttcactgattctactaaacctggttatgcatttattgctgctaaacctaaatcaggtctgtatttaactactgtacagcgcgaagatattaaaaattatctcaaagactataatttagctcctattacgccatcaattatttctcctaattatctttttattaagactaatttaaaagtcacatatgctttaaataagctgcaagaatccgaacagtggctcgaaggtcaaataattgataaaattgatcgttattataccgaagacgtagaaatttttaattcatctttcgctaaatctaagatgttgacatatgtagatgatgcagatcattctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgatgttcgtatagtatcaacagaccgagattctaaaggaattggtaaagttattattggtccatttgcttctggcgatgttacagaaaatgaaaacattcagccatatacaggcaatgattttaataaattagcaaattctgatggacgcgacaaatactatgttatcggtgaaataaattatccggctgacatgatttattggaatatcgctaaaattaatttaacatctgaaaaatttgaggttcagactattgaattatattctgacccaaccgatgatgttatctttacccgtgatggttcactgattgtatttgaaaatgatttacgtccgcaatacttaactatcgatttggagcctatatcacaatgacagtaaaagcaccttcagtcactagtctcagaatttccaagttatccgcaaatcaggtgcaagtacgctgggatgacgttggtgctaatttctacaaaatagtagaaatcgctgagacaaaaacagactcgggggaaaatctcccgagtgatcaatatcgttggattaatttaggatatacagcaaacaatagtttcttttttgatgatgctgatccactaacatcatacattatcagagtagctacagctgcacaagattttgagcaatctgattggatttataccgaagagtttgaaacttttgctacaaatgcttacacatttcaaaacatgattgaaatgcaattagccaataaattcattcaggaaaaatttactcttaacaattctaattatgtcaattttaataatgacactataatagctgcattgatgaatgaatcgttccaattcagcccatcatatgttgatgtttcatcaatcagtaattttattattggtgaaaatgagtatcatgaaatacaaggttccattcagcaagtatgtaaggatattaaccgagtttatttgatggaatcagaagggattctatatctttttgagcgttatcaacccgtggttaaagtatctaatgataaaggacaaacctggaaagctgtgaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagtaatgcacctatagattctgacccgttatcaccaacatactcggaaagactttttgaacctgatacaatgactataactggaaatcctaaagcagtatgctataaaatggattctatcggtgataaagtttttgctcttattattggtgaagttgaaacattaaatgccaatccgagaacttcaaaaataattgattctgctgataaaggaatatatgttttaaatcatgacgaaaaaacatggaaaagagttttcggtaataccgaagaagaaagaagacgtattcaacctggatacgcaaacatgtcaactgacggtaaattagtttctctgtcttcgagtaattttaaatttttaagtgataatgttgttaatgaccctgaaactatggtgaaatatcagttaatcggtgctgttaaatatgaatttccccgtgaatggttagctgataagcattatcatatgatggcatttatagcggatgaaaaatctgattgggagacttttactcctcaaccaatgaaatactacgcagaaccgttctttaattggtctaaaaaatctaacacacgctgttggataaacaactctaatagagctgtagtagtttatgctgatttaaaatacactaaagttatagaaaatattccggaaacatcaccagatagattagttcatgaatactgggatgatggtgattgtacgatagtaatgccaaatgttaaattcacgggatttaaaaaatatgcgtctgggatgcttttttataaatcttctggtgaaataatttcttactatgattttaactatcgtgtgagagatacagtagaaattatttggaagccgactggagtatttttaaaagcatttttacaaaaccaagagcatgagactccttggtcaccagaagaagagcatggattagctgatcctgatttaagaccattaattggcacaatgatgcctgattcttatttgttgcaggattcgaattttgaggcattttgcgaagcatatattcagtatctttctgatggatatggaactcagtataacaatttacgaaatttaattcgtaaccaatatccacgagaagagcatgcgtgggaatatttgtggtcagagatatataaaagaaacatttatttaaatgctgataaacgtgatgctgttgcgagattctttgaatcacgtagctatgatttttattctactaaaggaattgaagcatcatacaagtttctttttaaagttctttataatgaagaagttgaaattgaaattgaatctggggccggtactgaatatgacataatcgttcaatctgattctttgactgaagatttagtaggacaaacgatttatacggcaacaggaagatgtaatgttacttatatagaaagaagttattctaatggtaaattgcaatggaccgtaactattcataatcttttgggaagattaattgctggtcaagaagttaaagcagaaagactccctagttttgaaggcgaaattattcgtggagttaaaggaaaggatttgcttcaaaacaatatagactatattaatagaagtagatcatactatgtaatgaaaattaaatccaatttaccttcttcccgctggaaatctgacgttattcgttttgttcatccagtaggatttggatttatagcaattacccttttaacgatgtttattaatgttggtttaactcttaaacacacagagacaataattaataaatataaaaactataaatgggattctggattgcctactgaatatgctgatagagtagctaaattaactccaaccggtgaaattgagcatgattcagtaacaggcgaagcaatttatgagcctggcccaatggctggtgtagaatatcctcttcctgatgactataatgctgaaaataataattcaatatttcaaggtcaattgccgtctgaacgacgtaaattaatgagtcctttatttgatgcatctggaacaacatttgcgcaatttagagatttagttaataaacgtctaaaagataatataggaaatccaagagaccctgaaaaatccaacacaggttaaaatagatgaatgattcaagtgttatctatcgtgcgatagttacttcaaaatttagaacagaaaaaatgttgaatttttataattcaattggaagtggtccggataaaaacactatctttatcacatttggaagatcagaaccgtggtcatcaaatgaaaatgaggtgggctttgccccaccttatccaaccgattctgtattaggcgtaactgacatgtggacgcatatgatgggaacagtaaaggttcttccatcaatgcttgacgcagttattcctcgtcgagattggggagatactagatatccggatccatacacatttagaattaacgatattgtagtgtgtaactcagctccttacaacgctactgaatcaggcgcaggctggttagtatatcgttgtttagatgttcctgatactggaatgtgttcaattgcatctttaactgataaggatgaatgccttaaattaggcggaaaatggacaccttctgttaggtcaatgactcctcctgaaggtcgaggagatgctgaaggaacaattgaacctggggacgggtatgtatgggaatatctttttgagattccacccgatgtatctataaatagatgcacgaatgaatatattgtggttccttggcctgaggaattaaaagaagacccgactagatggggatatgaagataatctcacttggcaacaagatgattttggattaatttaccgggttaaggcaaatactatccgttttaaagcatatttagattcagtttattttcctgatgctgcattgccaggaaataaaggatttagacaaatatcaataatcacgaatcctcttgaagctaaagctcatccaaatgacccaaacgttaaagctgaaaaggattattatgacccagaagatttaatgaggcattcgggcgaaatgatttatatggaaaataggccacctattattatggcaatggatcaaacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataatgcgtttggcgatcagcgtaaaatggcagtagcaaatggcactggagcagatggtcaaattatccatgctactgggtattatcaaaaacactctattacagagtacgcaactccagtgaaagttggcactagacatgatattgatacctctactgtaggtgttaaagttattattgaaagaggcgaactcggcgattgtgttgaattcattaactctaatggatcaatatcagttactaatcctttaacaattcaagctattgattcaattaaaggtgtttcaggtaatttagtagtaactagcccatatagtaaagtaactttacgctgtatttcatctgataattctacatcggtttggaattattctattgaaagtatgtttggacaaaaggaatcaccagctgaaggtacatggaatatttctacatccggatcagttgatattccactatttcatcgcactgaatacaatatggctaaattgttagttacgtgccaatcggtagatggaagaaaaattaaaacggcagaaataaatattcttgtagatgctgttaattcagaagtcatttcttctgaatatgctgtcatgcgagttgggaatgaaactgaagaagacgaaatcgctaatattgcatttagtattaaaacaaattatgtaacagcgactataagttcttcaactgtcggtatgagagcagcagttaaagttatcgctacgcagaaaatcggggtggctcaataatgaaacaaaatattaatatcggtaatgttgtagatgatggtaccggtgactacctgcgtaaaggtggtataaaaataaatgaaaactttgatgagctttattacgagcttggtgatggagatgttccatattcagccggtgcctggaaaacttataatgcttcatcaggacaaacattaacagcagaatggggaaaatcatatgctattaacacttcatctggaagagtaactctacaacttcctaaaggaaccgttaatgattataataaagtaattaaagctagggatgtatttgcaacatggaatgttaatccagttactctagtagccgcttctggtgatactattaaaggatcatcgtcatcagttgaaattaatgttcaatttagcgatttagagttagtttattgtgctccaggacgttgggaatatgtcaaaaacaaacaaattgataaaattattagttcagatattagtaatgtagctcgcaaagaatttttagtagaagttcaaggacaaactgactttttagatgttttccatggaactagttataatgtcaataacatcagagtaaaacaccgcggtaacgaattatattacggcgatgtatttagtgaaaacagtgactttggctctccgggggaaaatgaaggagaattaattcctcttgatggatttaatattaggttaagacagccttgtaatattggcgacactgttcaaattgaaacgtttatggatggtgtatcacaatggagaagttcatatacaagacgccaaataaaagtgctagattcaaaactaacatcaaagacttctttagaaggaagcatttatgttactgatttatcggcgatgaaatcaattccattttcagcttttggattaattcctggcgaacccattaatcctaattctcttgaggttcgttttaatggaattttacagcaacaggctggaacagctgggtatcctctgtttttgtgcgaaggcgctaattcagatacgcaagaaggatgtatatctcttggtggcgaatggaaagaatcaaacacagattattctatagaatatgaagatggaaaacctgtcagtcttttatttgatagaaaatttgaatcaggtgatataatcgttataacatggtttaataatgatttaggaactcttttagaaaaagatgacattattgaattaactgatgaccgttatgttagtaaaggatcatctactgaagttactggggatgtagccttaacagattttgataaaatcggttggccaaatgttgaaaaagttgattcttatactagaacgtataattcaatatcatctattttcgacagcatttatcctgttggttcaatttatgaaaatgctataaacccaaataatccggtgacttatatgggatttggttcatggaaattatttggtaaaggacaagttttagtaggatggaatgatgatgttacggatccaaactttgctttaaacaataatgatttagattctagcggaaatccttcacatactgccggtggaacagttggtacaacatcagtaacgcttgaaaacgcaaatcttcctgcgactaaaactgatgaaagagttttaattgaagacgaaaatggatcagttattattggaggatgtcaatatgacccagacgaaactggtcctatatatacaaaatatcgtgaagactacgcaacaacaaactcttcacacactcctcctactaatattagtaatattcaaccgtctattactgtataccgttggataaggattgcataatgagtttacttaataataaagcgggagttatttcccgcttagcagattttcttggttttagaactaagaaaaatgatatttcggttatgaataatcagccggtaggcgctgtaacaatttcacaaatagcaaaaggtttttatgactcaaatgtagaatctgctatcaatgatgttagaaatatggcagagcaacaggttggagctgtattaattaatataagcggcgtatctcctactggcgtgcaacaaaccgactattggtcatttgaaggaactgttactgatacttcagccaaaccaggtgacccagttattgttaacatgtttggtattccagttaaagctactaatggaatgacttcaattgaatttactagtgctgttagaacagctctacaggaaatggttgtaaaatttattgcaattgattcatttgaagaccatcctaccatagggaataaaatacaagttaagtatttagataaccaagaacatatcttagaacaatactctgataaaggaattactttcaaacaagaaataatttctccttctaaacccgggtatggaacttggcaattattaggtgcgcaaactgttacgctagatagtcacacacaacctacagtattttattattttgagagaatagcatgagtaacaatacatatcagcacgtatcaaatgaatcaaaatatgttaaattcgatcctactggatcgaattttcctggcactgttacgacagtacagtctgcattatcaaaaataagtaatatcggcgtaaatggtattcctgatgcaactatggaagttaaaggaatagcaatgattgcatcagagcaagaggttttagatggaacaaataattctaaaatcgttacaccagctacattagcaacaagattattgtatccaaatgctactgaaactaaatatggtttaacgcgctattcaacaaatgaagaaacattagaaggctcagataataattcatcaataacgccgcaaaaactgaaataccatactgatgatgtgttccgaaatagatattcatctgagtcatcaaacggggttattaaaatatcatctacgcctgcggctttggctggtgttgatgatactacggcgatgactccgctaaaaacccaaaaactcgcaataaaattaatttcacaaatagctccttccgaagatactgcatcagaatctgtgagaggtgtggttcaattatcaactgttgcgcaaactcgtcaaggaactctccgcgaaggatatgcaatttctccgtatacctttatgaattctgttgcaacacaagaatataagggtgttatacgtttaggaacacaatcggaaattaacagtaatttaggagatgttgcagtaacaggtgaaacactaaatggtcgaggagctactggttctatgcgtggagtagttaaattaacgacgcaagccggtattgcccctgaaggtgatagttctggagcattagcgtggaacgcagatgtaattaatacgcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggcgattggaataatcctggcgttcctgatatgcggggtcttttcgtcagaggagctggcacaggcggtcatattttaaatcaacgaggacaagatggttatggaaaggatagacttggcgtaggatgtgacggaatgcatgttggtggtgttcaagcacaacaaatgtcataccataaacacgccggtggttggggggaatatagcagaagtgaaggcccatttggcgcgtctgtttatcaaggatatcttggaattagaaaatatgccgactgggataatgcttcatacttcactaatgatggatttgaattaggcggaccgagagatgcccttggtacacttaatcgtgaaggattaattggttatgaaactagaccatggaatatatcattaaactatattattaaagttcattactaaggattacaaatgattgaattaaaagatttaccttttgttgatagcgttcctgatgaaggtcaggaacgtatttcatggattaaaaatggtgaagaaatactaggagctagcactaagtatggaaacgatggatcaatgaatagaccaattgtttccgtgtttaaaaatgttgaggttcttgacgaaaatataggaattcttaaaactgccattgaaacatcgcagaaagatattaaaacaattcaaggagttttagatgtatcaggagatatagaagcactatcgcagatcagtgttaataaaaatgacatatcaaatttaaagacacttactaatgaacacactgatatattaactggaactaataatacagttgacaaaattattgctgatataggtccatttaatgatgaagaaaactctgtttatagaacaattagaaatgatttattgtggattaaacaagaactagggcaatattctggccaagacattaacggtcttcctgttgttggtaatgctagcacaggaatgaaacatagaataataacaaatagtacattattatcttcacaaggcattcgtttaagtgaattagaaaataaatttactgaatctgacgtaggatcattgacggttgaagttggtaaattacgcgatgaacttggtaataaaccagtagattttggaccaaatatttataatagattaaacactatagatgataaacaaactttaataaattctgatatagcagaaattaaatcttctattggatacccagaaaatgtttctataataacagaaattaataataacaaaagtagcattgaatctattaataatgaattaaatcagagtgaaggtgttaaacagcgcttaacggctattgaaacttctataggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctataaaaacgaatgaaactaacattgcggcagtcacgcatgaagtaaatacagctaaagacaatatatcctctttacagagcagcgttcaagctctacaagaagcgggttatattcctgaagctccaaaagatggccaagcttacgttcgtaaagacggcgaatgggtactactttctacctttttatcaccagcataacatggggccgcaaggccccaaaggattttaaatgtcaggatataattctcagaatccaaaggaactcaaagatgtcattctaagacgtttaggggctccaattattaatgttgagttaacacccgatcaaatttatgattgtatccagcgtgccctagaattatacggtgaataccattttgatggacttaacaaaggttttcatgtattttatgtaggagatgacgaagaaaaatataaaactggagtcttcgatttaagaggttcaaatgtattcgcagtaactcgcattttgcgaacaaatattggatcaataacgtcaatggacggaaacgctacatatccatggtttactgattttcttttaggaatggctggtattaatggcggtatggggacttcttgtaatagattttatggaccaaatgcctttggagctgatttaggatattttacccagcttaccagttacatgggaatgatgcaagatatgctctctcctattccagacttttggtttaattcagcaaatgaacagctcaaagtcatgggaaacttccaaaaatatgatttaattatcgtagaaagctggactaaatcatacattgatactaataaaatggttggaaatacagtaggatatggaacagtcggtccacaagatagctggtcattatctgaacgatataataacccagaccacaatttagttggtcgtgttgttggtcaagacccaaatgttaaacagggtgcttataataatcgttgggtgaaagactatgctactgctttagctaaagaattgaatggtcaaattttagcacgccaccaaggtatgatgcttcctggcggtgttacgattgatggacaacgcttaatagaagaagctcgattagaaaaagaagcattacgtgaagaattatacttgctcgatcctccatttggaattttggtaggttaatatggctacttatgataaaaatctttttgctaaattggaaaaccgcactggttattctcagaccaatgaaactgaaatactaaatccttatgtaaatttcaatcattataaaaacagtcaaatattagctgatgtattagtagctgaaagcattcaaatgcgaggtgtagaatgctattatgttccaagagagtatgtttcccctgatttgatatttggcgaagacttaaaaaataaatttactaaagcttggaaattcgctgcatatttaaattcatttgaaggatatgaaggagctaaatcgttctttagtaactttggtatgcaagtacaggatgaagttactttgtccattaatccaaacttgtttaaacaccaagttaatggaaaagaaccgaaagaaggcgatttgatatattttcctatggataacagcttatttgaaattaactgggttgaaccatatgatccattttatcaattaggtcaaaacgctattcgtaaaattacagcaggtaaattcatttattctggagaagaaattaatccagttctacagaaaaatgaaggaattaacattccagaatttagtgaattagaactaaatcctgttcgcaatcttaacggtattcatgatattaatattgatcaatatgctgaagtagatcaaattaattctgaagctaaagaatatgttgaaccttatgttgttgtcaataacagaggcaaatcttttgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcgataaattcacaagaagatgtggccaaggttgaaactattctacctcgtataaatttgcatttagttgattttagctataacgctccatttaaaacaaacattttaaatcagaatttactgcaaaaaggtacaacttctgtagtatcgcagtataatccatctcctattaaaatgatttatgaattgagtatctttactcgttacgaagacgatatgtttcaaatagttgaacagattcttccatattttcaacctcattttaatacaactatgtacgaacagtttggaaatgatattccatttaaaagggatattaaaattgtactgatgtctgctgctatagatgaagctatagatggagataatttatctcgtcgtagaatcgaatggtcactaacatttgaagtaaacggatggatgtatcctccagtagatgatgcagaaggattaattcgtactacttatacagattttcacgccaatacaagagatttgcctgatggcgaaggtgtttttgaatctgttgatagcgaagttgttcctcgagatattaacccagaggactgggatggaacagtaaaacaaactttcactagcaatgtaaatagaccaacaccgccagaacctcctggcccaagaacatagaggttattatggaaggtcttgatataaacaaacttttagatatttctgacctccccggaatcgacggggaggaaattaaagtatatgaacctctacaattagtagaagttaaaagcaatcctcaaaaccgtactcctgacttagaagatgattatggagtagttcgtcgaaatatgcattttcaacaacaaatgctaatggacgcagccaagatttttcttgagacggcaaagaatgctgattctcctcgtcacatggaagtatttgcaactcttatggggcaaatgactacgacgaacagagaaatactgaagcttcataaagatatgaaagatattacatctgagcaggttggcactaaaggcgctgttcctacaggtcaaatgaatattcagaacgcgacagtattcatgggttcaccaacagaattaatggacgaaattggtgatgcttacgaggctcaagaagctcgtgagaaggtgataaatggaacaaccgattaatgcattaaatgatttccatccattaaatgaagctggaaaaattttaataaaacacccaagcttagcagaaagaaaagatgaagatggaattcattggataaaatcacagtgggatggaaaatggtatcctgaaaaattcagtgattatcttcgtttacacaaaatagtaaaaatcccaaataattctgataagcctgaattatttcaaacttataaagataagaataataaaagatctcggtatatgggtcttcctaacttaaaacgagctaatattaaaacacaatggactcgtgaaatggttgaggaatggaaaaaatgccgagatgatattgtatattttgcagaaacatactgcgccattactcatatcgactatggtgtcataaaggttcaattacgtgactatcagcgtgatatgctcaaaataatgtcatctaaacgtatgactgtttgtaatctatcacgtcagcttggtaaaacaactgtagtagctatttttcttgcacactttgtatgttttaacaaggataaagctgtaggtattcttgcgcacaaaggctcaatgtctgcggaagttttagaccgtactaagcaagcaattgaactgcttcctgactttttacagcctggtatagttgaatggaataaagggtctattgaactagataatggttcttcaattggcgcttatgcttcctctcctgacgcagttcgtggtaactcattcgcaatgatttatattgacgaatgtgcatttattccaaacttccatgattcctggcttgctattcaaccagtaatttcatctggtcgtcgttcaaaaattattattactacgactcctaatggattaaatcatttttatgatatttggactgctgctgttgaaggtaaatcaggatttgaaccatacactgctatttggaattcagttaaagaacgtctttataatgatgaagatatttttgacgatggatggcaatggagcatacaaaccattaatggttctactttagcacaattccgtcaagaacataccgcagcgtttgaagggacttctggtacattaatttcaggaatgaaattggctgttatggatttcattgaagtaactccagatgatcatggttttcatcgatttaaaggacctgaaccagatagaaaatacattgcaactttagactgttcagaaggtcgtgggcaagattaccacgctttacatattattgatgttaccgatgatgtgtgggaacaggttggtgttttacattcaaataccatttctcatttaattctgcctgacatcgttatgcgttatttagtagaatataatgaatgcccagtttatattgaattaaatagtactggtgtgtcagttgcgaaatcactttacatggatttagaatacgaaggcgttatttgcgattcatatactgatttaggaatgaagcaaactaaacgaacgaaagcagtaggatgctctacattaaaagaccttattgaaaaagataagcttattattcatcaccgtgcaactattcaagaatttagaacgtttagtgaaaaaggcgtgtcttgggcggctgaagaaggttatcatgacgatttagtaatgtctttagtaatttttggatggttatcaacacaatcaaaatttattgattatgccgacaaagatgacatgcgattagcatctgaagtgttttcaaaagagcttcaagatatgggggatgaatacgctccagttatatttgttgattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaacgaagtagatttagttaatacttttggtcaacctacagctgaaactgctgactattttatgtctgcaatgaatttcttacaatatggaaatgatttgcgagttgtgcgcgctgtcgatagagataccgctaaaaactcatctccgattgctggtaatattgaatacacaatttctaccccaggtagtaactacgcggttggagataaaatcacggtcaaatatgtttcagaagatgttgaaacagaaggtaaaattaccgaagtagatgctgatggaaaaattaagaaaattaatattcctactgcaaaaattattgctaaagctaaagaagttggcgaatacccaacattaggttctaactggactgcagaaatttcttcatcttcttccggtttagctgcagtaataactcttggaaaaattattactgattccggtattttattagctgaaatcgagagcgctgaaactgctatgacagcagttgattttcaggcaaatcttgaaaaatatggaattccaggagtagtagctctctatccaggcgaattaggcgataaaattgaaattgaaatcgtatctaaagctgactatgcgaaaggcgcttctgcattactgccaatttatccaggtggtggtactcgtgcatctactgccaaggcagtatttggatatgggccgcagactgactcacagtacgctattatagttcgtcgaaatgatgctattgttcaaagcgttgttctttcaactaagcgtggtgaaaaagatatttacgatagtaacatctatattgatgactttttcgcaaaaggtggttcagaatatattttcgcaactgcgcaaaactggccagaaggcttctctggaattttaactctgtctggtggattatcatcaaatgctgaagtaacagcaggagatttgatggaagcttgggacttctttgctgaccgcgaatctgttgacgttcagttgtttattgcgggttcttgtgccggtgaatctcttgaaacagcatctactgtccaaaaacatgttgtttcaattggtgatgctcgtcaagattgcttagtattgtgctcacctccgcgtgaaactgtagttggaattcctgtaactcgtgcagtagataatttagttaactggagaactgcagcaggttcatacactgataataactttaatatcagttcaacctacgcagcaattgatggtaactacaaatatcagtatgacaaatataatgatgtgaatcgttgggttccattagcagctgatattgctggtttatgcgcaagaactgataacgtatctcagacttggatgtctccagctggttataatcgtggccagattcttaacgttattaaacttgctattgaaactcgccaagctcagcgcgaccgtttataccaagaagctattaatccagtaactggtacaggtggcgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccaatacttacagggaattaaagctctcggtggaatttatgaatatcgtgtagtttgcgatacaacaaataacactccgtcagtaattgatagaaatgagtttgttgcaacattctacattcaaccggctagaagcattaactacattaccttgaacttcgtagcaactgctactggtgcagatttcgatgagttaactggtcttgctggttaatacggtgcattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagtcggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagagcgctattgttcgtcaatatgctcgtgatgctaaaacagtaacaaaagaaattgaaattaaaggtctgtggcctactaacgtgggtgaacttcaattagattgggattcaaacaatgaaatccaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtagataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggtgctgataatactggcaatatggaagatattcgttggtttagacaagctctttacatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccacttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtaccaatgcttgaatctcatgatggaaaagacttaggtttaaaaccgggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccacggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgaacacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgccgcaggtcagacttctggcgcagtaactcagattggaccagctgttatgggtatggtacgtcgtgctattcctaacctgattgctttcgatatttgtggtgttcagccaatgaacagcccgactggccaggtattcgcgctgcgcgcagtatatggtaaagatccaatcgcttccggcgctaaagaagcattccacccaatgtatggtccagatgcaatgttctctggtcagggtgctgctaagaaattcgctgctttgaaagcaagtgatactcttgaagtcggaactatttacactcacttcttccaggaaactggtacagtatatctgcaagctacagcagctaaacaaattgattcaggcgcatctgacgcagacaaattagatgctgaaattaagaaacaaatggaagctggtgtactggtagaaatcgctgaaggtatggctacttctatcgctgaacttcaggaaggtttcaacggttctaccgataacccatggaatgaaatgggcttccgtatcgataaacaagttatcgaagctaaatctcgtcagctgaaagctgcttactctattgaattagcacaagaccttcgcgctgttcacggtatggatgctgatgctgaactgtctggtattctggctaccgaaattatgctggaaatcaaccgcgaagttgttgattggattaactactccgctcaggttggtaaatctggtatgaccctgactccgggttctaaagctggtgtatttgacttccaggacccaatcgatattcgtggtgctcgctgggcaggtgaatcctttaaagctctgttgttccagattgacaaagaagcagttgaaattgctcgtcagactggtcgcggcgaaggtaacttcattatcgcttcccgtaacgtagttaacgttctggcttcagttgataccggcatttcttatgctgcacaaggtctggctactggctttaacactgatactaccaagtcagtatttgctggtgttctgggtggtaaataccgtgtatatatcgaccagtatgctaaacaggattatttcaccgtaggttataaaggtccgaacgaaatggatgctggtatttactatgctccatatgtagctctgactccgctgcgtggttctgatccgaagaacttccaaccggtaatgggattcaaaactcgttacggtatcggtatcaacccatttgcagaatccgctgctcaggctccggcttctcgcatccagagcggtatgccttctattctgaatagccttggtaaaaacgcttacttccgccgtgtatatgttaaaggtatctaatctttgacgatttaagggaccttcgggtccctttagttgtttttatggtataaataaatcatataaactgaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaattggtgctacttacgccggcgaagctggatatgtagaccgagaacaaatcacagaattaacagaagagtctaaattaactctcaataagggcgatttattcaaatataataatatcgtttataaagtattagaagatacaccatttgctgatattgaagaaagcgatttagaattagctcttcagattgcaattgttcttttaaaggttcgtctattttctgacgcagcgtcaacaagcaaatttgaaagctctgatagtgaaattgcggatgctagattccagattaataaatggcaaaccgcagttaaatctcgtaaacttaaaactggtatcacagttgaattagcacaagatttagaagcaaatggattcgatgctcctaatttcttggaagatttgcttgcaactgaaatggcagatgaaatcaataaagatattctgcagtctttgattacagtatcaaaacgttataaagttacaggaattactgatactggattcattgatttgagttatgcatctgcacctgaagctggtcgttcattataccgaatggtatgtgaaatggtttcgcatatccaaaaagaatcaacttatacggcaacgttctgtgttgcttcagctcgtgccgctgcgattcttgctgcatctggttggttaaaacataaaccagaagatgataagtatctttcacaaaatgcctacgggttcttagctaatggtttaccgctttattgcgatactaacagcccattagattatgtaatcgttggcgtagtagaaaatatcggtgaaaaagaaattgttggatcaattttctatgctccgtatacagaaggtctcgacttagatgaccctgaacatgtaggtgcatttaaagttgttgttgatccagaaagcttgcaaccgtctatcggtttattagttagatatgctttatctgcaaatccttacaccgtagcaaaagatgaaaaagaagcaagagtaattgatggtggagacatggataaaatggcgggccgttcagatttgtctgttttattaggtgttaaattaccaaaaattatcattgatgaataaaacaaagggaccgaaaggtccctttttatttagctcaccaactcaatccaagccggacgaagtacatcttgtaccattttaactaattcctttttaatcaaagaaggattatctgcttgagttaaagtaataccttcacgagaagtttcttccaaaatatcttgaacagttagccccattacctttccaaaatcttttggaccaatttcgccaattttggaaataacgttatttactcggttcaatgtaacataacaagctaaaattccaaccaatttattatcagcttctgacaattcaactttagctttaataggcttatcagactttttcttttcactaaatttagaattcttgcatttgatggctacacgatttccattatgaagccaagaaggataacaaggtttcaatacatatccttcagcggtaaatacttcgcctttggcttcagctttccaaacacatttgttagcgtcaattaaacctgcattatctacggtaaaattataagacggaacaacagaatccaaatcatttggaagtttaataagatcttcaaatttaccacgacccaaaagtggagcgattttaaacccaaatgaattacaaaacgattccatcatgtaatcatcaacataagttacatcaccactttcggtagtaacaataatatcaaacacgtaaaaatctttattaccataatcaacatttttctgaataccaggaccagcaaattcgccaaatacctgataagtcacaacagctgaagtttccataatatcttgtactgctttaatggaatcagcgtaattctttagaataatttcatacccaaagaaatcttcagcaggaagaatcggtccagtacgtttagcgcaagttactttatcacgctcaataatcaatgagaaatttgtgccgtgaatcttttcacgagctacccattcgccgccagtcaatcctaagctataaagtttttcaataaatttagagttgtaatgattttcaagactgctatactttttaaacataattaatcctcaaaatgtaatttctaaccaatcaccatcacgctgatcactattaactttaaagatgaatccttcttttctcagccaatcaccaatttcttcagtaatcaatttatcacgagcagtacaataataactaaaatatgttttaccttgttcagctgctttattagcaagttccgaaaaatctttaataaaacactctagtttaaactgtttgcttttaagtgctttttcgcgtaatcgattagcaaaagattcattttcataaagatcatactgttccatttttcacctttttattgatatgtctttttctatagacaactttttctcgagtttcaaatttattcttagcagtcatagctcgagcccataatacagccacttcttttgcctgtaagttcaattcacgagcaatttcaatgaatgactttccagactcatgaagagtaaacaccacaacctcagttctcataatcaatctcatgttatcgagttggtgccattatatacatcattttctgattgtgttttgtgtgctttcaaaatgaagaaaggggccgaagccccttatgattatggataggtatagatgataccagtttctaaagcagttttatgaatgatgtatccattacgtgattcttgaacatcaacttctggatagtctttcatcatcttctggagagtgtaacgatgcaagtagtacttactatctggatcgtcagttttccaatctttaccttcttcggtcattttttggatttcatccataacccaccaaccacaccagatgtaagctgaagtacgatgtggaagaggatgaacataaggtaattcaccttctggttctggagcaactttatcagttacctgaacttgaccttctgctgtaatagttttgctatcatagtcagtagcagtaacagttgcagtaacttcaatagtttgacttccaatagatgaggtatcaactgtatacacattagtcgatccttctacaggagaagagtctttcttccatgaataagtaatttgcgcttcttctggagcatcagtgacattagcagtaaatgtagccgaagcatcttgttgaacgttaatagaaggaggagtcaatgtaacctgtggattcattgtcttcttattaactgttaatgatacttcattcgaagtaacttccttttcattgtaattttcagcagttacttgggctacgcatttaattctttttactccacttgtagttggagtatagctaaatgtagagttagtttctccaccaacttgtgaatcatctacataccactgatacgtagcagatgctccatcaggttgagaaactaaggcagcagtaaattgaactggtgttccaattactccagctgaaggactatcgggagttactgccaaagtagttgtctgtgtctttttattaacagtcaatgacacttcattagaagtaacttcttttgcatcataatctgtcgcggttacttgagccacacacttaattctttttaccccgctttcggcaggagtgtaattgaacgtagcgttagttgcttcgcccacaggagaatcatctacataccattgataagtagcgtttgcgcccgatggctgcgaagctaaagcggcagtaaattcaatagctgttccgattactccagcgtcagggctattaggagttacagctaaggtagtcgtttgtgtcttattttgaactgtgatagttgtcgcttcagccgtttccgggcctccttcagaaagtgtatttgttgcaactactttaatagttttctggcctgcaggtccttttagtacataactaaaagttgcttcagctccatcttgtggagcatcatctacagtccaagcataggtaatagttccgcctccagtttcaccactgggtgtagcagtaaactgctgagtctgatcgatcacccctgtaggtgttttaggagttatatcaactgtaaaagccataagttatccttattttttaccagaaccagaaactttcagttcacccgggatacggatttcgtacggggtaccctgggtcagacgcagcagggtggtcaggtcttcagcagatttagaacggtgggtagacgggttagcgtcgtaggtgtcgttgaaagcacgaacaacaccgttgtagttccagttacctttagcgtcgattttcagggtaccttcggttttcatggtgatgttacccaggtacagacccgggatgtcaccgtcgatgaaggtgttacggttgaagttaccagagatctggtaggtaccagcagcgttgtttttaacagcgatcataaccgggtcgatctggttagcctggattttcagaccaacagaagacaggtcaacggtacgcggtttaccttcaccccacaggtagtgaccgaaagcagcgatcggggtggtaacgttaccagagaatttttcctgagactgggttttgaagttgaatttagccggagcccatttggttttgtggaaaccgtcgtaaacagcgatacgcgggttcagaaccagagcggtgtcagcagagcagaagatcagaacgttctgagagataacttcccaggttttcgggttaccaacaccgtttttgttgatgtagtcggtcatccaagccagctgaccgatgcacaggttcggagactggtaagccggcagaacggtctggaagaagatctgaccttcagacggaccgttagccggagcaccagcgaaagcaccaccaccgtaggtcagaccagaagcgtaagagaaacccggggtcggggtagcaacaacgatcatggtgtcagacatatatatttacctcctcgtactttattttaatgttacgaaagaagagttgcgtgtttcacgaattaaaactgatccgtcacggttaatgtaataaattaagctaaataaagtttggtgtgctgacgcatgttcaaaactagttgggtgagatttccaatccggagtttcagcgatccattgataaatccaccaaggaacagtacagaatcctggattttttccaatcaactgaagattcgggctaaagttttccggaagagtaaatacagacggcttttcagattcaataatctcagctacagcctgttcgaatttttcttcaacaaaaggagtatcttcaatcaaaacatcggtattttcaggaattttatccgtttctactacttcaattttaatgtcagatttaactggagaatcaatcaaaagtgctgcttctggattgacttcttcatcgtcatattttaatccctctgcagcatcagcagcatcaattaagtctttaatagataacccatcagtctctggcataggttcactagcgagcttctggagggcttcttcaatatcaacaacgatattatcaaaagatttattctttttgacctttataccaaactgttcagcatattcagctaatttagctttagcttctttattatcatcaagagccttcagctctgcaatataatctttatctatcataatatttcctcagtataaatatagatatatttattactcggaaaatagtatgtaccactttgtatatgaaacaacaaatctaataaatggtaaaaagtatataggaaaacactctactgatgacttgaatgatggttaccttggttccggtaaggcaattcagcaggctataaagaaatatggtgaaaacaatttctctagaacaatactaaaagagtttaaaacttccgaagaagcgtacatgtatgaagaagaaattataactcctgaactaataaaaagcaaaaattattataatatgaaacctggtggaattggtggaattattatgactacagaggttatagcaaagatgaaagaatcttccgctaaaagatttgaaaactcaccaggcacggtattaggtaaaacttgttacactaatggaactaaaaatatttttattaaacctggagaacttgttccagaaggatttgtaaaagggatggttcatcctaatagaaagtccagaaaaggatgtaaagtcaaaccgactaccacaggaactttttgggtcaataatggcgcaataaataaattaatacaaccagacggtattattcccgacggatttattaaaggtcgtctcatgaaaagagattctaaaggcaaatttagtaaggcataattatggatattaaagtacattttcacgacttcagtcatgtacgcatcgattgtgaagagagcacgttccacgaattaagagatttcttttcgtttgaggccgatggatatagatttaaccctcgcttcagatatggcaactgggatggacgaattcgtcttttagattataatcgccttcttccattcggtttagtcgggcaaattaaaaagttctgcgataactttggctataaagcctggattgacccacagattaacgaaaaagaagaattatcaagaaaagattttgatgaatggctttctaaattagaaatctattcaggaaataaaagaattgaaccgcattggtatcaaaaagatgcagtgttcgaaggattagttaatcgtcgtagaattcttaatcttccaacatccgctggtaaatcgttaattcaagctttgcttgcgcgatattatttggaaaattatgaaggtaaaattcttatcattgttccaacaactgctctaacaactcagatggctgatgacttcgttgactatcgtttattcagtcatgcaatgataaagaaaattggtggcggagcatcaaaagatgataaatataaaaatgatgcaccagtcgttgttggtacatggcaaactgtagtaaaacaaccgaaagaatggttctcacagtttggaatgatgatgaatgatgaatgccatcttgctacaggaaaaagtatttcatctatcatatcaggtttaaataactgcatgttcaaatttggtctatctggttcattacgtgatggcaaagccaatatcatgcagtatgttggaatgtttggtgaaatatttaagccagtaacgacttctaagttaatggaagatggacaagtaactgagctaaaaattaatagtatttttcttcgctatcccgatgagttcactactaaattaaagggaaaaacttatcaagaagaaataaaaattattacggggcttagtaaaagaaataaatggatcgctaaattggctattaagcttgcacaaaaagatgaaaacgcttttgtcatgtttaaacatgtatcacatggtaaagctattttcgatttaattaaaaatgaatacgataaagtttattacgtatcaggggaagttgataccgaaacccgcaatataatgaaaaccttagctgaaaatggtaaaggaataattatagtagctagttatggtgtattttctactggtatttcagttaaaaatctgcatcacgttgttttagcgcacggtgttaaatcaaaaatcattgtattacaaacaatcggtcgtgtattacgtaagcatggttctaaaacaatcgcaacagtctgggacctcatagatgactgtggtgtcaagccaaaatctgctaatactaaaaagaaatatgttcacttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgtcaaacattagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgcgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaaggacatcttcaccacacgggtgatcggccaggatacgaatatcctgacgcttgagattatactttttcattaagaattgaatttccgtttcaaattcttcttcataattaaaagcatcatcaatgctatatctcattattttccagcctcaaatgcccgcatgtcttgaatatgcttaatagcaaatccacgtgatttaatagcatcaagagctccgctacagaaatctaataaaatcccccaatactgcaacgaggtatcaacctttaaaacatccttatcagctgatagaactgtcttcatttctgatttctcgtaacgatccatactaaattcatcaccatctcctcgtcccgagtagtagtctaatttagctttaagagcaacttttttctgtgcatcaattctaagcatttcctttttaatacttgaatgcttattaagccatttactatataacatcacattattagctgcttcatactgtaatttagtcgaatctataaacacatctttcttcaattcttcttgaagatcttctaatctcatattgttctctattcaattgttattggatggacttagattcattataccacgtttatacgtgaagcattatactctattactggaagccagttgtagttttatctgctcaatatcatcagggttatcgatgactgaaaagcgtatttctactatcaaagtataatcatcataaaccggtattacattaactgctaatttatcaatacgtggctcatagtttcttactgcgctttcgatattacgctcaaccgtgtcagcagtaagaggagtcatattctcaaaaagttggtcagataaatcgcatccaaattcagggtcaaacggtcttgaaccttttcttgttgtaataattcctaaaagactatttttaattgaccttaatccaagtgatcttgaaacgtctttgttccaatccattttcatctctgggtcaatatcagaataaagcttattaatatttgccattacaatagctcaaagaattctttgagtcctcttattacatgagcgtgagtttttccacactctggacatttaattggaacagccaaataaacagtaggctttaaaagcatatcttttatagctacaatatctgactctgtgatgatagaatataaatcttccagttctttttcatttaagtcttcaactggaatgctttcaccgttagcatgaatcgtttctatacatgatactatcatgtgggctatatttttatcatcaaaaattttagggtaatggaatttaattttaatgtcacccagtgtataccagaggtcttctggtgcatccatttgtgtatgtaatagatttatatgggttggtatttcagttccacaggtgcacttccaggagttttcgtgattaacttctccaagagaatgcgcccataaatgaatcagtaatagttctgattcttggcggtttaaatcttttgcatttgtacagtctttgattagctttttaacaatctcttctactgaaccattctttttagcagtaataagttctagatattctttaagagtaaatgcgcgacagttgattattttagaaccaactctcacatcaaatttgtattcatacatatttagctcctttatttatcatatttataaatagaataaaaggagcatctatggcaaacattattcgttgtaaattaccagatggtgttcatcgttttaaaccatttacggtagaagattatcgagattttttgttagttcgaaacgatatagaacatcggtcaccacaagaacaaaaagaagtaattgctgatttaattgctgattattttggagactatccaaagacttggcaaccatttatatttttgcaggtatttgtaggttcaataggtaaaactaaagtaccggtcacatttgtatgtccaaaatgtaaaaaagaaaagacagttccatttgaaatatatcaaaaagaattaaaggaacctgtttttgatgtagctaatgttaaaattaaattaaagtttccttctgagttttatgaaaataaagcaaagatgattactgaaaatattcattctgttcaagtagatgaaatatggtatgattggaaggaaattagcgagtccagtcaaatagaactagttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgaacgcggattcgtattaaaactgattgagaaggataaacatcaatgagtatgttacaacgtcctggatatccaaatctcagcgttaaattatttgagagttatgacgcttggagtaataatagatttgttgaattagctgctactattaccacattaactatgcgtgactctctttatggtcgaaatgaaggaatgctacaattttatgattctaaaaacattcatacaaaaatggatggaaatgaaataattcaaatttctgtagctaatgcaaacgatattaataatgttaaaacacgaatttatggatgcaaacatttttccgtgtcagtagattcaaaaggcgataacatcattgctattgaattgggaactattcattctatagaaaatcttaaatttggtagaccatttttccctgatgcaggtgaatctataaaagaaatgcttggtgtcatttatcaagaccgcacattattaactccagcaataaatgctataaatgcttatgttcctgatattccatggactagtacatttgaaaattatttgtcctatgtaagagaagttgctctagcggtaggaagcgataagttcgtatttgtatggcaagacatcatgggagttaacatgatggactatgatatgatgataaatcaagaaccatatccaatgattgtaggtgagccaactttaataggtcaattcgtccaagaattgaaatatccattagcatatgattttgtttggttgactaaatcaaacccgcataaacgtgatccaatgaaaaatgctactatctatgctcattcgtttttagattcttcactgccaatgattactacaggaaagggtgaaaactctattgtagtgtcaaggtcaggtgcttattctgaaatgacttatagaaatggctatgaagaagctattcgtcttcaaactatggcgcaatatgatggctatgctaaatgttctactgtcggtaattttaacttgactcctggtgttaaaattatttttaatgatagtaaaaaaaaccaatttaaaacagaattttacgttgatgaagttatccatgaattatcaaataataattcagtaactcatctatatatgttcactaatgcgacgaaactggaaacaatagacccagttaaggttaaaaatgaatttaaatctgatactaccactgaagaaagtagttcttccaataagtaataaagaagtttctattcctaagatgggtcttaaacattataacattttaaaagatgttaaaggtcctgatgaaaatttaaaacttcttattgattctatttgtccgaatttatcaccggcagaagttgatttcgtttctattcatttattggaatttaatggaaagattaaatctcgtaaagaaatagatggttatacttatgatattaatgacgtttatgtatgtcaaagattggaatttcaataccaaggaaatacattttattttagacctcctggaaaatttgaacaatttttaactgtaagcgatatgttatccaaatgcttgcttaaggtcaatgatgaagttaaagaaattaattttcttgagatgccagcatttgttttaaaatgggcaaatgatatttctacaactttagcaattcctggccctaatggtccaataaccggaattggcaatattattggattatttgaatgaaaaagccacaagaaatgcaaacgatgcgtagaaaagttatttcagataataaaccaacacaggaagcggctaaatccgcttctaatactttatctggtcttaatgacatttctacaaaattagatgatgctcaagctgcctctgaattaatagctcagactgttgaagaaaaatcaaatgaaatagttggagcaattgataacgttgaaagcgcagtgagtgatactactgccggttctgagttaattgccgagactgttgaaattggcaataatatcaataaagaaataggcgaatcactcggaagcaaattagataaattaacgagtttattagaacaaaaaattcaaacagctggaattcaacagactggaacgagtttagcagtagtcgaaaatgctattcctgttaaagtcgtcgaggatgatacagctgaatctgtgggtcctttattaccggctcctgaagcagttaataatgatcctgatgctgattttttccctactcctcagccaattgaaccaaaacaagagtctccagaagagaagcaaaaaagagacgcatttaacttaaaattatctcaagctttagataaattaacaaagacagttgatttcggatttaagaaatctatttcaattactgataaaatatctagcatgctatttaagtataccgtcagtgctgctattgaagctgctaaaatggttgcattgataatggctgttgttattggaatagacctgctgatggttcattttaaatactggtcagataaattttcaaaagcctgggatttatttagcactgattttaaaactttctcaagcgaaacaggaacttggggccctttattacaaagcatctttgaatctattgatgaaattaaaaagttctgggaagctggagattggggcggattaacagtagctattgttgaagggcttggaagtgttctttataatttaggagagcttattcaattaggtatggctaaattatctgcagcaattcttcgagtcattcctggcatgaaggatactgctgatgaagtagaaggaagagcactagaaaatttccaaaatactacaaatgcttctcttagcaaagaagaccaagaaaaagttgcaaattatcaatataaaagaatgaatgacgatcttggtccaatagcaaaagggctagacaaaattgcgaactggaaaactcgtgcatctaactggattcgtggtgttgataataaagaagcactaacgactgatgaagagagagcagaggaagaagaaaaattaaagcaactttctccggaggaagctaaaattgctttaatgaaagctaatgaagctcgtgctgctatgaatcgttttgatgaatacgctaattcagctgatatgagtaaagactcaacggttaaatcagttgaagctgcctatgaagaccttaaaaaacgaatggatgacccggatttaaataattcaccggcagttaaaaaagaacttgctgctagattttctaaaattgatgctacttatcaagagctcaagaaaaatcagcctaatgccaaacctcaaacttctgctaaatcgccagaagcaaaacaagtccaggtaatagaaaagaacaaagcacagcaagctcctattcaacaagcatctccttcaatcaataatactaataatgttattaagaaaaatactgtcgttcataatatgacacccgtaacgagcacgactgctcctggtgtatttgatgcgactggagttaattaaggaataatatggcaattgttaaagaaataactgctgatttaattaaaaagtccggtgagaaaatttcagccggacagagtactaaatcagaagtagcaactaaaacatacactgcccagtttccaactgggcgtgctagtggtaatgacactacaggggacttccaggtaacagatctatataagaatggattattatttactgcatacaatatgtcatctagggattctggaagtcttagaacgatgagatctaactactcttcttcatcttcgagtattttacgtacagccagaaacactatcagtaatacagtatcaaaactatcaaatggactaatatcagataataattcaggaacaataagtaaagttcctgttgcaaatattcttttacctagatctaaatctgacgtcgatacgtcatcacatagatttaatgatgttcaagatagtcttattacaaaaggtggaggtactgctactggtgtgctaagcaatatggcttcaaccgcagtatttggagcgctggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatctagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgataaaacacctaatggtaactttaacggattagctattgctccaaatctccctagtacatttactctcgagattactatgagagaaattatcacgttaaaccgtgcttctttatatgcggggactttttaatgtattctttagaggaatttaataatcaagcaataaacgcagatttccaacgtaataatatgttcagctgtgtttttgctacaactccatcaactaaaagctcttcgttgataagttcaattagcaacttttcttataataacttgggcctaaattcagattggttaggattaactcaaggcgatattaatcagggaattactacgctaattacagctggcacacaaaaactgataagaaaatcaggggttagtaaatatcttattggtgccatgagtcaacgtacagttcaaagtttattaggctcatttacagttggtacatatttaattgacttctttaacatggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggcagatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtgatgcaggctggagcagttgatagacaagctgccattgaatggcttgaatctgctactataaatggtattcaaagcgttctcggaaatagtggaggtgttactggactatctaattcgctttcacgacttagtagattagggggaactgcaggaagcatttcaaatattaatactatgacaggaattgtcaattcgcagagtaaaatattaggagcaatataacaatggggacctttcggtccccatatttttatttacggaatgaaatgaaagcagcaactgaagcaactaaactgtcttcaatataaacttcaatttttaccggagcttctgactcaaatttacctgttactacaccctgaaaaatactttcagtctgttctggctttgaaaaattttcagaaggaaaaattccgaactttttatctgttccaaaaattttgataaattcatcgtaaactgcttcattaaaagcattatcagcaggaataatgccttcaactacaagttcttgacctaaaaagcgcaaagaagatttcattttgtgttcctcatgttatgtcagtaagactactataacacaacacgagggacttgtaaactacatcttgaactttttagacattccgttgatgttaaccaaagaagctaagatttgagaaacttcgttttcctcttcttttgattcttctacaaggaattgattaaatccagccattggacgaacttcaccagtttccatcaaatgatcgccatcatatactgattcttctaattgctcagaaggaggaacgattgtaccttcgattagatacttgttataagcagtttctttcataaagtaagtacttactttattaatcttcagtaaaattccacgcggtagaataacttcagcttctgatggaaatcctgataaatgacccggaacgataactttgattcgctcagctcctttaattaccatacccacgctagtttcagcatcttcattagcatatgtagaatgactacccatatgcatcaaatcttctgcatcaacggaaccttctccttcaccagaaaatactgcaccggaatcatctagagccatatagtttttaccatgctcgccgaagatatttggtttaagcgatgtagatacgaagttcttgaaatagaacattttgttttcaatgttatgacgcaaagttttaaaggtaacttcttgtccgcgataaagcgtagttcctggaggaagaactgaacctttagcgaatgcagaatccaacgtctcgatgtgcttaatagctcgttccatatattcttcacgggtagaatctggtttacccaaaaggaacgagttcatttcaacatatgaatctgcacaataatcttcaattacatcagattcggcctgagtcagtccttttggagttacttcagtgcttgcgtattcatatgcctgggcagcagattcattaatcaatttataaatgccattcatgacaaattgaataatagctgtcttttcatctggcgtagctttagaacctttaactaaatcattaataattttcttaataacatcaaagctattagaaatattaatgtcagcaagatcgcttaaaattttatcagttttataatcaaagaattctttattctttaaatattcttgagaaccttgatatgttatatcgctctgcaacttgatagatggatcacgtaaacgtgcatgggccaatgcaatatgatttcggaagttttctagttcataatcgctagatttaaaacgagaagcacttctcataccaccgatagctcctttgctgaagtttgaaccaatctggataacgccagagttcattggtccttctgctttatataccggaactttagattcaaactcttgatatttcttggcagcgaagctatcaccctgtagcgaagcatcgacagtagaatattgagcttgtgctgctaatcgacgactaattttagttttttgaataacagcttgatccgtgcgcttatcattttctaaagcaatagaagcagcaacagcgacagctttaggaacagcattacctgttttaacatctacataaacatcaccgaccttcgattcaacttttgtgaataactcagttgaaataggaggtacacctggaatgtcttctaaattggcatttttacggtaaaccataatatatgcatactttttatcatagtcccagatttcctttaaaagaacatatctacctgctcctttagtacgtactaaacggtcagcaataacttgcatttgacgagcagcgccatttgttttactctttagtacgcggaataagcatgcatcaattttatactgtttcattgtttgaagagcagtatcaaaaacagcgttaatgacgccaattggatttccacccaagtttctaagtttaaccagtgataatttctcgttgacacctatcattacgatatgcatcattttatcgcccggcttaacgtttttatttgtatcacctccagaggtgtatgtacaaaatctaaatccaggaagcacgctttcttcgccggcttgaatagcaaaaatttgaggtattttatgcttaggatttaagttaacaaccggcgccgaagcgccgtcaaataattctgtaataagttccatgatttatccttgaacgaacttgtaaggcatgtttgcaatatctatgcaagacgcaataattccaagagatgattctactttctgtttaacatttgatgaaacaaatgatgcaaagtcaactctatcttctatatcacctgtcattgtaaccaattcaccagtttccattaaatggtctccgtcatagattaccgattcggtgagttcttctgtggtcataacttcagcttgaataagcttgttgttagttttaactgttccatcattgtaagatgcatcggttattttattaactttgaccattaatccacgtggcaaaatgacttccatttcatttgaaggtgctaaacttccaccgggtaaaacaacattgaccttatcagccccagtaataacccatccaattccaactaaattatcgctagaatttactagtccttcatcagttttatcaatagaaacacttagacgcttttcgtctggtaaaacacctacagatgaatcagtcatccaagtaccaaaaatatttggatataatgatgttgacacaaagtttctaaaataaaaaactcgattttttaccattgcttcatatattgaaggtaacattcgttgtgaacgatacaaagtaataccttttggtaatcgttcaccatttttaaaggctgaatctaaattatcaatagctttttctatgtcagatgctgtcaaaatacttgtacgctcatctggattatataatcccaaaagagcattatttatatctacatatcctgaacctacgtattcacgaattccgcgtttttgcgccggtgtgtatttagatgaatctttattttcgactataggatgtaatgaccatccagctgtaagagcatatccacgtaattctcttcgaataatctttgtttttattgcattccaagaattttgtactaactcatttgcagcatcttggtttaaatgcgaatgtttgttaatatttctttcaaaccaagcacctttatatttttctaaagtatcatcgacgatagaagcaatagtttctaaagtttttattgaagtaatagattcttttcgtaatctttctaaagctttattttttatttctgtattaacatcagattctttatcttcaggaattatagaagcttctctgaatgccattccagctgtaacactattaagagcattctctaatgcaaatcctgaagtagaaataacagttaattcgttagcatcggaaattaaaggcgcatcagcgggtttatttaattctgctgctgaagcctcaaatttttgaaacatcggtgtttcaaatctagaagattccaatgactgactttgtgcaattgctctacgggaaattttaactttaacgattacagcttggtcagaacgtttatcattttcttgtgcaatagatgctgcaattgcctcatttttggttacttgagctccggtatctttattgatataaacatcaccgaccttcgattcaactttagtaaagagctcggtactaatttccggaactcctggaatgtcttctagtgatacatttttgcgatgtataagaatatatgcatactttttatcataatcccagagttccttaagaaggacgtatctgccacctgaacgactacggataagtctatcagcaataacttgaatttgtcgagcttgaccagcggttttagacttaagaatacgaagcatacaagcatcaattttatactgacgcattgtttgcattgcaacagtaaaaactgaattgatataattaattgggcttggaccaagaccttttaatttagcaattgaacctttagcggttaatgtaaaaggaacaatatgcatcattttatcgcccatttttaaatcgcgattagtatcacctccagatgtataggtacataaacgaaagcctggttgttcaattgcatcatcaacatgaactgaaaaaatttgcggtattttcttctttggatttaagtttgtaatcggaagagtagtatcttcgtcaaataattctgtaataagttccatcatagcctctctagtgtttattctatttataaaattaaaggcccgaaggcctttagtaatctagtggtaagagagtacgatatatttcaaactttggtcctttttcataggcatcaaatgtttctgtaaatttattataagcgtatgcatctacaaattcgagaatgacttgtgatacagaagtagaaacatctccaccttctttttgagcaatgacaattgtttctaagtaagctttcataaaccagttacctcatgaaaatcaccaaatacatcctcgaatgtattagctttagttttatcttcacgtaaacgaatcgcaatcggaagaaataatttaacgtaatcagtgcggccatcagattttaaccaaccgttgcattcgcactctagaatttttccaatataataattttggttttccataatgcgagtacggtcaagttcatgcgattttacaccggctttatcttttaagcctgaaccagcatttaccttaatttttccacactctgattcaagaataaatccacccgctttagtagggtctttacggtgaggataaattcctacaatttttaaatcaacatcaattacttctttaaatttatagagattttttgaacgagcattttcccacaatccatcggtatttttgagaataataccttcaagaccttggtcaatatactttttataaattaccttagcttcatctaggttatttactacctggttttcaattaaaattactttatcataacctgatgtcatttgttctagtttagaaaaacgtacatcatatttcaaacgaaatgcaggaagaccgtatatttctaccaacgggacataatcccagacctgaaacttcatgcattgagcttctttttcagaaatggttccctttaaagatttattggcgatgccattagatgcagtacgtgattcagctacttcggcgaattctttagctttactaatttcaggataagcatcaaaaagaaaatctaggccttctggctccttttcaacttgctcatggtataccaattcgccatcaattaacacaccttctggatgaatctggcgagcttctgcagtcattttgattaactcttccttaagaagatctaatcctagatattcattaccagctcgtgataaaagacgaacatcatctaattcatcgcctcggacttcagcaaaacaccgagctccatctgcttttaactgcgcaaaggctggaaacttgatattcttattaatgcctttttcatcataagaacttgcaagcatttgaggttgttcaggaattaaacctggccaaactttatttgcaatagatactgaagcaccgcattcaaggtctcgcatcatcacccgacgcaaaacttcaacatcatcttttttaccgtcagtaatatatccagttaattcctcaattgccgcatttccagtcaatttccgagtagctaacgtgaattcaatgaagtcaagcatatcggtaagagtcaacattccaaaactctgggtagcaatacccggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacgtaaatgaaaccttgctctacgcattttttaaaaattcgttcgtctttttgagctcggaattctggattgcatctaaaaaattgatttacgtgaccgtaatcacgtgtagtattaccttcattttcataaatagtgtgaacaacaaacattagaatgctccttggaaaatattatcaccacaagtaggtctattatacaaatactctataccgccgggtttaatatagttccatgtctgaaacggatgcgtctgatatggatgatatagatgattataaggattaaatccaggagttctccaggtagtgttccaaggaaaagaatcgtttttaatcatcttttcaattacatcttttatagctttttcactatcaaaactttctttattttcctttggtgaaaaaagcttattctctacatcgttccatatataaactcgctgagcagtttttggaatactgtcacgctcccctcgagccatccaataaacaggaacatttaatatttcactcgcatgatcgcagtggtgagcgagatcgtcaatataacaaattacgttatatttctcttttgcctttttgaacaactcttcttttgaagaatcatgaccacacatcagtacttctgagaaggcaccaggaaaaagagcattcaaattaaattgacgattcagcagagcgtcaatagaatcacccagtgctgtaacagctacaaaattataatcttcttttaatttgttaattacacacagggcatctttatatggcgacaagtaacgaataaaatctgaacgattgtatttttcaattagcttaacgccaagttcttcatcacaattaaaaagtttaccaggagaaataaatttctcatcctggatcatttttaaaatatgttctaacggaagattatatttctgagcaaaataaggaaggcctgattgccagcttaaacatactccatcaatatcagttaaaatagtaggcttcatagagagtctcttaataggtttaacacatcaataaattcagcttcggttagtattgtatcatcttttgttagaccactagccatgctgtgcttcaaaacttttcctttcgaggcttgtaatgcatcacggaagcccttgttttggatcgctgcttcaaaatatgcatttgtgtataattctttccacgccggggagtatcttgaaaatggaactccaagccagaagagggtcccacggtcctgagctcttgcataagaccttccagcttgttgggcggcaagcccggataacccaaatatacgacgttgttgttcaacatttttcactttgcatccttggaggaatccttcaagacctccaaattgaatgccatccataacgaaaggccaatgggcgaaattacttaatgcacatgatggccacctaaaattgcttctaatctctaactcagacattttcaatgcttataatttcaacatcagcccaatgaccatagcaaggaagacgaaattcaactggccagttagggtccttttctaatataatagactcaacttgcggttcttcatgttcatcagtatacggatttttatctgttactttatatgtgaccttaatgtactgaattccaaaaatcttattaattatattcatactatttcctttaatccgtagataggagataattcatcacccatacgaaggtcttcatttccatctacccaggaaacaatataagcctcttttatttgaataccactccatttaaatggaggtaaaaccttagaaattaatccaggtataccaactccctttaattcaacggtttgacctaaaaagaatttcattaaaacctcatctgaaaaccgtgcgatttaacattaccgccgccaatatcagaaatgttaatttcacgcgcaattgaagggtcaatgtcaatttcgcgattgagtttagtgatagctaaagtatcgcgcccatttacagtacggaactctaaagggcagactacattaacgtagtttttaatcgattcactggtaggttgcaaatgtgcaggaaggtctttaggcgcctttgagaaaactacttcgcagaagtttttacgggtatcaaaataagtagtcataaacataacattttcctcagtaaggggccaaagcccctcatttattttaaatatcaaattcgttaagaactacatcaaagattgcttcaagatgctcaggtttagctctgttactcagaatatgacgaatccaagttttaaccaaaagcttgcgattaacgccattccagcaaggatgagtccctaaatcgcgttcacggaaatcatcatccagagcgattttaaagttggaaccttccatcgtgattgaaaccgtgataccgttttcaaatcgcatataaacgtaattaggagtcatatactgctcaatttcgcatactgatccattttgatgtttccaaaggcaaatagtatcaatagaacctgcaataccattagaaacatatttacgttcaaagttgatgtagttcattttattctccaagatgtttaattgcggtacaggtatataatatcatatcctgtaccaaagtaaacaattattttactactttccaatgctgcatgtcaagtttaccaacttttttcatcttctcaattaagcgttcggcacgttggcgagctgtaacataataccattcacctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagttttaactgcagcgttcagattaatcgttttcattttattctcctttgtttgtgtaagataatactatcacaaaggaaccatactgtaaacaactttatgcaatctttggaaaataaaaaaggactcccgaaggagtcctcaacttatgctttctgcttaccaaaacgagaagcatcatctcgaagaaccgcacgtgctcggcgcatgatcttctcaacagtttgattgatacgagagttcgacccacgcttgtagccagcgcgtttagaatcaccaactttcttttcaactgctttctttgctttagcttgttttgccattataaattctcttttaaatgaaaatgcaggacttattggcattgcctgcgcaagccctcaaggggaacataggtttttggatatttaacgaccaggataaccataaacccgtcatcattcacattcaagaggtacaccgtaaaactgccggggtcttaaaactataatgattcgcaaatcattaatcagacagttcgacggctcctcgatttagctcacactaaggcagtgaatctccaataaattacttcaatgttaccacaaagtgacgaactgcttttcgcgcagcagaagccaaaggcttagcatatttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaggtaacgaatttttgtttaatttcttttggctgcttaagacccagagctacaaaaggatgcggaacatttcgaatttgaccaactggaagagaagtcaaatcgccaacttcgcagaaaccttcaggaacatcaggaccgacagagtgaactacacacagttcaggaacttcaccttgaacacgtttaccgataataagtcctgattctgtaacttcttcatcaccggcttgtgcaggttcagaaactaaaataacatattcaccgacagcacgaattggtagctgttgtacttcagacatcgtttttcctttttgttaacagatgaattaataataacaaataattcttaaagcatttatttaccaataaattgaagcaaatgctcaactttcataccattaacggaaatcaatttgtcaatagaaaaacctcgccatgcaccaagctcaacatcaaataccggaatcatgtcagtagattctttccgagtagattcagtcaatttgccagtttgcatggttggcataaagtccgcgtcgcgagtacctttcataacacgaatagtaccgtcagacttttcaaaaactacgtttgaaacacccatggacaatttagttttcaaaatttcacgaattgctactttctgctcagttgtcagtttcatttatttacctattacagttttaatatgagttgttccacgttctttaagggtggaaagtaatttttggcatttttctaaatcagatttccaactatgtggtctatcaatacaaacccagtttgacttataatactgcttccatttagagaaaaaatatttcttatactctacagcaaatgaaatgttctcgttggaataagaactaattgctgtgagctgtaccaaacgaaatttcattattcaccacagaattcgttgatattttcccagtttaacttatttaagtttttcttaggaacattaaacacttcaatacctgcatttcgcagaatatcatcccagccaggtttatttttatcgtatgtttcacaataaaccagctttttaattccagattgagctattgcttttgcacaatctgggcaaggagaaagtgttacatacatagtagcaccttcaattgaagaaccgtttcgtgcagcaaacaaaatcgcatttagttcagcatgaatttcatttttagacgaccattcagagtgcgcgctacgatgttctttcgccaatacaaaacgatcagttgaaccaaacgatacacattcaggcttatgaccttgaatgatagtatgtttaggcttattcagcaaccaaccttgctcagcagcataatcacagcagttcacaccacctgcaggtgaaccattatatccagtagaaataatacgtccattcttttcaattactgctcctactttccaggagcaacattttgattcttgtgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcaccagtcatctttttgtgaagctcaaccggatacttcgtcacaataatagcatcatacacagaaggatgaatactattcaccagagtatcattcattaaagttattctaatgaactgtgctgtttcagaatcaagcgctctatgatcgccagtatcattttcaagacaattatcaattatatcagttaaattcatcatagtacgccatacaccctttgtgcttcaactaatccatcaaaatccagtttaagatgcgatatttgatcgccatcacctggattcacaattactaatactgaacgaggagtttcggtaataacacgaaccgacgtttcaggaaatcgttcagaaaccttatttaccaattcttgagcaaatagtttaactttttcttggaattctttaacagtaattggtttttcgcttagcatgttgatcctagctccttactttcaacatttttaactaatttgacagaaactaattcagcatcttgggtaatcattaccggaccttcttcatgctcttcaagatattctagagctttctttttagcttcttccttcgtatcagtttgagcatagatatagaacatacaaccagtaatacctactactttccacttaatttctttatcagttttaatttcaaatttacttacagaatcatctttttgaacttcttcgaaaaaagaatattctaacatataagcaattgaaaataacgggctaactttataggattcacccattacatcaacagctttataccaacaatcatcaatttcacgtttaatgctaataacatttttcgcaggatctatttttactttaaatgaattttccccaataaactgggcaattcgtttattagccccgcaagtttcattaaaaatatctttatatccagctttaaagcgataaaccttatcttcttcaaaccattcgctcatttcaatttcctcatttgttttggtagagctataatatcacaactctaccgtaaagtaaactattaaattgctttgaattctgatgtctgtgattcaaagcgaatgtcgcctttgataactagctcagcatcaagaccaaatacaacaatgatatgcgcggaacctggatacaacgtaatggcaatagaatccacctggtctggaagcaaagcgttcaatacatgagtcacttgagcgtggattcgaagttcagctgcattatcaagcttttcaaacatgttattagcgataatttggctaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccaactaaaccgctatttacaataacaaagcccaagtttcatggtgccaagccattaaaaatctcccgaagcgacttgccagcattcaacaccgatgcggcgccacatttcaactacttgagttcggtcatcaatagctaatttcacatcaaaatgtggtgcgatgtgtttccagaaaatttcttctttaactacatcatctttacgggtatcgccttgttcgcgttgacactgcatgactaatggaacaccagcaatgtcctcaacccatttacgggtcatacgataatatttcgttggatcttcttcggttccactttcacggcctgaaacgactacgatttgataacccataagagcatacatcttggatagttcaacgaccattggattaataatatcgatatcgcatttttcaaggtcataaggaccacgaccattcatttttgctaacgtgccatcaacatcaaaaataactgcttttggtttaccaggagtccctttatataccggaagaccgagatactctcgcatgcttttatacattgagcgtaaaacatcaattggtactgctttagttccgcgttttgagttacgtttaaccaattcagtccaaggaacatcaaacactttatattcaatttgatgcccaagctctttggcaaactcttcccaaaccttacgtcgttcaggattcagattagtatctgaaacaattacacccttcgttgcgtcttggcagagaatcatgttagcaacatcatgctgcatgtaagttacgataccttctttatttttggtatacttgtactcatcgcgttcttcatgtgccataatagattggcgatagtcatcacgattgatattataaaaccctggatttttagcaataaattcacgagcccaagtactcttaccagaaccaggacagccaatagtcaaaataatctttttcatcatttaattcctaagaaaacttcaagaatacgaatattatgctcacgccgccctttatataattcagctgttgattgattcaccgatttgctctgaacattagatgaaataaattttatcatgtgatttttaagctgatacatatcaaacccacgagcttttgcttcttttcgtagggctttaccagcatcatctaaagctttagcatgttcaatgtcttcgctaatgcttgatgcactttcatggcatacatcaatgtaacggtccgagcattcaatataacgttctagcagagttttcatttatttttctcaactaatgattgaatataatcatgcaagtctttagatgctttaccccacttattttgatattcatttttgagattagcacgtgattgagctaataaaacatcattagttggaggtaaagattctaatcgttgaatctgtcgtccataaatcattgcagccatctcggattcataaattaatccttttagatgttcaaattgataccatgaaatcatttacatttatcctcttttagctcttgacgataataacatatcatagttttctggtcatgtacatatcgttttacatcattaagccaaatacgaaattcctgagaatcttcaaatggcatacctacccaagctttaccatcaataactttaacttgccaagatagtttagcttcgtcatatgactttatttgcacaggccaattaggatgaactgtttctttctttacttctagaggctttgtcgaacaaccaactagaagaccaatagataatattactgctgatagtttaatcatttagaaaggtcctggatgtcttctgcgaacttgttgaaggagttgttgatttgtttttcaaccaatcctggcttatgagccaccacatccgccttctttgcgtctttgcgcagcttttcattttcacgctcaattgcagcaattgattcacgatttttattattcattgcatcaatataattatattgattttttaaatcatttaatgctaaggcgttttcattggccgtttttgtaatttctacaacagacgtttctaatctttcaattttattttttaaaattaaagaagttccgcccaatgcaattacaattaataacaatccagctgtaaaattacttacatgcataaagttttaataacctctataatatcgtcttgagaaagaccgttaattaaaatatgatgttcagctggagatttagaaattttaaagcatgcctcaacatcttctgccatatccgatgcactacgatttggattactaattccaagacgatgctttccagtcaaaggattaacgatgatatagcatttacaactattgatatgaacattaggttgagtctgattaataaatacatcacaatcatatttcgcaagctgattttctaaaaagactttcatctcttcaaccgcatcaggaagcatatcacgggcttgctcaagacgacgatttcgatattctttaatggtcgttttccgcttgacttgcttagctaaatctttcttaagatcggtgatatatccaactcgacggtttcctttaaatacagaaatcccatctgtagtatcaccgtatgcttcaacgaccatttcagtagtaatgagctgcaaatccatcataaagtcctcatgttatgtcagtaagactactgtaacacaacacgagggacttgtaaacagcttagtatccttctgggataaattttttataatttttcaaaaaattctgttcgatttcacacataaccttctcttgactatcatacccctggtataagctcatgatgataccgaacaagtgatccattccagcacctttagcaacaccttgcgcttccatcgcataagtctttctatccttaccacaatgcttattatgacagtcaagaactaaaaacagagctcggtctaagtacttcagataagtcgtttcaaatgcttcaatttttctgtatgaatattcatcgtcagcatacattgctttaagatcatctgatgcaccatcaataatagtcttaaacaatttttctggattatctaatgaactttttgtgctatgaagagacacataccagtcagacttaattttaaaatgagaaccatctttcatcacagcaacatagccttcgatgttttccgcatttttagcttcttctacccatttagggctatcgatttcgtatcgttcaactagatatggacgaagagcagcatctttataaatatcatcatatgaaatgtattcacccgtttcgttttcacgaacattcagtaaaataattttcatttcttggtaagcaagaacgattctattcgtcggagcaacgaattcgaagttagcagtaaatccatcttcagctaattctttaagtctatcacgcaaccgatggtgattaatattcatcaaaataccattagccattaaagcctgttcggatttgattgaaccctttgatttgaacagaatttcatcaccgtctaaataagttgataccaaagacccatcttcttttgttagaatgtaatcaacatcatttaaatcgatattcatcgtgaatggattttcattcaagttaaaaaacttttccataggacgagaagcaattcttactggtttttctccatccatttcaaacatgattccacgacattccaatgcgtctggaagtaaccaatcagaataagatgcataattatatgagaaaattctgtaagttcttccagacgcacttacatcatccgagtaaaaaaacttacgctgtgaatccttgcatagttccattaaattgttaaaaagttcttgcattgtgtatcctcttttgtgttttgaatatagtaccacactccatgtggaagcatcattttttcttatgttgaatattccaaggcgggttaaacagcttaatgaatagtggttcctctaggtcaatcgtcgcgattgtcattgtacctaactcatttgtcatagaaagattaaaacattggcgggcgtaaaattcaactttgcttccttcctttagcgcagcatgaattaatgcagatttagtagaatcagacgttttgtctttacggttaatagcagttctataatagtttattcttttgcgtaaatttttagtttttccaatataaacaagttcatcatttatagcaatagcataaattacgttatacttgtttggaatagataattgttttatacttccgttgtagtctaattctagctcagtatatttaataaatgaatattctgttgcaatttctttcataataaaatgggccttgcggcccactccttaaaagtattttttaaaactcatcataactttatcatcaacatcattatcaatctgtgcaacaaggtaagatgacaattctacttcttgtggcgcagattgaacattatcagaattaagatattcacgaatccaaggatatggatgtttaaccggagcatcggtaattgggcatggaagaccacactgcttcatacgagatacagttaagtaatcaataaagctccacatgctatttgtatttaatccaggaacatcaccatctttaaataaatgaactgcccaatctttttcttggcggttaacttccatgaaaatatcaactgcttcttgttcacactcttgagcaattttaacccattcatcgccatcagtgccaagttgaagttgacgaataatatattgggtgcctttaaggtgaagctgctcatcacgtgcaatgaacttcataatcttggcattaccttccatgatttccatgttcttatggaagttaaaggtacatgcaaaagatacataaaaacgaatagcttccaatgcgttgattacatgcaaacagaggtaaagagatttcattagctcacgcttccaatatgtctcatgctcaatagcatcttcaataacgtcttcgtctgcattaatttctttttggtattcgatatcagctttagcgttttcccaataacgagttttaatcagaacatcatcataataacgtccaatagattcagcacgtttcataatagcttcatctaatacaatttcatcaaataccttcgatggatcagtataaagatttcgcatgatatgagtatatgaacgactgtgaatagtttcactaaaagtccatgtagcaacccatgtatcaaggcttgggtctgaaatcaatgacataagtacagcagacggtgcacgaccctgaatgctatctagaagtgattgatacttcagattattagtaaaaatattctgctgatattgaggaagcttattaaactgtgcagcatccatcattaagtttacttcttcaggacgccagaaaaatgataattgcttttcggtcaaatcttcaaaaactttatggcgttgaatatcataacgcgcaataccaagacctgaaccaaaaaacataggttcttttaaaacatcaactggatttgtattaaaaactgtgctcataaattttccgcttagttaatagttggtgactcgtccgtgagtcaaattatatcataatttacaggatgaacaatcttcagcttttggagtttctatttcataatcatcagtaccagaaccatcacgggtattatgataatagaaattttttccgccaaaataccaaaaatacaaaaggtcatcaatcattattgacattggaacctttccttttggaaaaatctgcgggtcatagtatgtattcgctgaagctgattgacatacccatttcagcataatagctacttgcgtaagataaggtttattacctttcttagctaatttccatgtataatcatataggtctatgttatgttcaatattgggcacgacttgattaaaggaaccctcttttgattctttaacagagactggtccacgtggaggctcgataccgtttgtactgttagaaacttgggaagatgactcacatggcataagtgctgatagtgtgctattacggatgccaaagagcttaaggtcttcccgcagcgacgaccagtcacaaacgtattttggagctgcgatttggtcaatctttttattgtaccagtcgataggtaattcgcctcgagaccaacgagtgtctgaataatattcgcaaggtcctttttctttggcgagcttaatggatgctttaatgagtccatactgtaatctctcaaatagttcatgtgttaaatcgttagcatcttcataagaagcaaagttacttgccagccaagctgcatagttggtaacacctacaccgaggttacgacgctttttagctttttctgcttcaggaactggatatccttggtaatccaaaagattatcaagagcacgaacttgaacttctgccaattcattaattttatcttggtcttgccagtcaaaattatctagtacgaatgcagagagagtacacaatccaatttcagcatcaggactattcacatcatttgttggaatagcaatttcacagcacaagttactctgacgaataggtgccttttcacgaataaacggagtatagttattcgtattatcaatgaactgtacataaattcttgctgttcctgaacgttcagtcatgagcaattcaaatagttcacgggctttaatacgctttttacgaatattagggtctttttctgctgcttcgtataattcacggaaacggtcttggtctttaaaataagaataataaagctctccacccatttcatgcggactgaacaaagtaatgtaatcgttctttccgaatcgttccatcatcaaatcattcagttgaacaccataatccatatgacgaatgcggttttcttctacgcctttgttatttttcaaaacgagaagattttcaacttccaaatgccaaataggataataagcagtagcagcgccgccacgaattccaccctgtgaacatgatttaactgcagtctgaaaatgtttccaaaaaggaataacaccagtatggcgtacttcacccatgccaatcttagaaccttcggcacgaatcataccaacgttaataccaattccagcgcgtttagagatatattcaacaatcgaagcggaagccttattgatagacttcagcgaatcacctgcctcaataacaacacatgaactaaactgtcgagtcggagtacgacaaccagccataataggagttggtaatgaaatctgtcgagtagatactgcttcataaaaacgaataacatgttttaatctatcaacaggttcatcttgatgcaatgccattccaatagtcataaatgcaaactgcggagtttcataaatttgaccagtggttttatctttaacgagatatttttcttttaattgcatcgccccggaataagtaaattccatatcccgctcgtgcttaatttttgattctaaaaatgtaatttcttctgctgaatattttgacaacaattcagggtcatatttaccttcatttacacagtaagaaatatggtcaataaatgaacgcggttcatactgcccataaacatgcttacgaagagcgaacattagacaacgtgcagctacatattgataatcaggctcttcaaccgaaatagaattcgcagcggccttaatgacaatagtctgaatatcatcagttgtcattccatcacggagataagatttaatattttcatataattcataaggatctactgatgttccctcagctgcccaagataaaactttaataattttttgtgggtcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttgtatttattcactacccgacatagacggcccgcgcggtgataattcggcatattgtttttccgttaaaacagtaatatcgtagtaacagtcagaagaagttttaactgtggaaattttattatcaaaatactcacgagtcattttatgagtataatattttttgccataaatgataataggctgatttggtcctggaacttctagctcacttggattaggaagtgtaaaaagaactacaccagaagtatctttaaatcgtaaaatcatattgccattttccctttaattgctggatgcgattcataattttcaaggataaaatctttcggtttcatgtattcagttaaccagtaaagctgtgtttcggtgtcacaatttccaaactctataggccaatcaattttaagttcacatagttctttaggctcacgacgtaaaatttctttacattgctcagtatgattcatatagatgtgagtattaccaccagaaaatatcaaatctcctgggataagattacacatcttagccacaatatgcgtcaaggcagcgtacgaggcaatgttgaatggcaatcccaagaaaacatctacacttctttggtaccattgtaaatcaagataaccattacgcacattaaactgatagaacatatgacagggcggtaatgccatttgattgatttcagctggattccatgctgaaacgatttgacgtcgatcagttggtaattttttaatacgatcaatagtttcaactaattgatccacgccgccgaaatcacgccattgtttaccgtatataggaccaagttcaccactatgatatcctaggtctttagcctggttttcatagttatcgtcccaaatagttttaccttgaataagactaccatgtgtgcgaagacgtaaatcattaacattggtagaaccggaaataaaccatagaagctcagcaatgcatgcattccatgcaagcttcttagttgttaccgcaggaaaacctttagttaaatcccaacgtaatttagtaccgaacaaagcaattgttcctgtgcctgttcggtcatcggtttcatagccattttcaaaaatgtctttaattaaatcttggtattgtttcatttagtaccttatataaattataatacattttatgaagctaaataatcaatacggtttagcatcaaattttctctcaatttcaggcgtgaaatataattctttaccgcgtttggaaaagcgaccaataatatgataattattctcatcaaacgtgatattaccaatatccatagctttcaaccaaatatcgatatttctatccagctttatgtcaaaattccaatacagagaactattaccgaaaatactgcaagcggattcagtgaaacaactgctataaatcttgtctttaggaactactaattgatagacacctttaataaactgaggaccctgccactttggctgtttcgtgtctttttctaatagaatagggtaataattaaaattcatattttccgccacgtgttatttcatttatatactgattctgtaagggttgttacttcatctattttataccaatgcgtttcaaccatttcacgcttgcttatatcatcaagaaaacttgcatctaattgaaccgttgaattaacacgatgccttttaacgatgcgagaaacaactacttcatccgcataaggtaatgcagcatataacagagcgggtccgccaattacactgatgcgattttcgctggaatcgataaacgtttcaaaagttgtattaggactagataattggatacgtccaccggctactaaggtaacatactcatcccaggtaatataaaaatgagccaaatcaccgtctttagttacaggataatcacgcgcaaggtcacacactacaatatgactacgacctggaagtaatgtaggcaatgactggaacgttttagcacccataatcataattgtaccttcggtacgagctttaaaattctggaggtcctttttaactcgtccccatggtaaaccatcacctaaaccgaatgctaattcattaaagccttcgactgttttagttggagaataagcgaatactaatttaatcattacgcaaaacccctttcaataaaccattcagtggctttatcagcatcaaagaataattcttcgtaagtcttttctttgttttcaaagactgtcacacaaacacgttgacagtctccgcagtattcttctgacatactcaaagcgtcagaaaacatttcattaaactcatttaaatcaggattatgcaatgcgttaaaaattgcataatcgaattcgtcattcataaattcaaaaacaaaaatcatattattttccttaaacagactttttcacaattttccaatcagctttaaactgatcgacgtcagagtgataaatccaaaatcctgcgctttcaccgtcttcataaagcggacacccatcacattcatcttcccatcccatgccacgtaaaaggtgttcagctttttcaacaagttcagaatctttaccgatgatattaaaataccatttacctctaacttctgaatctttgatgctctggcgttgtaatctcattttattctccttagcaagctttaatcaaaagatataaacagaccaacataactgctgccataatataaggtgcgaacattttcttttctccattagttttgatagggtaatagtatcacactactacccttctgtaaactactttttgaaagtttttcgcaaaagttcaatgatttcatctacattgttttcgtcaacaatgcagtgaatttttgttacgccagaaactttgtctttgacttcatcttcttcagaagtcggttctttatactcacgaaaacaatgaaattcgtcttcacaaacgttaaagtaaaaatgctttccatttgcgcattcaatgtgttttattactctaaatccatcaacaaagaaagcttctttaacttcaaaccatccgccattttcttgaataattttaactattgctgaattagaacgtgggcgataattaataaatgtatcaataagtcttggaacaagttcatactttttaccgatatacattatgttttcctcattttaacggggctgtaatagccccttgataattattgttcaatcaatcccatgtaaaattctgcgtcttcagaatccataccatcacaatattcattagccataaagcgggtgaggtcttcaagaggaccttcaataacgatttgaatactccaaaacttagaatcttgcacgcttgtgatactaagttcaggataacgattacgaataatttcttcgatatattcaaaatcaacgatgtcaatatcaactttagccatattattttcctctttaatcatcagcagtattgccgatagttgtatagtaccatggaaggacaaggatgtaaaccgttttgtgaaaaaatttttgaaataaaaaaaggggaccctagaggtccccaattaattagtaatataatctattaaaggtcattcaaaaggtcatctaggtccgtgtcatcagcactagatgaactgccagagcttgagctcataaaatcatcttcagtttttgtattgaagtcatcaacattgaatgcatccaaatcatcagcaactttatcagctttcttagcagcagttgcagcggcaccgcccatcacagcagttcccataacttgaccgaatttagtgctcagttcttcaaacgatttgaatttatctttagaagtcatttcagaaaggtcaaccatttgttcgaacagttctttctggaaagattcatcgtcaatgtttggaatcgcagattgattcaggaatttagattcgtcgtagttactaaatccagaaacctgtttaactttcagtacaaagttagcaccttcccacggacaagttacatcaaccggagtttcacccatttcaacatcaaccgcaatcatcgcgttgattttatcccagattttcttaccgaaacgatatttaaatactttaccttcattttctggagcagctgggtcttttacaacaagaatattagcccagtaagaagttttacgtttaacaagaccatactctttattgtcagtgttgtacagatcatttttactgatgtattgacatactgggcaagaatcgtaatcaccgtgggtagatgaacagttttcaatataccatttaccatttttcttgaaaccgtgatttacaagaattgcgaatggtgcttgttcatcatttttagacggaagaaaacgaattactgcttgaccgttacccgcattatcgagtttcagtttccactcgcctttatcttcagaagaaaaaccacctttatttccagccagtttagccatttgtgcagcgagttcagcagtagatttacgtttaaacattttatttcctttttaatttaattaacagttggtgctatgacgatgtatgacctcatagctggtcagtgagataattataatctatttataataagcaattaatacttgcaggatttcacagtttcaataaaaacttttttagcttcctgtgaatcaatatttaaaatttttctataagcctttaactttatagaataattattccagactaaattatcagtctgttcatcatgtttatcaattatatttaaaaacgaatcaagcaagataaacgtttcaaacgaaattatgttcgactgaagcagtttaaaaatataacttgattgaacttttggattatattcaaagatttctttaaaagcagaaacttcaacttttttactaaaataataaatgttgcgaatatcttcttcaaacttaaatttaatttgctttaagcgtccgatatattcacgataaaacacaagtgcatcagcgtcagagatgtcgccaatccaagcatcttggttagcaaccaaattacttataaagattaaagcaagttcctttaatttatatttttctgataacttctggaaaaaatacttatcccttcgcttttgataagcggcatcagacacccgcatgcaccaattatacttaataacatcatactttccattcatatgttgttttatcattaagtataatttataaactgatttaccatcaatgtatctttcaccaccagcaggcatgcggagtttaatcatagcagaaaatctaatgtattagttttttcacaacgaacaacagaaggacgtaaaagattttcgtcaatggcttctgactgaattttttcaattatacccgaaggaataaatttagcaaattgagtttcaggaatagagttttcttccaagaatgctgtcgtagcttcaagataactcattccaaattcttctaccattttttcaataataaatccattttcttggcggtcaagaagctttgcaatttcatccttttctttcttaattgaaagttctttttctgaaagaccggtctcatcgaccgggcgaatatcatttagagaaaactgtgtcataaagttcaactacctcttcagtttcagcttcaaacacatcacggttatctttatgatacaaagctaatagacgattaaacatcttaccatcaacgccaagttcatctttagcacgaattcgaatatctttaatcagttcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatattcagattctgtgagaagcaccttagcttgctcacggtcattagcaatagcttcaacgattgaagttttcattgaaggggttcgttcaccttcaactctggtaaaccaaaagtcagatcgtactttaactgaagcaacgttatcctttttgtcgcctttaaggattttagtcatacagtcaatttcagcagaaccgcttttaattttaacccatttcttatgcatcggtgaccattgcttaacatttggatatttgtgaagctgtgtaaagtcaccgtccgatgaaatgattaaaatcttatgtccttctaaagagaactttttaacaagaacagcaatgtggtcatctgcttcatacttatcaatatccataacaatgtatggcatataagctttcaattcatctataactttatgactggattcaaaataaccttcccagtcccaagtagattcttctcgtgcttttccacggtttttcttgtaatagtaagcaaaatcacgacgccagtatccagatttcgcgttatcaatacacagcacaattttagtgtatccaagcgtttttgcttttttgacattaaacttaattgagttcaatatcaaatgacgaaccatcgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttgggcagcaacggataatattccaaaacctgctggaaattttaatagaattcgttggaaagcattacgtactgatgctgtatatacaactgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaagtacgttcagttttaatgactcatccaaagtcacagatgatattcatttttaataatcgtttgtggcaaatgtatgttgctgattatagcagagaagctgcgattgttactccatcgactgcgtatcaagcacaatctaatgattttatcgtacgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaaggccgtacatcgattgacggtttcttgatgtttgacgataatgagaaattgtggagattgtttgacggggatagtaaagcacgtttacgcattataacaactaattcaaatattcgtccaaatgaagaagtcatggtatttggcgcgaataatggaacaacccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaacggtgaaactaattatgttccagttttacaacttgcttatatagaagattctgatggaaaatactgggttgtacagcaaaacgttccaactgtagaaagagtagactctttaaatgcttctactagagcaagattaggcgtaattgctttagctacacaagctcaagcaaatgctgatttagaaaattctccgcaaaaagaattggcaattactccagaaacgttagctaatcgtactgctactgaaactcgcagaggtattgcaagaatagcaactactgctcaagtaaatcagaacaccacattctcttttgcagatgaccttatcatcactcctaaaaagctgaatgaaagaactgctacagaaactcgtagaggtgtcgctgaaattgctacgcagcaggaaactaatacaggtactgatgatactacaatcatcactcctaaaaagcttcaagctcgtcaaggttctgaatcattatctggtattgtaacttttgtatctaccgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagccaagaaggatgggcaaatgcggttgtaacaccagaaacgttacataaaaagacatcaactgatggaagaattggtttaattgaaattgctacgcaaagcgaagttaatacaggaactgattatactcgcgcagtcactcctaaaactttaaatgaccgtagagcaactgaaagtttaagtggtatagctgaaattgctacgcaagttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttaataactcctaaaaagcttttaggtactaaatctaccgaatcgcaagaaggtgttattaaagttgcaactcagtctgaaactgtgactggaacgtcagcaaatactgctgtatctccaaaaaatttaaaatggattgtgcagagtgaaccaacttgggcagcaactactctgataagagggtttgttaaaacttcttctggttcattaacgtttgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgggtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattaacggaaattatggtttcattgttcgcaatgatggatcagtaacgaattttatgcttactgcatcgggtgatcagactggtggatttaatggattacgtcctttagctattaataatgcatctggccaagtaacgattggtgaaagcttaatcattgccaaaggtgctactataaattcaggcggtttgactgttaactcgagaattcgttctcagggcactaaaacatctgatttatacacccgcgctccaacatctgatactgtaggattctggtcaattgatattaacgattcagccacttataaccagttcccgggttattttaaaatggttgaaaaaactaatgaagtgactgggcttccatacttagaacgtggcgaagaagttaaatctcctggtacattgactcagtttggtaacacacttgattcgctttaccaagattggattacttatccaacgaccccagaagcacgtaccactcgctggacgcgtacatggcagaaaactaaaaattcttggtcaagttttgttcaggtatttgatggaggtaaccctcctcaaccttcggatataggagcaatcccatctgataatggaataataggtaatcttactattcgtgatttcttacgaattggtaatgttcgcattattcctgacccagtgaataaaactgttaaatttgaatgggttgaataagaggtattatggaaaaatttatggcagagtttggacaaggatacgtccaaacgccatttttatcggaaagtaattcagtaagatacaaaataagcatagcgggttcttgcccgctttctactgcggggccatatgttaaatttcaggataatcccgttggaaatcaaacatttagtgcaggtcttcatttaagagtttttgacccttctacgggagcattagttgatagcaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtatcatatgctgctttttatacttcttctaaaagagctattgcattagagcatgttaaactaagtaatagaaaaagcacagatgattatcaaactattttagatgttgtatttgatagtttagaagacgtcggagcgacaggatttccaaaaagaacttatgaaagtgtagagcaattcatgtcagcagttggtggaactaataacgaaattgcgcgattgccaacttcagctgctataagtaaactttctgactataatttaattcccggtgatgttctttatcttaaagcacagttatatgctgatgctgatttacttgatcttggaactacaaacatatccattcgtttttatgatgcatcaaatggatatatttcctcgacccaagctgagtttactgggcaagctgggtcttgggaattaaaagaagactatgtagttgttccagaaaacgccgtaggatttacgatatatgcacaaagaactgctcaagcaggtcaaggcggcatgagaaatttaagtttttctgaagtatcaagaaatggcggcatttcaaaacctgccgaatttggcgtcaacggtattcgcgttaattatgtctgtgaatcggcttcacctccagatataatggtacttcctacacaagcctcttctaaaactggcaaagtgtttggacaggaatttagagaagtttaaactgagggagccttcgggttccctttttctttataaataatattaaaataaaggggcatataatggctgatttaaaagtaggttcaactgtgggtggatctgtcatttggcatcaaggaaattttccattgaattcagccggtgacgatgtactctacaaatcatttaaaatatattcagaatataataaaccgcaggcagctgataacgatttcgtttctaaagctaatggtggtacttacgccggtccaattactattaattacggggtaaatagttatcttcaattaagtaataatgaaacccctatccgaattcgttctggtggcggcactggtaatactcttgtagttggcggctcttccggtggtattagttttagacctgcaggtagtgaaatcactactggacaaattactattacgccagaaggtttgacaacatttaccagggctgtaacggctccatcggtaactgttacatctactccttccgcagcatctgatgttactcgcaaagattatgttgatggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaattaaggattctgttcaagatttcggctattattaagaggacttatggctactttaaaacaaatacaatttaaaagaagcaaaactgcaggtcaacgtcctgctgcttcagtattagccgaaggtgaattggctataaacttaaaagataaaacaattttcacaaaagatgactcaggtagtgttatagaattaggtttaaaatatggaggaactataaatgggtctttagaggttacagaaaatataactggaactttaattggaaattctagcacagctactaaattgcaaacacctaggaaaattaatggtatatcttttgatgggtcaaaggacattaccttaactccatctgacataaatgtcaatagcacaacatttataaaaaataatggcgaattacctactgatgctaatttagatacgtatgggcccattgaagaatatcttggcgtttggtcgaaatctacttcaacaaatgcgcaaccagcaaataaattcccagaagaaaatgccgtaggtgtactagaagtgtttgtggccggccaatttgctggcactcagcgttatactgtaagatctggtaacgtctatattcgttccttatctgctaaatggaatggcgtcgatggtccatggggtgtgtggcgtaatgttcaagcgtcaactcgtccactttcacaaacgattgaccttgatagcttgggagaattagaacattgtggcttatggcgaaacagttcaagcgcaatcgcatcatttgatcgccattatccagaagaaggatcagccgcacaaggatttttagaaatatttgaaggtggtttatacacgagaactcagcgttatactacccgcatgggtatggtttatactcgttgtctcgctgctgcatgggatgctagtgcacctaagtgggaggaatggaagcaggttggtcatggcacaccagcgactttctatgatggagatctgaatgattttaaaactcccgggttatataatattttaggcactgatgccgttattaactgtcctacaggtgaaggtttgccgactgttattgttggtttgctggaagttaaacagcgtgcttctggcggtgctattttccaacgtttcactaccgcaggaacgggtgcaactactcgcgatcgtatttttgagcgtgcatatactggtggtgcgtggggtgcatggaacgaagtatatacatcttattctctgccaattactttgggtatgggtggtattaaagctcaattagcggagttagattggcaaacctttgattttgtccctggtagtatgtttagtgttcctttgaacaaaataaagaatatgccagcaaatatggattggggcacgattgatggaaacctggttatgttttctgtcggtcctagcgaacataccggaacgggtcgaactgttcaagtgtggcgcggtactgtatctcaggcgaactatcgttatttcgttgttcgtatcgctggtaatccaggaagtaggactaatacttgtcgtcgtgttgttcttgaagacggatcacacacttggactgctcaacaaaactttaggggattgctgaatatcactgctgctgttaatcttggtgctaatcagaaaatttcacttgctccaggagcatatattcaagcccctgctagcggttctggttctaatacttacgcaaatcagaatactaccattgcgccattatatcaggctattgacgattcaaataaaaaccagtttgcgccaattgttaaacagaaaaacactgtaacaaatattactatggcttctggtatggatattgctagttcagaatatcgtatcgttgctcagggtgatttatccgctactggaactacagccactaaattagctacatggcgtttcttgccgtctggccgattcatgtcacaaagccgagtttatgctggcgcagcattcttgaacactgatggtaacattgctggttcaatctggaagaaatacaacgatgcaaccaatttagatgctgccttgaatactcgcctaggtaaaggcggtgatacgatgacaggtcggttaacaatcaatgcacctaatgattctattgtattatcaacaactgctagtaattctttgcatattcgcggtgacatagacgggactggtaactggtatattggcaagggtggtgctgataattcgctagcattttatagctatgcttctcaggcggcagtacatatcacaaacactggtgagattgcgttaaacccgcaaaataccgcaatggttaacgttaaccgtgaccgtgtacacattaacggttctggatggattgctagacaaccgggtgattggggcaaccaatggcgagtagaagctccattattcgttgatcatggttatgttggtcaagatagttattatcctattcttaaagcaagaagcgttataaccaatcaaggatatagcaccgctgttgactttggtatgcgtcgtattccatcacagtgggggcaagcaatcattcgtgtcggatccacggaggcttctcctgatgctggacacccacaagctgtgtttgaattccatcatgatggattcttttatacaccaggaaatggtagctttagcgatgtgtatattcgttctgactcccgtctcaagattaataaagaagaattagaatatggagcagtcgaaaaagtttgccgactgaaagtttatatttacgataaagttaagtctattaaagaccgtagtgttattaaacgtgaagttggtattattgctcaggaccttgaaaaggaattaccggaagctgtatctaaagttgaagttgatggatctgatgttctgacaatttctaactctgctgtgaatgctcttttaattaaggctattcaggaaatgagtgaagaaattaaagaattgaaaacgcctctctttactaaaattgctcgcaaaattagtaaatattttaaattctaacaacaagggggaaatgccccctttggagtataaattatggcagtagttggtgttcctggttggattggaagttcagccgcaaatgaaacaggacagcgctggatgagtcaagcggctggtcaattaagattgggtgttccttgctggatgagtcaatttgcaggtcgctcacgagaaattattcatactgtaggagcaaaccacaattttaatggtcagtggttccgtgatagatgctttgaagctggcggtgcacctattgtattcaatattgttggtgatatcgtttcttattctaaagatgttcctttattcttcatgtacggagatacaccaaatgaatatgttcagttaaatatacatggcgtaacgatgtatggtcgtggaggtaatggcggtagcaatagtcctggctcagctggaggtcattgtattcaaaacgatattggtgggagactaagaattaataatggcggagctattgcaggcggtggcggcggtggcggcggcggatattattctcctttttcacaaatgagattgacctttggtggtggtggcggtcgtccttttggtgcgccaggaggatctattgatatgcaatcaggcgcgactggcggtactatttctgcacctggctcaggatccgtgaatggtatctataatggtggaaacggtggtgaagtaggttccgcgggaggtagatgcaatattcgcggtcaaggatctgaatataatggcggcgctgctggttatgctgtcatagggtccgctccaacatggcaaaatgttggagcaatatatggtccaagagtataatgtgaataaatacccttaaaaggagggtctatggcagcacctagaatatcattttcgccctctgatattctgtttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatacagttcatttaaatggacgtcattattattccgactcaaaatttgcttttttaccaactaaaaagcctactcccgaaataaactacatgtacagttgtccatattttaatttggataatatctatgctggaacaataaccatgtactggtatagaaatgatcatataagtaatgaccgccttgaatcaatatgtgctcaggcggccagaatattaggaagggctaaataattatttgttcgtatacatctctagatatcgatatacaccctcaaaaccctcgttgaattcgtcgatgagggttttcttatcttcttgagttaattcagaaacaattttacggaatgaattctgatttaactttctaccttcatgcgttactccaatctcattcagaaatgcaataaaattagcgcgattctcaacaatatcttctctggaaaatttaatcaaaatagacgcaacagtaataatttcacgaactgtatcaatatttttattcattaactataccactcaattagttgactttgttataatatcatcagacgtttgatttgtaaactggtctgtgttattttcttcaaaaattttttctacgaattccttgaacgactcacgttcctgagctacattatgctcgattaccatttcaagattataactcattcgaaataatcttcaatttcataatcatggacataaatcattatagtttttaatacatcatcaatactttttcctggagctggaattacgtaaaaatatcctgcttttgagaggtctttataagttccaatcaagaaatcattattctcaagatgtagttcttcaactaattcattaacaattgagtggtataaatttggtagaaacttatatagcttttctagaatatcaattttgattgtatattgaaccacagattgagaatcaataatcatagaccttccccttatgtttctgtttgcgattagattctttaaacgctttcttcttatctttatggacagaagctttattaaaattatgttttgcgactaaattgttcataatgctgaattacctctcttaaacatttgcatgtgaatgaaaactttttagctacaccacattcaaatatatgttctcttaaatcacgtgtatcagtatatcccatctcaacaataaaatgccgtattagatttttatctttatcattgagagaattaaaataatcagattttgaattaatttccctggccaaattgaatcaccttcagttgacgttttaattcttttatcatttcttcgttcatcgcaatataaagatcgcgtaaagcaggttttagcattccatttaccggaaaactaaatgggcatacataatcttttcctacgagctttttagtgaattccatatcacagaactgaaatgccggttcatttgtataaattccccaattagttgacatcattttattggcatattccaacgcctggatttgattcttaattccatcaatttgaaactttttaatattcattagtaaaggtcctcagagtaaagttctttttcactaccaccacgttcaatacgcacttgtccagcgtaagttgcaataatcattgcttcttcacgtgtccagtaattgctatactggtcaataaatccttggtcttcaccacaaacatggtctgatacaagtttatcacttacctggtcaagaacttcagccatatctttagaataatgacgagcaccaggaataaccagagtcccaccatcttttaacttaaagcggttggctgcacacacaattcgacgttgatatttttcattattgttccaatgagctacttgccaacagatttcaggaacctcttctaaaacatcctcttccgtatattcggtgtagtcgccataggcctgtaatttagctgctagactttctggagtttcacgtaataaagccaggtctaataattcaagacgctctttgaaggttttcatttggtttcctcaacacttttaatttttatagcttgtttagaactttcaaagcattgacaatatactcttaccgcatcaaactggttggccgctttaagatggactacaccttcgccgttataaaattctacgacaattttaaatgttttcatttaaaccatcctttaatacgttgccataaagttttctgttgagctttgttaacaccaattgagcgaataactggttgagattcatggaattctttataatcagcaaggtaaatttcgtaagctgaatccataaaggaacttatagctgccatgaaattattgcgaatacctactggagcatctttactttcacgaataatcatgtatttgccagtcttaatctttacgatagttccaagataagctccatggtaccagatgtcccaaccctcttgagtaggttctacacaacgacgaagttcattgacaatttctaacttgttcattatttattcctcacagttcagatgctacagtgattacagcttcaatgttttctgccgaacgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactgcggtaagtttcaacctttttaagaacaaatccattttcatctaaaagttttaacatgaagtctttatcttcttccatatcagaagtaatttcgcgagctttacgagttgctcgttttttcagcagttccggagcgttttcctgtgcgtataaagttgctgcatttgaaataatatcctgagcttcaccagtaatgattaatccatcaccagatttctccaccaggccttttttaatcaataccccaatattactattaactactgcattgcctaaatctggatgcacctcacgaacttctgcagctgtaatgaaatctttcttagcaatggtaattaaaatcgcagcagttttttcattcagaatatcgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcattttttgtatctccgggttgtttgtttcagttcatttatttgatagttgtatagtaccacagtatgctttggttgtaaaccgttttgtgaaaaaatttttgaaataaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagcttcttcagcaagtttctttgcttcgtcggaagtcatatgaaaaatgttcattccaactagtttatcaacataagaagaatacatatcaattttagaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacattatcgtaaacttgcagctttcctttctcattaatgacggtaatattctgggaacgacgctcaatcaacccgaagtctttcataatttttgcatggcgttcttcttcattatcgctcaaagagtattcttttcggaatttaactttgaagccaaagccatgctcaccacaagcatcatcccatgtaatgaagcctttatcttcaagcgggtctaagattttactcacataagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgcagtacagctttcttgacagaagaaacactatgaggaagaatgtaagttgcataaccagttgcaataccggaaacgccattaagaagaacagtaggaataataggcaaatagaaagcaggcggaatgtgttctttatcttgatgtactggagcatattcagtatctttatatacgttatagaaatttttacttacacgagcaaaaatataacgacttgctgctgccttttggacagtacgagaaccaaagtttccttgaccgtctaacagaggaaagttattattccaagtgttagccatcaaagcacctgcgtcttgcgcagagttttcaccatgatgatatccaaggtccgctacaccgcctgcgatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcacgattattcagttgcataaatttaccatactagtgaatgtagtgccataataacatcagaaatgaaaagcacgacttgaattaatccgaacattattccgtaatataatgctatcaataaaatagcaagggctaatgaatagcccaagattttcttaatcattagtagataacaacacaaatgttaaatatgcacacataccctgagctaaagcttgcgaaaacacactgctgacatcaatacagatagttaaaacacatgctactatccaacaaataaatgaaataactcctaataattttgcaatattcatattttcctcactggcgtccgaagacgcctttagttttaaaattattacgatagaactgcatcacatgttcgttgtggaaattactcattaatatgcctgcaaaacgaatttaaagttatcagccaacatacggttcatttcttcaagtgtttgatactcagaatgatgattacgaataaacgccaaagctaactgaccttttccaaatcccgtagtcagaggtttcatcttagaagcaggcagataaaatactgtgtatggaacattgttatttgcaatagtacgcgcaagctgagaccgacgttgacgaatatgacttagaaccgcactaaatccttgcttagaacgctgattacctacataaaatcgtgcagacacacatggattactaaatggacgaccatctaatttacttactaaaaagtaaaatccaggtttagataaaatatctttatgtggaactcccaaaaaccattcaccgttcttgattgtaccaataacggtagcgcctgcattattcagatcagtaacagtcatgtatttcatattaatttcctctaaattattttctactccaaggccgcatgaatacacacggccattaaattaatcgtcgcagtcgacgctcaattcccaaaactcttctacggtataagtttcagtatcattttcaatacagaaacgttcattactattgtttgctaaagtagcgttaactgtcggtttctcgctagtgctcttaagaggtgaaatacgaattaactgatcaccgttatctaaacagaaaatttcaccaacttttacatctttaaagattttcataattcacctcaaggagtataaaatccaaacgcagttgttgaccatcccatccaatatggaaaatttgcgccaatgtaaaacataagaatataaaaccaaccgctcagcaaattcatcattttacaccgttccaaattgtttcaactacggattttaaaccattttgatgaatatcaattccgactactgtcatcaaatagattccaactacaactgaacctaaagcaaaaatcagcatgaaaatgaataaagccggaaaaatattatcgaaaaaccattcaataaatgtaaaagcactgcgtttacgcttcatattttcctcacataaatccaaagtaagcgtttaatacatcaatcattaaaacgattgggaatatactcaaaactattagtattataactacattccatatagctttaacaatctttttcattttctgttcctccgtagttgatagggtaataataccacggaagaacagtcttgtaaacaacttttttaaaaatattcgtaataaatgtgaataccaactactactgctgaaacttgcgcaacccaccacgcacaagcaataagcacagaattcaaaattttcataataacctcatcacaaaagtaaatgttaaacaaattaatggaatactaattaaccaaacgaaacaccaccataatgaactcatagttcaatctcaacgatttccaagtgtttttgttttattgcctttttaacacaatcatggactaaatatgaccatgaatcattatattctccattaactaatcgttggagatcttcacgtgatgataagtaaggttgatctgattcccattttgataaaaatactgcagtaaaaatatctccttcatctgtagttgaagtcgtaaatgcaataaattcaccggtaattttatgtttagcgtaataaaatttaaatttcatttttactcctccgtagctgatagttgtatagtaccacagtccttgtggtatgtaaaccgttttgtgaaaatttttaaatggaaagataccatccattgtagttgctttttcttacaaccttacgaaggtcttctctgtcaccgatgaacttcggagtgtactggatgacacctggatgaatttctttagtgttgaatataattatacagtcagcaacttgatgatttagaatgggccctagatttattccagaaccatatggatactctccgctgcatcctgttgttaccgaaatccaacgtgagtcagtttgatgtgtcttaacttctacacgaagcccgcagtattttggatgcgccagtacatcccatgcgtatgtatacgggtcattaacatcctcttggcctttgttaacataccctcttagccaatctgccacaaaaaactctgcgtacacagcgatacgacatctttcgataacttctgctttatcctggttcgggttttgttttaaagagtatcttgcagtatcagcaattttgaccttcatttcactagtcaagtcactgttcgatagggtaaatgacggaatctgaaatagtctctgcaaacccggattcgttttctgcatttaaactttcctttatgtcggaatcataatttcccttaaaacaaaagggccgaagcccttattttatttgaattgtgcaattcttttttctaaacaatctgcgtaagatttcattgagataaactgcgaaagtagcaattcttgctcaactgcactaaccgttagaaactttgtgctttctaaaaaattgctaagtgcattaattttgagcattaattgatcgtattcttcttttactcgtgcttgataacctaacataattttccttagttaagggccgaagcccttatttaaattgttcagtaacgtcttcaactacttcgtattggcaggtacgcattttagcatcgttgtaatcaatcggaattgatactacatcacgcggatgtactttaacttttacgactcggctggttgaactgccaaagtgacgaatataagatttagaacatacatgcaaaccgcgggaacaagtttgcgtatcatcgtcattcacacgagtacgcggcattttaactactttaccaggactgttatcaaaagtgtttgagtgacaatcaaagtaattgctacgaactactttccaagcatagaagtaaccatcttctgtaatttcaatatcgtttgctaccaagaaatcaaagagtcgagataccgctttctggcttgggttttccagcagattttccaagaacggaaaataaaattcaaagttttcgcctttttccatcgaatcaagaatacgatcaaccaaaccagaccgcaattcaatattttgatagaataagcttccaccttcaattcgaacatcgccggaaatatatttttcaacagcgcgacgaacattaattttttgtgccgcttcttccaacttatccgctacaagcagattaagaatttcctggaagtttgaatgagtattaggagttgcgttataagttacaccgtcaacagtaattgaaatgaattttttagatgcattccaaataatgccagatttagcaactggagcaataactgcatcgctattaactttaactgtaatgtcaccgctaatagtaactttagagcgttctgcttcttcagcatttttcaaaacacgacggattgtgtcaaccgatacaccttgccaatcagccaattcctgctgggtgtaattaccacttgaatacagtttaacaatttcagcttgttcgtttttggtcaggcatttaatattgtacat

SEQ ID NO: 25 - DNA, 152140 bp, synthetic construct; identical to SEQ ID NO: 9
  source 1..152140: mol_type = other DNA

SEQ ID NO: 26 - DNA, 57891 bp, synthetic construct
  source 1..57891: mol_type = other DNA
gcactcgcaacgcctctcgaagcgtgagggaaggcgcaggggcgcaggcgtggccacggctggcgggggtctttaggaagggcagggggtagcttttccgagggcgggcggggcgcgcgactgtccatctcacacagtttttgggaaaagcgacattataggccttccgatttattttttgctaaaaatcctctataaggcgtcccgacacacttcccgacaagctttccgaggccattccgacaatctatccgataagcattccatcaatagacgtccgaaagctttaaagctacctttcctgatacctcttccttagtatcctttaagaatagattccacaaatagagagggcgccgcttgtcggcagccctagaggcttcgcctctttctagtggagtattcacacaagcgtttattaagttgtaggaagcttattcaagccgttgcaaggccgttggaagaggcaatcttccgaagcatttccttaatgcgttctaacatactgttcaacacccctttcttatcgtttcttatagtataccataaaaaagaggccgtgtcaaggcctcctgaaggtttattttagccatagatggattctctaaccatctcgaaaaggtaaattaggacagtcactgccacagacactgctgcaacacctttccaaaagtttagggcagcatatgttggagccttcttatggactatcttaagtcttgttaccctgtgttgctcaaagcccctatagtatcttaggttaagctcctcagaaactatttccttagcttggtcaaaggcatcctcttcgtcttctgcaatgccttcccactcataaggcactccacaatacttcatcttaacaacgtaataaccatcttctaaaaatccattcatatcctttacctccgcttttaatataccttattatagcataaaaaagacgccttgtcaaggcgcctctaacattatttctctaagtcttgcttagctttattgtactcttaatgaagcatatcccagattagtttaaggagaattaagtttgttaaaatccgtccaatagcaattgtaacttctcctccaaatactgctgtaatggctacaataagcccaaatgcaatcaccaatgctaataaataagagaatgatactagtctaaaagctttccaattcatattaaagttcctccaatgtcttatgtttatccttgttatagcgactataggcgtacttagtagtttcccaaagtaggtctatcacgaatagaatcccaagatagaagaaaagctgttcccaaccagttattaatgatactagccaaagtataccgaagattattccaatagttatcagataagctatgataacggctgccaatataacgcgtttagtaagtttatcagacaatataatttccaactcctttaacaagctttctgcaaagcttaactttgactaatttactatagcgtgttgaatatatctccacaggtgtctctgaataagtttcaataatcacgtctttaggctttttacgtgtaaccatttcaataagaccttctgaaagtgttaaaatacctccataattaggtataaagtaggcgtagactctatttaatagttgttgaggtgactcgcatacttggcatctagtggaagaccatttttcttcaaaccaatactcatactcaggctcttctttaatgcgtggggaatactcttccttaatctcttgcaagtaattctcaagcatttcctgaatctctttagtatcaactttaatagtagctgttggttgaggctttctaggaattgcttcttgaagctttctatactctcttttaaggctgttgtaatcctcttgaaggcgtcccatttcctgttcccaacgcttgttttgctcctcttctactgaaagcttttgacaaacctcttcaaatttcttaccaagtctatcataagcctcttgtctaagcaatctctcttcagcggactcgttagccatttcaatagcctctacttccttatcagaagcatatttaagacgctctttgtagccagcttctttaagctttaaggcgtctacctctctttgaagctcttcgttagccatctctaacctatctaaggccagttggtagacagcttttctgccagtcaataattcaatctcttgtttaagctctttaataagcttgttttcgtccttcttaaataacatcttatcaatcctttcctaatactccactagtatagcataaaagaggcctgttgtcaagcctctcctaacactttttaaccatctaaccaaaaatcttccatacggcagaatccataaccgttctcatgagcgtaaatgccctcatgatagaggtcacaaagctcttggataacccctttaggtaccccatacttagtggaagctttctccattcgtgtaacctcttctaaaacctctccagtagcatcgtcaaagactaggatgcgcttattgttgtcgtagtagtgtttaaggttatcctcatgtgttaaccattccaagttatctaggttgttattaagcttattgccatccatatggtttacagtaagctcttcccaaccttctattggattgtaagtggaaagcaatacccgatggagtcttttcttattcccatcgcctagtccaatttccgcatatcccttatcatttataaaaggctttagaatcttaccagttaggttattaacgaccttaccagtctttgttatggagtagttaggaaacccattaacaaccttccactcaccctccaaatactttttgatgggctttttagaagctagtggagaacctttctcaaactctcttccagtataactccacacatgccctgcatacaccttatttttagcacaggcgttgcggacacttgttgaatccttccctaaatccttagcagctgcatgagcgcttctgtaaactgtctctaaacctgtctcaacgtctactgatttaacctcttttataagcttcactaaaaaccctcctaagtcctcttctataggcatattgtagcacctttcaggtgccttgtcaatatcctttatgttacatttgtgttacaaacattaaatttactttacagttataaaatattccatcaaatagtgagactaatttaaagcatgtgggaaatactgtcgtattagttaagagttagttagcgaagctactaacgagcggtctccagcgagttagtaattacttgacctttcctaaaagcttcctgaaacgttctcctaagccttcctaaagctttgagacgtctaggttacaggtcggggatggagtcagttgttaattactttaaggacgagtttgtagaaagcttattaaatcgtatggcctcacctaatgcaaagtgccagcagcgacctttagtaagcttcctagagactcgttttaatgtgtaataagaaaagccttcaggatagcttcccgaaggccttatttatgctttatttataggcttccataattccagcaacgaagtgccattcgtcccagccttcagtacgcttttgaatagcttctaaaaggcggaagaactcactttttggaatcatgtctgaaggattagccaaaggaatttcatcttctatgataatgtcttccacaaagtctctgatagaggagattccgtcaaggaaaccttcatcccaaccttttccgaatgctgaattatcagcgttatcggttgtatttaattcctcttcggtcttttcaatgtgatttaacactacttctgcatcgataagcttcataaaatcactccattaccttttggaatagcttggatagcgcctttcaacaaggcttgaatcgaagaggtatcaaagaagtcctcagaagcctctaggagagcttctaaaacgtctttggtataattgtgaggcaaggtgttaataggcgttacagagcttcctgtaaaggattctgctacaatgtttccatcaatagctaatttaataggctctggtgcagcctcttccttagctaccgataaagctgctttaatttcgtccatacaagtttctacagcgtcctgataaccctcatcgtaatcatcttctgggtattccaatttgtttttcatagtggttaataaagcttctccatcgattagtttcattaagcttcctccttaacagtttcaataaaggccttcaaacgaggtgggtggaatccactaatagctgtgtcgaagtcttcgtccaacatcaccactggaaagcttcggaaacccgctaatctaagcatctccacagtctctgtatcattgcggacgtccacaaacacttcatcaaagcttactccgccttctgtaagcactcgtttagccatcttgcaggcttggcacatgtctttagtatatactttaatacggttcattcccattcctccatgctttcaataatctcttcaagctcttctacacgttctgaaagcgtgtcaacttcttctgtaagctctgccacagtttcttcaaggctatatacttcgtcttgcaagtcagagttctccgattcaaggtcttctacgtcttgttcaaggctataaatctcctcgttcaagtcttcgttttcccatacaacactagtaaggcgctcttctgcatactctaattcctgttcagcaatcagcttatcccaattggaatccaccaaggcattttgaagctttcctacaagctcaattaaagctgtttcatgttgcgttaatgtaggctttgcacaagcctcttttaattctttctcaaaaggtaggttactcatactaaaactatccaatctcgttttgtttaaactcttcaacaggaattgctaatggtgcatagtgaggtgaagtcttcttaatttcatctagcgtcattgaacctttttcaattacttcatatggcgattgagtaactgctatactagctgtaagagtagtcaagtaagtatatccacaaggcgtaccacttccacgcccactaggaaggactagtacatactttttctctgcttcgttagccatgatttgtaaagagtccgcaaggtctcgtgccgctctaggggtaagggtcattgaagcacatatagtagaaagatatatctcaccatgctccttactgacaattaattcaatatctggttgaaaggctcgtttgactgtaagtgactgcattatactttctcctcccacttcttatcttccttagccaagtatcgcttagcatcggtaaacagttctgaaagtacatctaaagaattagtaaggttatcgatggcttcagtaacttcatctacagcagcctcgaactcagattcggtgacgtcagaaacctttgcaccaagcattcctgtcaggttgtagacagtcgtttcgacatttgcttggtctccttctaaatacccattctctaaaaagttatagtaataatctaattcaatgccttccactattccttacctccagactccaactcttcagtaatcttctgctgctttctaatggttcctaagtattccgtaagctgcttttcgtcttcctctgcttcgtcagaaacgatattctcaataagctcatggtactcttgaaccttttgggaaagcttttcaatatcttctgcatactggttagcgattaattcatgagccttctttgaaaagctattattaagctcgaagtctgcggccgcttttcgtactgtaccaagcttctctaaatactgctgataactcttgatggagtacatcttaattgccctcatctgtattcctccttaaatgcctgtgtaaggcgttctaatgtgttcagggataattaccctagaagctactcaaaagctctcagagagcttcctgtggcttttaaggtatgctttagcgcctgtttgtcttttacataaataactataacacggttgcattaaaatgtcaagcactttttcataataaattaaaaatgtgacaaaaagagctagataaggtctaatctaagaggctcttaaatgagcttgaataaatactccagaaaggaggaagcacttatggtaagaattggaaacagagagttggaagaacgtcaacgcaagtatttaactacttctaaggagccagacgaatacgagggagttgacttaactacattaaaacctaaaatgaaacgctttgcgagacattatatgcaaactatgaatatcgctgaaagctgccgttccgtaggctataatgaaagctcaggttatcgtgtgttaaaacgtgaggatgtgaaagcttatttacaatggcttgtttcagagaatgctgacgcagctattatgagtccaacacaggtattagaagagctaactaatatcgctttacgaaacagctctgattacacggttactgtaaaaggagatgtcgtagagaaacctattgatacaagcgttcaattaagcgcactaaatagcttggctaaattccatgacttattagcccctgatgtcaaggtagaacagtctcttaatatcgtggtagacattgctgacgacgttccaaatgaagctgaagaggttgaggaagaagagtttgtagaaggagactttaccgaagttgaagaagaggatagtgacgtaagttatgacttcctttctggattttaaggaaggagataccaatgccatttgaagagggtaacttagaggttatcgtcaacgaccttattaaagacgttaacactcatgccaaccagattgcttctattcagtcagacttaaacagaatgacaacagacatttcaagcgttcgtgacttgcttatcaaaaacactgagcgttcggacgttctaatcggccacatcaaaggccagtctgacgaaatgcttaaactacttactgaggagcgccgtagacaaacggaaagctacctagctgacgaagcttcagaccgcaagaataaagagtttagtcaaaagcagatgtgggctgtggccactgctcttgtcacaggagtagggtcagctttagtgaccattgttaagctaatcatgagctaattgaaaggaggtgcattaatggacgtagtaatttctatcgcagttgttttaggtggcgttaccacaggcttagttaacttagttaagtctatggatgtagtctctcctaaatacttaccactagtttctctagctatcggaatggtgtttgggttagctatgtcaccacttcttggaatcacattatacgtaggtgctattagcggacttgtagcagggctttccgcaatgggattctacgagttgacaaagactccagcagaataaccttcacatggccttgagggagtttccttgaggcctttacataattttaaggaggacacacaatggctgaaccaataaaattaaccataaccaaaagaacatttaacgaagcctatttaccttacatgtacgaccagcctgaaggacagcatcggacaatggtattctatggaggcgctgggtcaggtaagtctaagttcgtagtacagaacgctattctaaaaggcttatcagaacgccgtaagttccttgttcttcggaaggttgacaacactatccgtgactccatcttccaagagttcttagtctgcttagaggaatggaaccttctcgacttctgtgaggttaaggcttcgtatatgacaatcaagctgcctaataaaacagagttcatcttcaaaggattagaagaccccgagcgaatcaagtctatccaaggtcttacagacatcattatggaggaagcaactgagtttacccgagaggattacgaccaacttcaaacacgtttacggcatcctacagcacggcatcaacaagtgtttgtaatgtataaccctgcctctaaagacaactgggtttaccaatacttccacaaccctgccactaagcgtcctaaaggctctaaggtaatctgtacaacatacaaggataatagattccttcctaaagcttacctagaccatttacaagacttgaagaacactaacccagtctattacgaaatctatgccttaggtaagttcgcaagcttaggtaaacgcatttacacaaactggaagatagactctgagttcaagcctaaccaactagttaaacaaggctatgagcctcgctttggactcgactttgggtttactaacgaccctaccgtaatcctttccacattagtatctgaagcagaccatgtaatttatatatttgatgagtttgttaaaactggtatgatagctcctgagatattcgatgtgattaaacgtaagaagcttaccaaccagcttatctatgctgactctgctaaccttgaaaccatcgagcagattaaacgcttaggggcacgcaagattaagcctgttaagaaaggccgtaacacagtccttcatggaatccaatatctacaaggctatacaatctacgttcatcctcgctgtgttcacacgattaaagagcttgagaactatgagtggaaacctgctaaaggctctgacgactacgagaacaagcctaagcaaaacggctttgaccactgtatggatgccttacgatatgctgtcaacgacctcattccacgtaacagaataagaaccattaacaagtcagtactaggcctataagacgtctagtatctgtcttgggtacaagtatcagcgaaaaatataaggaggattctatatggcaatcccaaacggacaaattaacgctggtgatataatcactactaacatccgacgtaaacatttcattagacgcaactacgatattcgagaattagtaacccttgctgaaatgcactctcgttcttcaagcgcctatggagtattgtacgactattacaaaggcaatcacattgctatccaatcacgtactttcgacgacactaacaaacctaactctaaaatcgttcataacttccctaaactattggtagacacttccacagcttacttggctggtgaaccaattacggaatcaggcgatgagaaaactatcaaagccatgcaaccagttatgaaagagaactatgtaacagacgttaactcagaggaaattaagctctcaggaatcttcggacactgtttcgaaatccattggattgaccgtaacaacaagcatcgcttcaaagctgtttctccaatgaactgtttaattgcttactcagcagaccttgacgaagagccattagcagccatctattacaatactgttatcagtgatattacaggacacgtaattagaacttatgagatttacactgaggataagattcttaaattctctaccgacgacgagagagacgtctacaaagagattccagaagtgttggacattagaggttatgaagaacatcctaacctacttaaaaagttccctgtattagaaatcattgctaacgaagaacgcttaggtgactttgaagctcaactatctttaatcgatgcttacaacctagctgtttctgacagcgttaatgatattgcttattggaatgacgcttacttgtggctacaaggatttgaccttagcgcagacagcgattcaattagcaacatgaagaatgacagagtaattgtaacagacgatactggtaatgtcaagttcattacgaaagatgttaacgacaagcatatcgagaacattaagaaccgtgctaagctagacatcttcagcctatcacaaacacctgacttggtttctaaagacttcaccgcagcttcaggacaagctttgaaagcagctacacaaccgcttgagaataaatcagctgttaaagaatctaagttccgcaaagtattagctaagcgttatgaacttatctgtagctaccttgagttaatgagtaaagagaaagacttgaaaccaaatgaagtaacacctgtctttgtacgcaacttaccacaatcttatgcagagttagctgacatggctgttaaacttcgtgacatgcttcctgacgaaactatcattaatcagttcccatggattactgacgctcgactagaagtagagaaagcggatgaacaacgtcagaaacgagctgacatcgccttgcagaacttcaaacagactagtgctgtacagggagcctcaacggcagctgctaataagctagataagaaccctgctaacacatctactatcacaactactgacccagtggctgcgaaggaacaagagaaagctatccaaaagaaacctaagactgactaggaggaataacaatggcacgcaagaaggataaagagaaacgtcaacaggaaattgaagacgccttagttgctctcatgatcgctcagaaccacaagtaccatagattcactgaccgcttcactgtccttcttgatggctttgttaatgagcttatagtaaacctagctgaccctaagttggatgcttttgcaatccttcaggtgagtcagtatgaggctatcagaaagcttcaagcagcattgatagactatcaagaagagttcagggagatgcttttagagagcatgtcagacaccttagaagagaccttgggacagctttttacaaataaggctataccttcagcgacagataatgcctacatcgaacaagttattgcagaggcttacgactactttgaagaaatcttcttgcaattattagtagagattgaggccatcgctgttggaactattccatcaacagaggacatcgtaaccactatccaaaagcttcgagatagattgtcctatacactacgtcgacacattgaagctcaaatgtcggcagtaattaacctcgctgttatcgaagcttctaaacagcatgagattgaattatggaaatggtgcatccgtccagagcttactgaaagcggtacttgtgcagattgccgagagcttgctgaaggaggtattggtaatgagggtctatataccctagccaccatgcctttgctacctagacatccacactgtgtttgcatcctaattccatacgtcttatagagcggtaatgttaaagggcgctcaagaggaaaagaactttacacaaactaatctaaacgcacgcacagggcttaattgaactgtggagggcagaaggagaatcttatattatgaatccagaagaacaaggacaaggacaacaagttgatttgacaccagaggttatcgttggagctattgaatctaatccagaattagcacaagctatccaacctcacgtcttaacgaaagacgcagtatctagtttcttaaagacagacgaaggtcttggcgtagtagcccctatgattgaccaaagcgtttctaaaggcattaacgcttggaaagaaaagaacttagagaatatcgttcaagagcgattggctgagttaaaccctgctgaaacacctgagcaaaagcaattaaaacaaatgcaagctcaaatggcagctattcaaaaagataagcaaatgttggaaatgcgtggagtagctcaagaagctttagcaaaagctggtttgcctgcctcattagctgggtacgttttatcagacaatcccgaagccgttaagcacaaggtttcagaattagatattgaaatccagaatatcgtttcaggactagttgaccagaaggttgctggaatcgcagctaaagcagctccaacaaactcagacgacatgtcaaacattggcggttctaaaactgtagaacggttaacagatttaactgttgaagaagcgacagaacttgctcgaactaaccctgctaaatatcgccagttggttcaacgtggataacaacagataatcatataaactataaactattagaggagactattaaatatggcacacgaagtaactaaaatttcagacttaattaatcccgaggtaattggtgcgttccttcaccagaaaatgttagacaacttagtattggctccatttgcagaaattgaccgtacattacaaggacgtccgggtgacactttaacagtaccacaatggaacttcattggattagcggaagacttagctgaaggtgcagaattacaatcagttaaattaactgctgctgaacgtacagcgactgttaaaaaagttgctaaatcagttacattaactgatgaagctgttttaaatgcttatgttcgtcctgttgatgaaacagttcgtcaattagcaatggctatcgcaggtaaaattgacaacgacttgtttgcagctatgcgtgcattaactccgtcagatgttgaaatgactgatagctacgagtgggttattgatgctcaagtagcatttggcgaagagtttgatgaagaaacttacttattcatctcacctaaacgccgtgcaacaattttgaaatctaaagacttcattcacattcaacaaggcgtgtctgtaatcaaaggccacttaggtgaaatctacggaatgaacattgtagtttctaacaaggttggtgaagacgaagcgttcgtattaaaacgtggagctttatcattaattatgaaacgtgactacatggttgaagaagtgcgtgaaggtatgaaacgtcaaactaacatcactgctgaccaacactacgtagcattcgttaaagatgctaaacgtgcaatcttcatcaacaaggtagctgcgggaaagtaggaggaggtaaatatatatgtcaggtggtgatggtcgtggtcacaactcaggtgctcacaacacaggtggtaacatcaacggtggtccaacaggtttaggtggtaacggtggtgcttcagatggttcaggttggtcatcagaaaacaacccatggggtggtggttcaggttcaggtgttcactggggtggtggttccggtcacggtaacggtggtggtaactcaaactcaggtggtggttcaaactcatcagttgctgctccaatggctttcggtttcccagctttagctgctccaggtgctggtacattaggtatctcagtttcaggtgaagctttatcagctgctatcgctgatatcttcgctgctttaaaaggtccattcaaattctcagcttggggtatcgctttatacggtatcttaccatcagaaatcgctaaagatgatccaaacatgatgtcaaaaatcgttacatcattaccagctgaaacagttacaaacgttcaagtttcaacattaccattagatcaagctacagtttcagttacaaaacgtgttacagatgttgttaaagatacacgtcaacacatcgctgttgttgctggtgttccaatgtcagttccagttgttaacgctaaaccaacacgtacaccaggtgttttccacgcttcattcccaggtgttccatcattaacagtttcaacagttaaaggtttaccagtttcaacaacattaccacgtggtatcacagaagataaaggtcgtacagctgttccagctggtttcacattcggtggtggttcacacgaagctgttatccgtttcccaaaagaatcaggtcaaaaaccagtttacgtttcagttacagatgttttaacaccagctcaagttaaacaacgtcaagatgaagaaaaacgtttacaacaagaatggaacgatgctcacccagttgaagttgctgaacgtaactacgaacaagctcgtgctgaattaaaccaagctaacaaagatgttgctcgtaaccaagaacgtcaagctaaagctgttcaagtttacaactcacgtaaatcagaattagatgctgctaacaaaacattagctgatgctaaagctgaaatcaaacaattcgaacgtttcgctcgtgaaccaatggctgctggtcaccgtatgtggcaaatggctggtttaaaagctcaacgtgctcaaacagatgttaacaacaaaaaagctgctttcgatgctgctgctaaagaaaaatcagatgctgatgttgctttatcatcagctttagaacgtcgtaaacaaaaagaaaacaaagaaaaagatgctaaagctaaattagataaagaatcaaaacgtaacaaaccaggtaaagctacaggtaaaggtaaaccagttaacaacaaatggttaaacaacgctggtaaagatttaggttcaccagttccagatcgtatcgctaacaaattacgtgataaagaattcaaatcattcgatgatttccgtaaaaaattctgggaagaagtttcaaaagatccagaattatcaaaacaattctcacgtaacaacaacgatcgtatgaaagttggtaaagctccaaaaacacgtacacaagatgtatcaggtaaacgtacatcattcgaattacaccacgaaaaaccaatctcacaaaacggtggtgtttacgatatggataacatctcagttgttacaccaaaacgtcacatcgatatccaccgtggtaaataacagcccccaagaatcttcaatctagcggggttactgaggactcagttactctgacttgggaagacggaggggcaagcctctagtaagctaaacgagaggttgcggaaacgttccgtgacctcttttactttatcataaatcaggaggaaaagcaatggcaaagacttataatatttaccaagatggagcgaaggttcaggaaggcattgcagagttaactaaaaccattacaggccttacgccaaacacttcatacaagtttgaggtaacagctgttgaggacggcgtggagagtgctaagtccacagcggtaacagccaaaacaaacccgcgtaaagtagctacagtaacagcttctcaaaagactatgtctctagcttctgacggaagcaaagcattgactttcacagtggctccagaagatgctactaacaaagaattagaaatcactaacagcaaccctgagtttgctacttatgcagacggtacagtaacagctgttgcagaaggcactacaactatcacagcaactgctaaagatggttcaggcgctactgcaaactgtgttgtaactgttcaggcaccagcttaataaactatcccaaggaggctgaggcgaatcgccttggtcttcttttaaggaggaagctaaatggaactaattgagaacacggagttgttcaagtcgtttgaagacgttaccctaccacctgaaacagaagctattgacatcaccgacttaaagcttatgcttggctatggtaacagcactatccgagacaacgttctgaaggttttgaagaagcgtgctagacaacatatatgcttattcattaacaaggaagttacagcctttccgatggagttggattacattgctgacgagcttaccgcagggcgtatgtcacagcttaactcagaaggccttaaaacagagtctactgacatcactcgttacgactataaagatgacatctacgcaaactggtatgccattcttaaccgctggctaaaacagcaaggagagtatcgcaacaaggcattattcatgctttaagaaaggagcttacaaatgcgttataacgacattgtggatttaatccaatttaatgattgggacgaccctgacgacgactacggaacaatctcttataagactcgtggaacaatcgttgttaaagaccttcctgtaagtgtaggctccctacgagttcaaggaaagctattgcaaaaccaagaccaacagtgggagaaacgctacttgatacagcataaagtattcgagttaaagaaccttcgggtagacgctgtccgacgccactccacaggagagattctaaatgtctattgggataacactactggaacagaccagacagtttcttataaggttgagtacagagacatccgaagagacaaggaggacggagttatatggcagggttcttagaaataactaaacgaatcgatttcgcaggcttagagagagagtttgttaatgaggtgaaaggcgttgttgaaaagaactccgcacagatggctacagctgttagatttaatatcgttcgtagaggcaacgtagacacaggaacttactacgatggaataaagtctaagacggaagtagaagggaagggtaaaagcgttacaggaattgtagagtcagacgtttcaggaaacccttatggacacagaggttacgctgtttacctagaggaaggaacttaccgacatcaagcattccctaactttacagacgctttagaagagtattctgatattcttgtcgagcagcttagcagaatcaaagtgtaggaggaattatcaatgagcaatagaccacctttccgtgcaagaagttcctctgtagctttgcaaagggctatcgtaaaggaaattagagcgcaaggaatcaatgtctgggacggtactaataagtttccagaatatccattcattaagattggtgaggagctaacttcaggtagaacaatctctaaggatgctatcgggaagatgcacaacctaacccttcacatatggagtgactacgacagctcttttgaagttaagagtctaaccgactttcttgtagacttacttaccaactctcctcttaacttagaggacggcttctgtattggagagaaatccctcgaccacgttcgttacacagaagctgcaaacggaacttataaaaacgagcgtgcatatctattcttagacttcgaggtaatcgactctacgatagagccataataacacacataaaggagactgacaaatggaagcatgtaaatctagctacattcgtggtacagcagtattaattgaggttcagaatgaccttggcgaatggattaaagtagcagcacaacgaggaggtacattaaaccgtacagcagcaaccttagacgtatctaacaaagaaggattcggatgggacgatgcagaagcaggtaacaagtcttggtcaattgactgtgacggattgttcgtagaggataacgctggtttccaagcattgaacgcagcttgggttaacggagattgtgtacgtgttcgtgttaaattccctagtggattaacttatgtaggacaagcaatcttaactgacttcccttacgagtttggttacgaagatgccgtgacttactcattaacattccaaggtaaaggcgctttagaagagcaacaagtagctcctacaatcttacctaagaaagttgagttcacgaacgaaactaaggaagttaaagttggagaaactcttcaagctacaattaaattcactcctgaaaatgtttctgacaaatcagtaacttacactgccttgactccagctttagcaacaattgatgaatctggtttaatcacaggcgttaaagaaggtactgcatcattcaacgttcgctcaaatgtcaacacagctgtttcagcattgattgatattgaggtaaagcccgcggggtagtagaagccccgaccgagctttcggcaagtagcgttagcgaagactcagtaacattaacttggaaatagactgcacagagggggcttgggataaattcccttgccctctttttacataacaaatataaaggagattacaacatgattataagattccaaggcaaagaccttaacctacgcttaacatacaagtctattcactttctggagttagcctttgaccaagactacgcttctttcatcgctgagcaaacgcctttcaaccagtccttatatatcttctgggcaatgcttcagaacgagtctgattacgaaggagtatccgtactagatgtagcagagcttctacaagactctctggatagctatgagtttaccttagaagaatacttcgagaaagttaacagctcgtatgcttcaagtattttagttaaacagctattcaaaaacaacacaagctcattacccagaggaggcggaagacgaggacgagcttccgaagctagacgtaagatactttatggtattgtgtacagacttaggaataccttccagcgacttttggacaagtacaccatatgagtttaatggaatgttacgaggagcttaccaaagacaatcaagagaagcttcgttattcctttctctagtgcaatctaagaagcctgtcaaattagagaagtaccaaggctttgaattagttaacgaaaccaacaaacctaagactactagagacatggcggaaacaatggatgaacttgatagagcagcctttaaagaggaagagctatctaacctgttcgactactttgactaggaggaaatttaaatggcagataaggaaatgcgaattaaggttagggtagacaactctgactacacaagtaaaatgaaagatatggagggcactcaatcacgcttagggaaaagcactgagcagactacaggaatcttcggtaagttcttcaacaagttaactggtggtgcgagcttagctaacagctctatgctaggacttggtaaaagctttctatcaaccagtgttggattcggtactctgacagctgctgctacacctatggccgctgctgttatgggagccgctgaagctactaaagttgcaggacgctttgcgatggattccatcaaggactatgctaactttgaaggaacacttaaacaagtacagattattgcaggtggtactcaagccgacatggacatgctcggtgacacagctatcgaaattggtggtaagacttctaaaggtgctcaagaagttgctgaggccatggtggactttgctaagctaggttttacagctaaggaaacttcagaggccatgaaaggtatcgtatacgctgccgaagcttctggctcaggtgtacaagagactgctggaatcgtagcaacagcgcttaacgtatggaatctggaagcctctaaggcagaacacgttgccgacgttttagctaagaccgctaacgaaacggctgctgacatgcaggacatgggatacgttctacaatacgctggttcatcagcttccctagcaggagcttctctggaagacctttcagctatggcaggtatcatggccgacaatggtattaaaggttctaaagctggtacatcacttcgtacagcattcacaaaccttatcaatccaacagacggtgcggccgctgcgatggaaagcttaggggtacagtttaaagatgctgaaggtaaggctcgtcctacaatggatgttatctatgacttacaagatgctgttaaaggtatggatgatattcaaatccaagagctttcaacaatcctgttcggaaagcccggggcggctggtatgtcgttcgtccttaaatctactaaagagcaagtacaagacttatcaaaagcattagtagactctacaggtacagctgctaaacaggctgctgctatgcgtgagactatggcaggtcaattagaccaactaggagactctgtggacgccatcaaattaaaaattggtagagcgtttaccgacatgtttgcactagacgctgttaaaggattcaacaaggctcttgatggagttgatgaaggcttatcaaactttggtaaaggcttcaagcgtacaagcgatttactagaaacttctaatggattaatctctggtactaaggatgccaacaagtttgttgaagctgttcgagatgcaggtactaatcttacaaacattcctttccaagagtctttagcacagtctcaagtatggggaatcggaatctctaaaagagcttatgaaactaacgaggttatgtatcagcttaacaaaagcattcaagagttcagcttcctaccagatgactgggaaggcaagtggggacaggcttcaacaatccttaaagactcagtaggtcaaatggagttgaaacttgcttcagcagcggctaaaggtaagcatggtggagaagccgatatttcaggtattatgaaccagactatccaagagaatctacctgccttgcaagaagctttaaatgagcaagtagcagttttcgggacagctaaccaaagccgtttagatgccttgcagacattcttcactaacgagaagactttaactgacgagcagaaatctattatgatgcaaggtgaactaactcacggccaacagctttccgataccattcaaacaaataacaacaagattttagaattgtatcaaagcatgggtcaacaggattatgcacagcgtcaagagactggtgccgctataaatgcattgcaacaacagaactctgaaatcctgcaaaacatcgctacaactgagtcaagtagtattattgaaacactgaaagcacaggctagtagcactggaacaatcactcaacaaatggccaatgattctattacagccgctaatcaacaatattctgaaactgtagcagcagcctctaaacagtatgttgaaactgttagttcaattaaccatatgtcagatgaatctatagctgccgctggaacaactagggacgagcttatcgaaaaagcacgccaacaaatggttggaacagtagaccatgctaagactcagaaagagcagacagtagaagaaatcgagaagattgctaaaaagtctgaggaagttgatgggacacacattcaaataaacgctgacgcagatacttctaacgcaatggaagagctcggacaattagctgctagaattaacgacgtgtttagagcctttggagaaactgcgggtaagattcaaggcggtattgatggctttgaaagcaagcttagacaagcggataaatgggttgcaggaaaggttggcggaatcttcaaggctcgtggaggacttacttcaggcgttggttacggaattggtggaggcaatgcacaatactctccaatggctaccgcagtaggtgtcggaacccagctaggacagggcggtattaatcagggcgtaatccataacgaacgaggaagagaagttacaatgcctattcaaaacgctacttacatgagacctttcgcagcagctgtggcaaacgagctgcaagcaatgggtgaaggacttggtggaggaagcattcctgaagttatcgtgccattgtacatcaacgataaagagtttgcgagagctactaacaaagctatgacagaggaacagcaacgtgttaaacggattgctaaccgagctgtcggtaaaaagtaaaggagacgtttaaatgacctgttctaataaacctaattatacaccttttaaattacaaggtctagcccccactaagcagtggggattaggccgttctgcaagttatgaacgatttaacccaagcgagttccatgcgctagaggacgaagttaagattacatttccagtagactttagaggaaaggttaaaggaagcaatacacctaacccttcacgaggatttagccacgctagtcaaatctatcgtgagaacgtgttaagaggtagccaattcctttctaagccttctttgctttttaatggagctgtatacaatgagaagacagtctacaatggagctatggttgcttctactcaagaagttaatcaaggcttgatgttctattgggaagactttatcaatcctgacccaagaattaaagaaggggatatggtaaccttctcagttgatgtacgaagcactggggaagatattccgacaggggctgtggccttcaaagggacttctaactttgaggaatactataaagtccttgaacagcctatcacaaaagagtttacaagagtatcttttactacacgattcttgtctaaggactgggaatgggacgaggcttttggaatgttctggggagtagagaatgttcctgttacagactatccaatgttccaatatgacaaggataagttagttggttttattcaggctcaagaaagtgttcaactagagttctcacggcctatggtttcaactatcggaaagactgcttacattgagtctggggacgacatgttctctaacaacaaatgggactggtctaaagccgtatctaaaggccgtttaaatgaatttgatggtaagtataacacaaacggaatcaaacaagactgggcaatgcctgagttcattcctattttcaaaggctctgagagaatccacttctacaaaaagactaccttaacggaaacaactgacgctggacatggctatggtaaaatcctattctacagcgctgctaacgaggattcttacatgaacgtatataagaagttccctcacgaggctggtgtatatggtggatacgcagctgaagtagaagtgcctatcggagctactcactaccgtgttcatataacttcagaaagaggaaaggccactacagaagcctatgtacaatcttctgctaacgactggtcagagtttagtcaagagtggtacgacggactgtcaggaaagctagatggaaagactgccagagctgagacattctatcgtaaagaaatggttgagatggagtttgagctacactttgcagaagctgtacagaaagctttaccagacatctttaaaggccttactactgacgctgagaagcagcaaagacttcgtgacattgcttatcaattcgattcaacaatgattgcacgaggccgtggccaaggcaataacttagctgattggattttctatagatgggctcctgacggctctattgaagagcagacaatgaaacagtttagaggtgagggattaacttcagttacccatccatcaagctatcaagagtggattaatccacaaggtaggattgtaacatctcttcgctctaaccgaatcattcctaactcaatgtacatgggaactgatacgctaagcggtaagtatgaccctaaattaacaacgcttcagctagaagttaatggggagcttgttgataagaaggctaccttagataagacctcagaggtatttacatttacaggtcttaaaggattcttaaagcctgaagataaagttaggattgctggatggattaatcgtaacaaccaatggtcaatcacctactctaatgttcttatgggaaacactcccgaaaacgttgctgagtttaacgaacgagctttcgtcgaagctgattacctagttacaaacatgtctattatcgtaactcaatcacagatggatgaatggggatttaaccctaatctaccagactaccgaattgaatcattagaacgtccagcaagtcgtactgaggagtatatgattaactcaatggtacaggtaacacatgcttatgacatctacggttttgttgaaagtaactaccctgagtttttcggtgactgttacacgttcgatgatagaataagaaagattaatgaacgcatcaagcagtttaacttagtggctactacttattcagaagagccttgggaagcaggtaatcctacaatcttcattagtgcggaagctaataatcccgacagagactacgatgttaaagcagagataaaccaaacagttgaactacaaattaacaattctaagggacactttatccatcctaatggttatatatacgtgggatttgcaagaatgcctagaagcgaccgtgagactggaatatccgttgactctgagttaagctttgagttcacgatggatagacagtacgacagccttccaagagtattccgctacaactaccagaaacagccttggttcttgtttgtaagaaacattaacagaagtgttcttgcgcctaaagtaaacactctaactcctattaacggaggcactagacgttataactttggagctacagaagacgctcggtatatctcaatggactgcttcatcaaagctcctgcggaagaggttatgcctaagttgatggaagagcttgctgacttcctagacgttggggaaacggtaatccaattctctgataacaaagaccgttattacaaggttatgttagatggctcgacagacctttctcaaacgcttcatgtaggaacgttgacgctgactttcgtactgcttgagaatacagccatcggtgaagaggttgtagaaagctttgacatagacagtacaactggttcagttccattcatcgagcttgagaacatgggtacggcggacgcttaccctacctaccaactgacctttgaagagcctgtaggatatgttgacctaatcggtacagatacctcagccaacgtgtcaattggaagacgtcctaaagatactgaagacgaggttaaggtagaccttcgtccacgtaagttttacagtaagtttacgtctacagatggagctggttggactgccatgaatgacacacagcttcctcaaatcgaaggataccaaactaagcttcagggaactgttcaaagagttaacggaatggccaatcaaaacaagtggaattacggagacactagccacagaggatggcacggagctggtatcgtagctaaccttcaaaagaaccttgacgacttctatatggaagcctctatcgtagctacaggaaagccagttaaaacttctgctaatgctattttcttgatattctatgacgaaaacaacaacccatatgcttacactaaggttggtacacggcctcaagagggtaacttagacagctacgtagcttacgcaggtgactggggtaaacgtaaagtagttaacaatggagctaagtggaaagacttctggggtaaggtttctgtacagcgcagagataaccgatggagacttattgtaggtaaatacaaagaccgtagatacagtccttcacctgaagcttcattcaactttggtcagaacatgttgaaagacacaagagacacaggatggttcgacttgcctcctgaaacttggggtaagaagtttgcaagggttgggatattcttcggacagtattcacatagacctaagctaggccacttatcagtacgtagactaattgtgtgggaaaaccttgaggagtatggagaaactcctttagaaggaactccaatcatgttccatgaaggtgacacagttgtaattgactcaagcaaagctcaaacataccttaacggagagcttactccatcacttgtagaccctatgaccgactggttcccaattaccaaaggtgataactacattggagtaaacaacttcaaaggcaagattgacatagtatataacgaacgatttaaataaggaggaaaaagtatgattacagtattaaacgcaaacggacaaacagtagcacactttgtcaacaacgttagcgaaggagtaccatactttgagcctactttgacggagaacatagagacgttggtatcaacgttctctttctctgttcctttagactgtgacgaaagccagtatttaaaaggcttgaataaagtattagtaaaggataaggacggagatttaagacagtttaacatcatccacactgaagaagttttccaagaggttaactcacgtatcttagtggaatgtgaagacttctcaattagtgagatgaacgatactgtaatctatcctttcaatgggcataatttaggagacaccttaacaaaagccgtaaagggtactggatggggagttgagtattcggcagacacttggcaagaaggagaagagcctttcatactagctgagtatacgaacatgcgagaagtgtttggaaacattcagaagacgtatgacgtagactttaaatttacagctgagagaacagccttcaaccaaactaaacggattgtcaaagtgtataaaaacagaggtcttcaaacaggccgttacttcacctatgacagagacgttctaggaatcactcgtgacgtgcagtatgatacaatcaaaacagccatcctcccttactacacaggagtcgatggaaaagtatggacgcttaaaggaatggttccagttaaccctatcgaaggcattaccaaagataaggaaagccctttggtagtccacaatcaagctcatgcagactatgacgaacctttcttcttcaaagcaatgcctttcaaagctgcatcaacaaaccctgagcaagtatatcgacaaggtgtagaagagcttttaaaacacattgcaccaatctatacttacactgttaatgtaatccttctaaatcgtgtccaaggatgggaaggggaaaccttagcacttggcgataccgtttggatgaaagagcgtgtaggctctcgtgaaattggattggaagcacgtgttattgaatacatttatcacgaagacgacccaagccttgatgaagtaacctttacaaacttccgtgaaatagacacttacgacacctctgacattgcaggtatccgagacgctttgaacgaccttaaagaccaagtaggctctaacacagttattattgaaagcactagagaacaaatcagtaagcttgaagaaggtcaggcaggaatcataacagaccttaaaggaaagaactccataagcattggagacacacctaagccaaatcctattgacggcgatacatggttctctacacgtgttaacgaagctggtcaaacaatccatgagattaaagtttgggatggtgttgagaaagtatggaagctttcaatggatactgagaaagcattccaagcagaggaagctgctcaagctgctaagaaagacgctgaggaatctcttgataaggctaaccaagctgtagctgatgctgacactgctaagacggctgctcaagaagctttagatagatacaataagcttatgataagcggacgtaaccttgcgctaaactctcaaaagattactattccagacacagatggagctactagcataaaccgtcgcaaaagcattccgttatcaattaaattaaagcctaatacacaatacttgctaaggtttaaatacgaactagaatcaggaactcttcctgaggatattacagtggtcttgtggcacggctctggatttgcctctaacatagtccatgttccaactaaagcaaataatgttggggaaggttcagcaacctttactacaaactctagcgaagctaatatattgtttatgtaccaaggtaaacgacttgaagttaagcaaggagataactttgattttacagaagtctaccttgtagaaggtgataagataggcgactggcaaccagctccagaagacgctattgcaagcattacaaacatcaatggtgaaatcacttccctagtaactaagacagatggattggaaacaagctatagccaaatctcacaaacggttgatgaaatccaattaacggttggtgacaaagccgataagagtcaaatcacacagcttcaagaccagattaacttacgtgttgagaaagacgatgtaatcaaccagattaacgtttctacagaaggcattatcattgatggtgcaaaggttcagataacaggtaagacttacattgaggacgctgttatcacagacgctatggtagctgacctttcagcaagtaagcttacagcaggagttatcgacgcctctaaaataaatgtaacgaatatcgatgccagcaacattaaagctggtactatccaaggtattgacataatcggttctaagattactaaccctttctcaattggttctgaaggctatacgctagtcggtcagacagtaatggaaagagctcaggttaaaatcgattataccgtatctgaaactggtcaaaaaggttggtcaatacttcatgcaagaggtattcaaaatcagctgcttaaccaagacggtaccattaactcattttcatctcttgcttcagacggattatctattcaagattctttaggaaatagaggttacttatcagccgagttgctaatgcagttctctaacactggcaagaagatttaccccggaaattcatgggtaactaacactgatagaattgtaccatcattgacaatgaacaaatgcgctattggatggctgttcttatggcaaccttacgatactactggcggtaagccttatacatgggactatacttactatttagttcctaaagctcatgctaactttaacaatggtaaaggtattaatatgcggctacaaggcgcaggtaaaggtggaggagcagatgatactgtgtataaatatgtatacgtatctaatgactctataacaggaacggccaataatggtactgggaatggagctagatgggttcttaccagtgtattttcagtttaaaggagggattattgtgagagtttggattgaggataagataggattcttaacaggctacactacagagcctatggaaggttacaagtgtgtggagattgacccttcagagtctttagaaatgcttggtggaatgcttgatttccacaactactactatgatggtgagaaagtatacagagacactaacaatgacttccagaagttcttagaagaggaagctaacaagcctcctgaaccttctaaggaagagatggcagaaagacttgctaagttagaagcacttttagcagacttgctataaagctttgggtgggttgtgggaataatattagaaaggagattcatacatggttaaagtaaacgatgtagtaagctatgtcaacggacttgtcggcaaaggtgtagacgctgacggatggtatggtactcaatgtatggacttgacagtagacgttatgcaacgcttcttcggatggcgtccgtatggtaatgcgattgccttggttgaccagcctattccagcaggcttccaaagaatccgtaccacaagctctacacaaatcaaagctggtgacgttatgatatggggcttaggatactatgctcaatatggtcacacagctatcgcaacggaggatggaagagctgacggaacctttgtcagtgtcgaccagaactggaataacccaagccttgaagtaggcagtccagcagctcctattcatcacaatatggatggtgtatggggctgcatcagacctccttacgaagctgaatcaaagcctaaaccacctgcaccaaaacctgataaaccaaatctaggacaatacaaaggagacgatgatattatgttcatctattacaagaagactaaatctaatactaccgaacagtggttcgtaatcggaggtaaacgtatctacttaccaacaatgacgtatgttaaagaggcgcaagatttaatcaagcgctatggtggaaacactaatgtaacaacctataactatgataactttggattggcaatgatggagaaagcttacccacaagttaagttataagcctataagaaaagccccttggaaggttactccaaagggctttttatattacaactcaaagcattctttaagcttttctaaagctactctataagctatcctcatgcctttacccatatctgactcctcgtcagcaaggtaatttaatctcctatccaagtctaagacaacctcggccaccttctccttgttaatggagtctacagcttgcttatgggaagcttctttaatagcatccacaatgatattgaaagggtctttcggtaagctgcttccaagggttatcttagaacagtcgtcagtatctcttagataaacttttggtacatctagctttatgaagttatcattacggtagtttaaaataggtcaacaacctcctctaaggtatattcagtctgtggagtggcttcgtcagcagccttctgttcagctttctctaaagctacactcatgaagcgttccatgtaaagtagtcgagcctgactgtaagaaagcgttgggtacctcatattgcttcggtagtctgcaacagccatctctaagaatatgcgcaaagcggtgtttccaaatctttccatatccttcttcataatagctcttagagtctgtagtgaagcattaataggagccttaccaaacttctgcttattaaggtgttctacataggctaggaatgtagttgtattccaaagactttcatcaactttccaccaatcctttgtatcaaccttgttcccctcggcgtctttataaagcttgttctctttggttctaatccatgccatcttaaatgccctcctcgtgctcgtctaaatacttccaaacgaatcccttatgcttacctcttcctttagtacagcatctactaatatgtgattgctggaatccatctgcacatgcgtctgaagccttattgtatactaccatttccccagttatctcattaaatcctacaacagctcttccctgtcgtttatacaaagttttcataataacctctcccttaactatttgatgaaccaatcatatcacgtattagatggaatgtcaatacctttttaacaactctcacgaaaaagtttcaaaggcgactgaaaggagtctttaggctgtgagggaactttccgaacgcctttatattatatgctatagctatccttaaaccataagaccttacggtctttaagttcaagagcagcttcgttaacactcagctacaacctcctaaagtcggttgtgaaactatttaataagcttctctttctctctctctaaagacaagtataacatattcctaaaaatgtgtcaagtgattttgcacaagaacttttgtggagttgttaattgtaaggttgttgaaacaattgtaacaaaactgtaataataaactttaacaaatgttcaaaaaggcttgacttatactttataatatgctatactaatgaagtagtaaagatgaataaagaacttattaggaggaaattaattatggctaaaggtttagaagcaattgcacaggcagcacaaacgcaatcaaaaggttctggtgagcaatccaaaaagacttaccttaaaaaaggacaaagcattcgtgcgcgcattccagaagacatcttagaaaacttacacgtaaaccaagtcgtttcagtttttgaaccgcaagtgttaccaacattatcataccatgcagaaggacgtacagacgttcgtgacttgtatcatgaagctactgaaatcatgttagcagaccaccgtgctaaagttgaatcaggggaaattgaacgtggttctcaagctgacaaagactcatataaagcagctcgtatcttaactccaaaaccacttatcttattcggtgtaattcctttggcagacttcacacaaggcactaagaaaactaatacttacccagctggtgagccaatcttattggaaactaacttaggccgtgacaacgctaatatcgacgccttaacgaacttcttatcaaaagaaactaacgctaagaaattccctaagaaagccttcgagattacttgtgaggcggctaatcgatacactttcacaccgttagatgatgaagacttaacgcctgaagaattagaagtattcaaagctacagaaggcgctacagtccctgaagaagatttcgagaacgcaatctttgaaagcactattgaacgccaaattgaagacttgaagaaaattggtttcgatacaactcgtttaccaaacttaccaacagctgctccagccgctaacaaaggcgctgacgaagttggtactgtagacccttcaggaatcgatttctaaaaactatacgaggggcttcggcctctctcctattatagggaggacataaagcatgaagaaagacacaccaaaagtgaatccaattaagtttaccgaagaggattacttccgcctgttacagacagtcgttatgacaaacacattcatcggctctctatcagctggcttccaaggtaaagaacgcttagagaagattactaaaatcgctgagaacatgtttgttcttaaccgcttgatggaatctgccgaaagcaacggcgaagactggggcgacgaaatgttgttagactcattatacacggattcagaagtgcttgtaactaagtataaacacttgctgtcagaagaccagttggagtctatcaataactctatcaaaaactttgcagaatcagccgagaaagctcgcaaagaagcctacgaagaaaaggttgcacaagccgaagtaattgactttgaaaaggccaagaagaaacgaggcaagtagccatggatagattagagttcttcacgaaagtaattgcaatgccttttgatatgcaagaggttcccatacatcctttagcaattaccttttcagacacattttaccaagacgactttccattaagtcagctttacgacgaggcaattgcagaaactttgtggaacgcttcttacaaaataatccataatgaaatggccaaggctaagtcggtaaaagtattaattacaatcttcaatccgaacaccttgatggaaggaacgcttgtatatgaagctattccagaagacttgcaagtagctattgacacaggagtcgtagaagacgttgagtgggaatctagtgagtcggtattccaacacgaccttcattacttctttaaaggatactaatggattactcaaagtttaagttaggcgatacagtaatgtatcagggacagctttgtggagcaggtactgttatcaacggcaatacctacactgttgtacagcttaccacaaagcctcgacacgcctttatcatagatgaacatggcaacaagaagcttatccaaatggggttcaacttcgctaaaataaaagaagcttaaaaagtgttcaaaaacgcttgacaaaagcttttaaatatgatatagtattatatgtaaggcggcactactacggtttgtcgtaacatagttcgggatgcttctcggctatagcggtctagggctacagattgctcccgcctgtgggctgctgtaaaaggcagtaaaaataatagcaggagtacccacccttgaggggatgagagggcgtagcagaggcggtgacgactgcctcgttcatgcgttgtaagtgtaatggctgcacaatggtctccaaaaccattagagagggttcgactccttcacaacgtgttcaaataagtcttatggaggtttgtggaatgactactgaaagtatgaaaagtgagaaagcttggaaccgtgccattgtgaaagctgagcaagaagctgctaagaagaagatggagcgccttgctaaaatgcgtgccaaaagtaaacgtaaataactccattaagtaggtaagatggatttcttatctgctattacataagggactaaccaactgcggaggagagttagctactttccaaggccttgccgaaatccctaaccagtcagttagcatagtttaggttaatgcgcaacagtcttcctatagcgcttgtcggaggctgattgagaaaggggttcgaatcccctactggcgccttacatattcccaataagcacttcggatagatgccagaagtgttccatggagggttggctaggggaacgctcaataatcccttgctgtaaagcttattccgtagcgtgctaaaacgactaggagcggagctacatgtgatttataggagggcagtagcagtcctcagctaaaactagctacactcgtgatggaaggcgaggtaagcgccttggccaaaacattacccatggtggagtaatccacttaggagagcgtcgtacgacaaggtgtccagccaccttataaaagggttgaacattaatgcacgctgttaaccaaggcctgtagggaggtcaccaacagcgcattagccaagaagtccagagtagctccctagtgaagtcttctgaagctggagttggctaccagcggccttatattcgggatacagaatgttgtcccctttggataagttctgtgaggcggttcgattccgtccataaggcattggctgtttatcagctcattccaaaaacctctttcataaagaatcacctcctttcgattagagcagcttaacggctgttctttttttgttaaaaaggccttgacaaagttttaaagctatgttatgattaattcatcaaagagatagaggagaggttttatgaacagtttaggaatatctaaggtaaactatgtgtgtagacactatggaggaacggttcttgaagacgaagttgtagagattgtcggagagtggactagcgctctaggagaccatattatggaagtattgccaatggattcagaatccagagatgaaacggttgttatcaaagcttataatatccatcgtatgaatccagaagaagtattgggttatcatttgaacaatcttgaatgtgacttattcgccaatgtagactatggaggagagcttttacagagtagtattcaaagctaatcaatatacttatggagaagatttaccagtatctcatttcacatcagtccgaatgcttagtaaggaggaatattaatggaaaccatgtacacagttatttataagaacgctgtagaaagtgagccagcgcttgagggaggaagcttcttaacggacactcctaaaacagatggattaaagcttatgattttcgggacaagagtatttgaagtggagtttattgaccatgcggagaagaaaatctacgcaactagaattagataaggagtggtaatatgtggaaccagtggacactttactggacggatagtgaaacatcagaggaaggtaacttcaagattcctcggccaaacgctttgtttattggaatgcctattgacattgatgagtacagatacactgtgacagctgtatcaacacctactaaagaggtttggacagaacgtattccattcgattttggccctaaaccaccttgggaacacaacaattaacttttaactggaggtttttaaatgcttgatgagacatggaagccaataaaatattatgaaggattgtatgaggttagtaatttaggtaatgtgagaagcttagatcgagctgttcctcattccaatggaatgtatttaagggcagttaaaggaacaactttgagtttatttgattcaggtagagggtatctaagcgtaagattaagcaaaaatggtaaaaagaggaataagttagtccataggttggttgcagaagcttttatagataatcctctaaacaaacctcaagttaatcacattaacgaagtgaggtgggataacaacgtgaataatttagaatggactacctctaaagaaaataacaaccatggttcaaggactttaaaagcctctaattccacaaaaaagaaaataaaagcaacctcaattgacggattagatgtaagagtatataatggagcaatagaggctgagcagctagatgggttttcttataagcaaatttcgctatgttgtacaggaagacataaaactcataaaggctttaggtgggaatttatataaaggggattttttaaatgcttgatttaatacatttatcaaaggatattaaaatacatgtagacatacaaagctttctaatggagtttgaatgggagcgggctaaatggacggaagaccgtttaatagcagcttcacctttcagggacgacaatcaccctagcttctttgttaattttaataatgactttgcaggaacttggggagactcagggagtggagagtcaggaaatttcatagagttagtttcaagattatatgaaacagattacgaaacagcttttgaaatgctaaaagaacggtactggactagaccttacgaagctcctgcaatatctgttaagctaggcgttaagaaagagaagtcaatctttgacatacctgtccataatccatctccatacctattaggaagaggaatctcagaggagacacagaagctttacagaacctctgaggacgagtataaagtatgtcttccatacattaacggaatgggattagcaacagctttaaaataccgtcggacagactctaaagacttcttctatgaggcaggtaacaatcatttgaaaagcatgttgtttggctatcacgcaatctatgaaaagcttcctaagactgttgttatatgcgaggctgagatagacgctatgacagcttatgatatgggattcgtgggtatttcactaggagctgctaaccttattgaaaaccaagtggaactcattaagaaagttggtctcgacaacatcatcataggcactgataatgacactaaaggaaacttagcggcagaagagattgaccaagccttttggaagactcataaactattccgatacgatatgcctgatggatacgacttaaatcagtattggcaagagtttaaaaaggctcctccaatccgtaagataagcgaacctaaactgcttagaagaaaactctggtgggtacagtaaaataaactttagaaagaggcttgacaaggcctcttttttatgctatcttaaaggagtagtaaggagatgttaaaatgaaattgaagaactataaaaaaccttggacacaagaggacatagattatttagaatggttctaccagaaccctgaagaaggctccatcaaaagcgttgcagagtttttaggaaggactcctgaaagtgttaaaactaagtattatgaattacgtaggcaaggcctgttagaatacccatcaagtattaataagaaatggactgaagaagagcgccaatacgtattagacaactatgggaaaatccctaacaaggaaatggcaagaaagcttggcgtaagcactgccagaatagttcagttaaattggtaccacacccataaaaataaaggcaatgaaggccttgacaaatagttacaagtgtgttacaatagtgaggtagaaatttttaggaggattccaatgagaaaacagacccttttggaaaagcttaaactagttacaggaaagacagataaagagctaaatccaactctttcacatatacatattcaactatgtggaggctctgggacaggtggtaagttcggcgccgctaaagttccatatgactattcagacaacttcttatttaactctcctgcaagagttacccaagagcaaatctacaagcagttagaagtctatgtaggaagcttcaagagagacttcatcaaagatggtaacgtaaaccaagatgaacggccaatcaagaacctatacttatggagtgagaacaaaggcaatgggaaaacttctacagcagctgccctcctaaatgagtatatgttcatgtcttggcaagcttcggtaatccgtaaaacaaacatgaaacaaccgcctgcctacttccttgacgtaaacagtttccaaacgctttacaataagtttactagaaatggaatcgcaaaagacattgcagaaaagacttcacgagagtattacgaaatgatggaactagctgagtcagctcctttagtagtatttgacgaaattggtaatcgaagcgctactgaagctttccgagcagaccttcacgacatcattaacaaacgaatggtaaacaagcttccatcaatctttacaagtaaccatccaattgactacttggaacaggtgtttgatgaacgcttagcagaccgtgtacgtgaacgaactatcgtgtatcatttcgagggcgattcacatagaggaatataggagggattaggatggcttcagtttcagctgagatgttattatcaaaggttataattgaaaacgatgtacaggctttaaatagatatggagtaagcgaggatttattccagtcgcctatccacaaagaagcttacaactacattattaattacagtagggaaaacgatggaaatgctcctgcttaccaaacacttttaagaaaggttcctgagttcgacttccaaagctctgcggaagagtcttatgcaagccttactaagagcttaaagaactctcgattacaagtagctacagctgcttttatcaatgctgatttaggagagttctgggaaaactcagtcaaaaaggacgacccaacagacttcattaatcagactatccatgccttggaaacaatcaaagcagagaacttagttaatggagctaatggacaccgccttgagaaggcctctgaatggtacctacaagagttctacgaccgtaaggaaggtaagtctgtcaagttctggaatagccacttcaagtctctaacagagcttattggtggaggctatcaatcaggaaacctttacacgatattcggtagaagtggtcgaggaaagtctactgtaatgctagttgaagcattagaagcagctatgaatggggctaatgttctttattactgtttagaaatgcctaaatacgagttcacttcaagagcagtaagcttcttatcagctcgtaaagaggttaagaaaagccgtatcaatggctcagattatctagcaggatttaatatttcagacattacaaaggcttcatttgaggacttaaacgaagaacaagatttcgttgactttgttaccaacttaaatgatttcatagaaggttcattcactttaagagcagtagacgacgacgactttgttaaccgctctgttgcccagcttgaacgagatatagtagaaacaggagcagactttgttgtagtagacccaatgtattatatgcactatgagaagaacacttctaaaacagcaggcggagacgcggcagaaacttctaaagcattgagaagacttgcaggccgtacaaagtctgttattatcgctgtaacacaggcggaggaagactccaatgaaaaaggtggagacgaacgcgaactaaacattccaaaacgttccaatgttaagaagacaatggcgttacttgaagacgcttctgtagtattggcttttgatagctgtgatggaagatttgctttggagattgttaaaggccgttcggggcatgaaggagaaagtgtcgaaggtatcttcctaccagtaattggatatgtagaagaatcattattagaagaagtaggaagtgtgtttgatggaatcgaattttagggaggaatttacatgattatttggtctttatttgatagtggtaacggatgttactcccaagtttttagtaaaaaggaaggagtggaaaattatagtataggaatggataaggagaaaggtactagcaagaaccaccttaatttagatttgtcggatttgagtggatactttggtgaatccaagatgataaaaagtcttgagaatttacccaagcctgacgttataatagctagtccaccttgtgaatcatggtcagtagcgagcgcaatggctggaggtaatgcttgttggaatcaccttaaaggagacccattcactatacgaacagccaaggaatatgaaagtgttcaattcaaacatgagaactcgttttataatagaatgaacggcgaacttacagtatttaatctcattaaaattattaaacatttccaacctaaaatttatataattgagaatcccgcttatggaaagatatgggaatacattgataaggtattaggatttgagttggagtatgaaaatttaacatattacaataactacggatttgaaataaagaaacctactaaatttaaatcaaatattaatttgaacctaaaatcagaaaatgttaaagctgacaccaaatttagagaagcttctaggataggtggctcgtacaatgtacggtctaatatacctttatccttagttgaggaaatatacaaacgaatcaaggaggaagccaatgagttattacctatctcaaatgaacaaccttaaagaaaagattcgctacgagaagacttctgttaagcttatccgagaaagcattgagcgtatcggaaagcctacaggagaatattctctaggctacaccgacgcattgaagatggaattactaatccaccagaagatgttagaagacgctcaggaagagttattgaagcttgagaaagagcgtaataaataacaatagtgttcaaaggggcttgacaaaagcccttttttgtgttatactagtcaggtaggaaggagctaaacaatgaccgtaactaatgaactttggaaacctttgatattcaagggaatccactcagacatttacgaggttagttcagaaggtttagtaaaaaacaagttgactaataggttattaaagccccaagactctggctatttacatgttagaatacctcttgacggcaagtattataacgctagaatccatcgaattgtcgcagagaccttttgcgaaaggcctgtgggatgtaatgtggtaaatcacatcaacggcaataagaaggataatcgagcagccaatcttgaatggattactcaaagagataatgttatccactctataaggttacgtgaagaggaatctaaaaccctctctatgattgagaaaatggacaagcttctgggaaaactattatcgccagaggctaaaaaagagtttatggaggaatttgtaaatggctaaaggactaaaggcaattaacgaggcggctggaaagactctagtagacactatcgcagaggactttgaacgccaattaaataaatggggagcaactggttatacatacgatagcgacgtacatcaccaacttatgcgagactatcttaaaatagttgaccgaaacccttttgaagacttcccagaaaacgttccagtattccgttcaagtggaactggtaaatgcttacgtgaacagactttgttcgctattgataagcttgaaggaagcgaccgaaaagaccctcctaaaatgcagtctcaccaaagccgttgggtacagattggaaccaaggtaggggacatgattcaggaacaagtcttaatgatggagaaacattaccaacgctttactggagaggagtgccacttccgtttcgaacgtactgaagaaggcttcccacacttcgaggagttctcaacaaccttcaagaagtataagtcaggccgtatggagttcattacaggaggctctatggatggcattatgatttggactgacccagccactggagaagagtatcgggtaggccttgaggtcaagtctaaacaaactactccagcagctactagcaagttctctatgagacagcctaactcaaaacacgtgtggcaggttaagaactatgctatgttaaaagacttagacatgtatttaattgtctatgtaaactgcgctcacaagtcttgggaaatgactgaagaagactatgcgaagaatccagacttacaagtattcggtgtagatattaccgaacaagataagaaagacgtccgcaatcgtttcttcacagcgattgaacatgctcatgcaggaacgcttcctccattagagcttagtggatttactttcagcgactataaatatgccttggcaaacagccttacttataaggaattagaagagcttgagaagaaagctgtatctaagtttgaccagaaggccttagaagaaattaagaagattagaggagatgttaagtaatgaacgaaagcatttatgatggcattccagagttcgacctaaagcctgagatatatggagttgtaattaacttctattgtaacaaatgtcagaaacctatagtaatgcgtttggacgaaccatctttagtagctttggatggaatttaccaagagcgtttagcagatgattccaacgtaatcctagaagactgcgtgtcaggctatcgggtagcacttgacttacaggatgttgtgacatatgcctctaaaaagcttgacagagcggatatggacttctcttggagtacctttattgattgggtagacgttttcacagagactgaaggaggagattaatgtgcgctttattagtttcgatgtaagtagtgtttccacaggcgttgcggtgattgaccgtgagccttctggataccttaccttagtccatacagacatcattagcacaaaccctaaacacaacgtagggcgacgcttaaaagacttcgcagaagctgttcaaatccttcttgaaacattccgcccagactatgttgttaaggagcagacaatcgctcggatggccactcaacacatcttgctgaagtttgctggagtgcttgagatgatagcctctaacgaaggcttcccaaagatttacgaatactctcctacgactgtcaagaaggttgtgggaggccatgggcgctccacgaaagaagcagtgctgatgggcactacagaatacattaattggaacgagccaattgaccttgtaattgacgacattagcgacgctgtagcaatctgtctaactcacattggaaaagaatttgtattggttccgttaggtgaagttgagaaagctaaagaagaagctatgattgtagaggcggaggcttctaaatatcttgaggaggctaccgaatgaaacagcagttgagaattgccataacaggaacttctaggagcgggaaggatacctttgctcaagctatccagaaaaagttagttgaaatgggttttgcagaagctatgccgatagcctttgcagaccctttgaaacagctgtataaaagatacttcttctatatggaggacaaagagaagccaagagatgcctatgttaccattggaaatgctatgagagaggttgacgaaaacgtttggattaataaccttttaatacaggctgccaaagactgggacgaaggcttctccacactagttacggacgttcgtttcgagaacgaggccaaaacacttataaacgaatatggatttatcttggttaaggtggatgccgaccctcttattagattaggccgtgctgaagctttaggtgaaacacttgatttaaacaataagggagacattgaggtaggaatgattgagcctcacttaaccttcctaaataatggggagagcgacttaatgcaaatggacaaatacgctgaaataattattaatatggctcaggaggttgctaatggctaatctattaatctctgagaaatcatactacgaaaagttagtagaagcggaaacagcaaatgagttccgtatggttttaataagattgattaatagagttgttatgaaagttaaagtaccacttgaggttagagagcttttttgtgaagaggttttagagatgtattacgaacgctttggcgacgtagcattgccagatagcctagcaaacatcctctcaacatattatatgcaagacgatactagaggcgacttggaaggcactaacaagttcgctcgctgttctaaaatggagtatagctttgcttctgataaaaaggagaagcgaatccgtactgaggacttatataaagaatctccaatcaacttagaagtgttggaaggaaatggttattcacgaaataatattgcctcatcattggatatggagcgagcatctcttagaactgacttgttaaaggcaatggcaaaagccgatttaactgagatggagaagaaagtccttgagctaaatcttatctacgattacactatgcgtgagattgaagtgcttccagatatgccttcaagaagcaccttgagtagacaccttacctccgctcgcaaaaagattatgcaacaaatttaaaatactttcaaaaaggggcttgacgaagcctcttttttgtgctatattatattcatagacaaagataactaataaaactacttggaggaatatataaatgcctagaacaaataataaaatcagccgtaagaaagcgttagaagtgtatttagaagggagtaatccattagcggctatctcagagctaattgaagagcatacttggacagttggtttcgacatggagtcagcaaccttttataaagagcgtacaagcaatccatatgacacctgtaagaatcctcggtgcaagctttgtaaacagattagagaacacgctgaacgaatccctgcttactctttaggtaagactttagctaagcctttcgaggaactttctttagggcactttggtaagctagctgcgaatgatgttgctaaagctgatatgcctaagctattaaaagtaactatgaaagatgttaataaacacattgacatgcaggtagaaaagattggattagacaattccatcaaccttctaaaagactatgagttatctgaacaagttatccaacagcttttaggaattggtgtttatgatatgcgacaatttaagaaacgcatgtacgaaggcaagaagcaacgtattgccgaagctaagaaaggtgagtgggcttaatgaagaaatatataaagctaggagcagccgttttgattttgcttattggagtagctgtgtggttaattgaatttatactgccttttgttttactaaaatgggcattgtagaaaggattgtggaacatggataattcactaagcgtatatgaggtgcaaatcctcaacactaacacaggctgctttgacgttttcttagtcacagcaataagcatcacttttgcatatattaacttttcggagacttttgaagaggatttccacgatgatgggaatgttaaagtaatcaaattggaggagttttagaatgaatatgattttaattttgttaggcgttgtttttttggatgcttcttacttgccttagaaaggagaggttttaatatggaacttttagaaagaatcacatacagcttatttatagctttggtagtagttttagcagtaggagcattttttgtaggtgtttattggctatccgtttggactagtggattaggagaccttggaaccttcgttgcagtaggtattgtaatgttcgtttttacagctttagcggtgtttcttggatttgattaaggaggaattttaaatgaaattgaaagacttattaaaggtagtagacccaatgcaggacatctctttggagattgctgaattaacggctccagaaggtatttatgctaaagacattccagaaatgcgtccaatggccttggaaatggatattgtagatgttcacacagcttggtataatacagaagatagcattgaaacaactttgggagtcgttgtaaaaggaggtaaaaagtaatgcgtaaactatttgaagagaactttacaattgacgaaatgtcagatatgtggtatggttgggataatgaaggccttttatatggctgggaaaatggcgaagcaggagaagtttatgcaatacttgaggaaaatggatataacgtggactccattaaaattatgtatggagcgttcataacacttggggaattgattggagcgatttagacatgcttattagattaaatgaagcagacaattatgaagaatacaaggaatatattgagctttctgaaacatataatggaaaagttcacctagagctttatatagaagaatctgaaacagataattatattagtgtaaaagaagcttacttagacgaagaatctattgacaagcttatcaaagcattacagagctttaagaaaggggaaatctaaatgtctttaggaatgtttgacaaagagcttttagcagctctagcagctttacgatgggttgtagaagaccctgaaatcaaagagcgtcacgatgaaattttaaacactgcgtacatggaaaacgcctacgagaaaggcgaatcattccccaatgaaaagtttgtggagtggcatttcattaatgccttaacaacgcttgagatagaggcggctgcacgagaccttattattgatgatgaatcctacgatgaagaagacgatatggactgggcaagcgacacctattcatgtggctgttgcacatgctgtggatgcacctgtgactactatatgtgggaagatgatggaagctttgacgaagacgatttggaggactaattgatggctaattactatgtgttagaaagacttgacgacggctctggcaaactccatcaagtaaagcagtataaaagcttagataatgctattaaatatgctaaagaaatgagcacctttaaaaagacttaccaagtggctggccaattcgatatgaacaggcttgctaacactgggatactagtttagaaagttgtacgagaggccttgacaaaggtctctttttatgttatcataaggtatcgaataaacaaggaggaagtttatatgaagatttcagttaacttacctgatgataaaaaagctaaggaagcaattaagaaggttaaggggaagaaacctctattaactatggaagaggcgtgggcaaagattctatctatgaagaactccgcaaaggatttagaacgccttaagcaagttaaggaatacctcgaagaaggtaaggtaagccgtgaggaagacaagttaaacaagaacttctcaaaggccgaggctctacgtatttatcaaaaggttcaagaaatggaacgagaagctaagtttgacgaaatccgtaagaaagagtgggagaaattccctatcataaacaatattgtagagcttgctagttggattgacaacgctcttgaatgtgataatgaatacttggcgatggactttgaaacagtcggtgacaacggcggtactgacatatatagggaagagatttcaggattctctttaacttaccgttacaaaggcgaaatcattaatggttatgtgcctatgcgacaccgagaagaagacggctctcctagtcctttaaatatcgctaatgttaagtgggctgaggaaggtattaagagagtctttgagtcagataaggcaactgtatggcataatgcaaccttcgatatggggcttgctaaagcttctttaggaatcgctcccagaacgcttgtccacgataccttaatcttaatgcacctacttgacgaagaccttccaagttatcagttgaaagttttagcaacacgcttcttgaatattccgtcagatacctttgaagaaatgttcggaaagaatgcaaagttcgctgacattgctgttgagattgctcgttattatgccggtaaggatacgtatgtgggatttcttttatttgaatggcagttgaacatccttaataagccttctttcgctaagattaaaaaggtatatgagcggattgagcgaccttgtatcatggccacttttgaaatggagtcggaaggcttccacattaacatggaagaggttgaggtacaacgtaaggaaagcgaggcagagttagaagagatttctgcacgccttcaagcacgctttggcgacgttaacttcagctctccatcacagctgttaaaactgctttacgtagacaatgattggagtaagtatgttacagctgaccataaatccattctaagaggtcacgtaggttatgatgaacatggtataagcaataacaaattgtttgcattaatgcctaatggaagtgttatcctagaccctatggtaaatgctgaaggaaaggtcgttccaaagaatgacagaaacaagttacaagctaatgctaaggctatgaaaaagattgccaaagctgttgacgaggttcaagacatccttgactacaaggacttgacaaagcatttgacagctttcgtaaacaagattgacaccttcattgcgcctgacggaaagcttcatggacagtttaatcaattcggtactgttacaggccgtttcagcgcctctaatccaaacttacaacaacaacctaagaaagctcgtaagatgttcgaggctccagaaggctcattaatccttggagcagatttttcgcaacaggagcctaggctactagctcattcaagtggatgtcaagaacttattaacatctataacgaaggccgtgacttgtattctgaaatggcttcagcaatctttaacaagcctatcgaagagtgtttggatggctcaatttaccgtaagaacactaaaatgattgtccttgctatcatgtatggaatgggtgcctacagccttgctgacatccttcgtatcgacgctcaggaagctcagaaaatgatcgacgacttcttcgtagtataccctgaagtagaaacttggattgaaggcaataagaaaacagttgttaagcaacgctatgttgaaacgctgtttggaatgcgtcgcagattcaagcatgaaaactttgacatccttaaaaagaattggaactccttagatgaaaatgataagaagctccgctcagcagcagcaagagccttgcgacaagctactaacgctttaatccaaggcggagcggcctctcagactaagcttgtaatgaatgcagctagaatccgtttgaaagagttgtcagaggctcgtggagaacctaactcatttggattccttgctcaagtgcacgacgagctgttatttaaagttcctgaagacgtaacagaagctgaggtagacgctattgaagacgttatgattaacactgtgaaactagtagttccaagtaagactgatattgagattggtaaaaactggggtaaaatgactgctagaaaagattggtttaaataaatttcagaaaggggcttgacaagcctctttttgtatgctattattagtccataaagaagagggaggaatcaacatggtattgcgagtaggggataaagttactattaaagaggatttaaaatcttacgaaagttttggtaaaggagttacttttgttccagaaatgagtaagtacctaggcaaggaggctaaagtagtcacggttgcttcacatgatggattagaggttagcctagacattgacaacgagtgctttttgtggcatgaggaaatgcttattaaggatgaggttaagccttcagaactaactttaggaatgcttttgagtaagctaactgaagacattagtgtaaacattgatttaagttttgaagacgcatctaccagaatcgtgtcggaaaactattattcatggcagctagagccttattacagtcgagttgttaaatggtttgcaccagactttgataatggagagttagcaatacttttggaaggagagttttaatatgaagcttaaagtaggagataaagtaactgttaggaaagacttgaaaacaggtcggtatggcaatgatttagtttttccagaaatgcttgattgtaaaggagttacaactagtattaaaaaaatccattctaatggtgccatagaaataatcggaagctcatggtattggactcctgaaatgtttgaggaaactccttctgaaatcactttagaaattggctatcgacactctttagacactattgttcagacatcctctcagacagttatcgatgatgattacgcttatgagaatgcctgtgaacagtttttagaagagtatatgaaggattacaatagtgtagaaaatatccacatctgctttgtgagggaggccgtcgaaaatgcctaagaaatattacctgaaggccatttcaatgtatatattatatactttcatagcagccgtggttatcggcggaaccttcctgttagtaaatgcttttgtatgggtaggtacattcatctacggaagatttggggacactgttggaacaattcttttactctccacagctggactgatagctttatgtacagccctttactatgaagctagaaaagagtttcgagaagacgctttgagagtccgtatccaagaccctgaagatggtattgatacacagcgctttgatattgtttacatgcttccagaagacgctatccgacaagcctcgacaattgttggaattattccagaagacatacaacacattgagtccaaagagcttcggaaaaaggttatccacgccatcatgaagcattcaccagtagagtatggatttacgcttatcactaagtatgacccagaccttgactatatgcttcgtgaaatctgggacttaaactacactttcaagactagaagaaagcttatggaaaagcttagagattgtggagtaggccttgaaggagaatttttgaagtatcttgttgactaattaattaaagtgtgttatagtagttttgtagaagacattaaggaggagattttaaatgaaatacactaagaaagaccttaaagaaggcatgaaattacgtgttattgacggagctgactttgatttttgggaagaaggctcagtacacgaagtaattaagctttttggaaagcttgttattgatggtgacgacgaacttggaagaggaattagaaacagtgatgacatcctaaattacctaaatttagaatatcctgtaaaaatggaagtagtggaggaaggcattatgaaaagctctggggaacgcttaactaaatccaatattaaagaaggcttgaaagtagtgtgtgttaaaaacgcttatgagccgtatcgatactttactgttggaaaagaatatgaagttgtaatggataactgtggtgacttaggcattgaggatgatgatggtgaaggatttatttgggataatgcaatctttaatgaagaccagtttgtcttcgagcttttggaagaaccttcgaaaaaagctgctttagaagctttagatagcaaaattagagagcttaacaatcatcagcaagagcttttccaaaagcgtgacagaatcaatgagcaagctatccaactaggcagcaaagcacgccgtttagaagaggctaaagcactcattgagaaatacatttaggaggcagtcttatgaaagattttctagtagtcgttatgattggcaataagatgcttaactttgctacttctacagaagccatgacaatggagtttgtggaaagccttaaaaaagagctttcagaacagcttagcgaagacttaacacctgctgatattacagttttaaatatcattccaatggataagaaacaaagtagccttattacaggcatttaggaggagtttacacatgttaacgacagattttattgaggcggtagagaagattgggctagaggtagataatagctactcttcggtgctttacgtagaaagtcacgatggcgttgttgtaagtattaacaaaggctgttctgaagcttttacatggtgtgaaggaagagacattcatgtgggaggccttttaaatcttatcccgcttgtggaagagtacgccaacacgcctatcgaagagcgtgagaaaaaggtttccgagaagctagattatgagactattaaagagtatattttcgaaaacatgtctgaaaatgatttagcaagacttttgtcagaggcgcttaaacacagcggcgaaacaaatacctcatatataattactgacagaggtgttgcggttagtcctaagttcacatttttagattaaatactttcaaaaaggggcttgacaaggcctctttttcatgttatagtaagactatagaaaagacataggaggacattatggaagacttattcaaatttgcgtgcacgcttgtgttaatgactgttctaatctctgggtatgtggccattcaattagttattatagcagtggcaggaacctttttgccaacatgggcgtttgtaattgttttaggatggcttgtatacactaattacagagtattgttgaaaggtggagaatactaatggatacagtttaccaagacactcaagacatctatttgaaagctttttggatttgcattgatagagctagaaatagggcaggagtcacttggtcttatttacagcacggagataccactagagcaattaatgggacagctaatccatctatcaaaaagactttgcagcttatggacaagcttgacttagatattgtagactttcaattggacgttgcagaaacttatgaaagacttttggaaggaggactttattaatggaatttaacgaggaagaattattctatttactagctcttttaaaaggcgatataaatgaacttaaggaagcatttgacatgatcaaggcatttggagcaggtggaaatacccttcaccatattaatgaatacatccttttaaaccttaaaataagagcaagcctattattaaagttagaaaagattcaggaggactttgcgaatgctaattaaaaaggaaaagaaggcctacctattcaccatttatgaattgcattcctacccctttgtgataggcgtcgatgcttactccgattcagtggctatagaacgtttctacaagatttggagaaagcattatcctaagcattataaaaagcataaggggttctccgttaaaaagtttgatatttagtattgacaaatccaccgaaaggtgttaagatagacttatcaaaggttaaggaggtaattactatcatacccgaaggaagttatttaaaagattcgtcaggcctcaaccattactttatcgaaggccatatcataggcgttaggacaggagtaagaggctatcagacagttgtttgggataaggaattggacaaaatgtatgaacaaaactttcacgaacagtctctcatgaacgatgttaaaatgtctaagaaagaaattgaagaatttaacaaaaagtattatgaatggagttggggacaagatgtctaaacatttctatgcaaacactagcccagacatggctgtaaactatccaaaaggatggacaagctttttccataatattgtaggctatgacgagcctttgtcagaagatgtcttaacggcttatcagcttaaagaaatcactgatttaggagagcttccagaacaccataagaaagtatttgaaacgctttcagcaatggagtatagcaccgtggagcaggctctaaaaacatttaaaacaaactatgtggagggaatttaatatgaattttgaagaactaattacacaggtagaagaatggtcagctaacaaaggattagacaaaactgctcctgagaaacaattcttaaaagttattgaagaggtgggagaagtagcggcggctatggctcgtaacgaccgagaagaacttgtagatggccttggagatacttttgtaacattaattatcctttgtcaacagcttggagtagagcctcacgaagctttggatactgcttatggtgttatttctaagcgtacaggaaagatgattgacggagtattcgttaaaagcgaagacttgtagaacagttaaataaactactatcaacagcctttccgaagagattcacggaggggctgttttatagttttcaaaaaggcaggggcgaaatttttaaaaaattttttctaaactgagaatttttaaaaagatttttccaaaaatttaaaaaaatttttcttaaaagtttttcctaaaagcgctactggattccattattagcgcttattttacatatttattgaaatagcgtgtcgcacaggcgcattctgagcgcatttcgcactgctttctgcacaactatccacatatttgttgtgtggcgccttatatatgctgctatacatgcctttccactgcttttgataaacattattggattaggctgctatatacacactatcatgtgcctttactatagcctatcccctatgctttatagttagttttcctataggctactttaggttatactactataccttactctactatactccccccccccagtttccacgagaagtgccctataaggggctttttaagcatttttacgcctttttaaaggcttttcttgctctttttacaagcctttttgcacattctttcttaaaatccatcaaaacacctttataatagctttttcagattgtttttaaaagtttctactatataatacgccgtttttatgtaaaagctgccaaaaagaatttaaaaaaagttgtattttattgttgacaggcatttttgaaagtgatatattaagagtgtagcaacgatctactaaaataaattataagaaagaggttttataaaatgatgaaattaatcgaattagacaatgggcggaagcaagttttttacaacaatgttttaatgcaatacgaaagacgtggcagcgatatatatggcaatcccttatatcgagcatatccaattaacttttcttttaaacgtttaaaaagcgtatatagaaattacgaaaaaagttacggagaggaatcctactaccttatccaaagctataacattttagcagatattcaaaacattgctaacgaggtaaacgcaaaaaacacttttccagactttgaccaaactttattgaaagactatcgggaggttttggcgtatgtctaataaaactattgaaaaattatataatagttacatgagtacttgtaaagagttccgagaaacggtaacatttactcaatatgtgaaaggggaatattagaaaatggcgttaacaatgtttgaaaaagagagtttgcaaaaagaaaatgcacgacttaaaagagagctagccactttaaaggctagccaaaaactaggcggaggacttgacgaaaaagaattacaaaaggcattaaatagttgccaaaggattttcaaaactttaaataggggcaaaagaagccttgttctaagtaaatccgccatggaggctagtgtggaatattcgggaagtggtcgctcaaaaacttataaagattgttccaggacagcaataagagaagcagaaaaaagcgcatgggagattatgagcctagaaaatgactttagaaatattcaccacttcttaaaacatggtacaatgaaagcggaggaaaaagacaatgcttaatattattgtaacagtaatttcaacggtggttattttaaaggcattggaatgggcatataaaaagctttcgaaaagacttgacaagtctattaagttttcaagaaagaaatctaaaaagcgctttattattgcacgagtgacggaggaacaagcttatactttgcgattattaaaagccatttctaaagatgatgaagctgtttgcgaagctacaaacaaagctttgctggaatacggttacgaggaggcgggcgggcattcttatgagaaagctcgggaaaagttttcatcattacctgacgtaaaaaacggcataccgttggacgatctagaaagtgatgaagaagcggacgtgcaacctttttagaaaagtttattaaaatgcttgcaatccacttggtgatttgctattataaatgtagttagaaaggaggtaacaagaaaatgagtaaagctttttacatggcactaggcggaatgttgacaagctttttcctagggcatggcacagtagcgtattttatggcaggcgctgcagcgttaacaatagccgtccaaacaatttacaaaaaagattagtcaaaagtgttgacaatggttttcgcaaatgctataataaagaaaattaagaaaggaagtaatgaaatgacacaaaaaatctacgttgacaccattctttacaatccatcaattattgtttatgaatggaataagaaaaacatggaagtatctttctataataagcttaaggagagagaagaaaccaaagaaattaaggcagaccgtgatggcgatttatatttttatgcaaacggtcaaacattctacaaaaggcatttacatgtaattgaatataaagaaataaacttgtaaaaagttattgacaagcggttaaaaaagtagtaaaatatatttataagataacaagtaataaatactcattcgataaggttagggcaatcctttaaaaaagcctaaaataaaataacagaaaaggcggtttttaacatgacaaaaattacaaaagaaattactttagaagaaattaataatgcagagtatacaggttatcttgtgttagataatgatagcattattgtaagggtggaacgtaacaaggtaacaaaagaaacatactgctatgtttatgcagacagcgacagcgacgactttacagcaaaatttaaaatagagtagttaaaaaagtttacaaaaagctattgacaaaaaacaaaacatagtgtattatagacttataagataaagagaggaagttatagacatgacaaaagaaagcaatgtatttttagacgaaaaaggattttttgaggaaattatagaaactttggaaaatggctacaccggttattattgcgacctgcacagtgaaatttttaactggggcgtaaatgctgacattaaagaattagaagaatacggcgtttttaacgcaatcggagaaattcaggaatatgaagaggaacacttctgcgcaattctaacagaccttgggaacgcttcggcagttgctgatatgctttactatattaaaggtaacgagtttttatttgatagaatagattttaatgatgttttagcagacgttgcagaggggctaaaattagataaagacttatggggcgaggaagccaccgaggaagtgaacaaggctattattaaatgcttatcggaggaatttaagaatgtttattgttaaaatttataaagaaaaatcagatcgtcagttaaagcttttccacaactccaaagaagctgaaaactatgttttgagaaagctcaagggaactgacaagaaaactattgaagtttttgaatgggataacatagcgttagaattaagctactggaatcacttcacacggcagcaagaaagttatttactagaatattgaaaaagtttatgaaaaggggttgtaaaaagcccctttctatgatattattaaaccatcaagaaaagagaggaggtaacaacaaaatgacaacagcattaacaatcgctttaattagtttggtagcaactttggcagtaagtattcacgaaattaatcgttaaaaagttttagaaaagtattgacaaaagcagttacaaatgctataataaaggtatagtaaaacacaaataaaaaattatatgaaagaggttttcaaccatgacaaaaacatttaaaaacattatcgcaactttaacaatcctagtaatcgctttggcagcagctacaggaatcgcaacatttaaggcagtagaaaacgcaaatgataaagctatccttgccgaacgtgtggaagctttggaaaaactttccgacaggcaagaatatgatattgcagtaaagtctaatgtaatcggcgcttacctaatcaatcatgaggaagaagcacaaaaggaatataccgaagcttataaagcacacaagccaacgcttcttaaaaactatagagaggcacacaaataatttaaaacatttttttcaaacttaataaacaggaataaggaaagcttttgggataacttctcgagagcttttcttttttgtgttttcaaaaagtctgatcagaaaaggcgccaccttaatttatggaatgcttttctaatccatctaacctaggcatttcttacaacgtatataaagctttctaatggttaactacccaacttctttcttgaaacgttacgagaagccctctctcacacacataataaagcagtaggcaaaggaatatgcaaagagtattcttaaatgctgttattaatccaccaaaaaggcaaggaaagaagcggaaatgtgagaaagaaatggtaaaagcctattaatcctagggtatttttaaaggaaatgagagggcgcctaacaatattattttaaagctttttctagggcgttgttatgggggtttttctgaagggtatctagagggcgtgaaggggcgtaatctcaaggcgaatctaagaagcctaatcgaaagctttgcggtggatttgtttttattaaaggaaataagaaggctttgcggaatgctggtgtggtgggctttggggagaggtggctcgagagggtgtccgatagctttcaccacaggttaacactaaagaccacactcacaggcacacgacaggcattatagaggtgtgcgaatggtgtccgaaagctatccgaacagccctaacatggcgctagtttacataatacacattattcaaagtagaaagaccctgactcaatgcaatgttaacagcaaagagacagagtcgaagtgaagtcgcttgtgtgagcgtgtcggacggcgtgacgtgagagcgtcgtgaa

SEQ ID NO: 27 - DNA, 171545 bp, synthetic construct
  source 1..171545: mol_type = other DNA
tcacacataaaacacatcatatcgaccacgggtagtaccaacatataataactgctgtgcgagagaagcatctgccatgtgaatgcatggagtataaatgaagcttctgtcaattgagatgccctgggccttatggaaagtcgaagccggtaatgctttcactttatgaaacttacgcttagcgtcccagaactcagaccaaggagctttacctcctttattccaattcttatatgtatctgcagtttttgccaagaagaattgaaatttattcatttcttcttcggatgagatgacacagattttctctctagcgtactcttcatcgtcgccataggtttcaatatctaatacccaatgacgaaccagatattcacctggaacacctctggcacccaaaaatgtggtggtttcaactgcatccaatatgcgaacaaactgaccattattgaaaagaatttcgctgaatttcttcccttcaaatttaagttccttggtaagaggttcttgcataacaacaatctcgcctactacgaatggtcgttcagtttcgtatattcttcgtctgattatttcattcaatttgtctacagatttattcgtgaatgcaagcattcggttttcaaataaatcttctggtgttttaactaaattaaaataatttagcataaaatctttaagggcagttcctttcgtaaacccacggacaccatgaccatcaactacacagtcacgaatccatccaccatttctgatttcagtagcaacttcaatgattggagcattacttcgcatcacctcggtcaaatgaagctgtaagaaatctttatgagtgaagaatggactcagtgcaggttcattacttccaggttctaccggacgtatctgagccttatcaccaatggcaatgacaatacaccaggcaggaatagttgccatcaaaatcttaaacagcttacggtcatacattgaagcttcatcgcaaatgagaactcgaatagatgccatatccggaactttcttttgttcaaacagaacgttttcttcatatgtcgtcgggttaattttcagaagactatgaatagtactggcctgcattccgctgagcttagataaaacctttttggccccatgtgtaggtgctgccaacgcaatgccagagataccctgagaaatcaaagcatcaatgataaatttggttaaagttgttttacctgtaccggcaggtccattaatcgtaatatgttgacctttagctccttgtttgaccatttcaatgactttattaaaaatcgctttttgactttcttttaattggtcaaacgtaatcatgccacttttaccctcactacatgtagatttttaatttttgcttcgagtttttcacgctcaacatcgctaagtggttcatacactagctcagttgttttccaccaaagcattcctttggttttgctttttccagtaaaattcccttttgctaatttgtctgttaaaaccgacattgtacgaatccgtgctttattagccgattcttcattagtgaagaccacacatcgttctccatcgtacatatcagttgtgactggatggtcaaatccgtctttatccttatacgctactacatatccatagtgttgcattacattttacctctcaaaagttggaagaaggacgcagtcaatggaagaccttttttcaattttaacttatctagcattgagcatttttctaaccgacgaagtgagctaacaattagccgtattgattgtacacggatttcagcatctgatggacgattcggaactgatgctaaaatagcagataacttacgctcaactttagctaattcagacttaccaccgctgatacgagttctcaatgcattaataagttctaaatctgccgaggttgcagttccattcttttctttttgcacaaattgagaaagatgattttcgcgattacgtaagttagttttaattgatgttatagttttttcatactcacgaatcttttccaaacgagaagcttctttatcacttgttggcttaacagaatcagaagagcgaactatgcgtgccgcaatttcattcgcttttcgttcaaggccttcaatcgtattatttccacgcaaagtattatacttttgcttgacaggaataacattccctactacatatcccaagtcattattccaacgctcgagcgtcatgctatcaggatgatttcctttaacagttccaaacttttcgcctgagtatgcgcaatgtgtctgctgcatgatgttaaacagatattctggggtgagattgaactccttgtgccgacgttgagcagaacctaaagttgtaattaaacgagtataaactttagcggtttcagcagtaaatttcatcatgttttcctcaaaaatgctttcgtcttacggacggtataatgggtctaggtccctagttctagataatcactagttgactaagctatagtaacactaaagtagtccataagtaaaccagatttttcaactttgttatgaccaaccactttgaacttagttcccatcggtagcatcctttcttgttctttatcaatcatctcgatgtcagcgcttctgcgctgagcaatgttatcaatcacatcatttggtcgcatgaattcagaatctggtgcagtaattaaaagcgatttcatgttggtatgataatcaaatgattgctgacaattattgacttcaatgactacaaaggtcgagtaatgccatttgcctgcaaactctcgggcgatcgtttcatctgttgtgaatgatgctacctttccaaagtcaaatttctctcctttaataagagcgtcataaaaggctttagcctcacgacacgatagacctctatagagaatttctctgttatcgatttgatgacgtctaacgatagagtcaagtttcttatgaaattcttcgccaatcttattgttcatgcactgccacagaattgactgttctttgcagtcaaaacgattggctaatgcttcccatacgcttaaatcatataaaggtaatcctttgctttctcgcgcgaagttaagaacatcaatggagcgaatgggttcttcgataggaataacctttgataattttactgaaatagatgggtttaatgaaatagccatgatattctccattttggttacgagaggtatcttatcatggctttttggaagagtaaactactttgtgaaattattttgcccagggagaccagggcggcgggtcagaccagattgaagctagttcatctagaagagcttctggggctttaataccatacttctgtataattatacggtattcgtctttgatgtccttagaaatcactggatgaacttgaacctcttcctgaggctcttccatcatttcaaacaaatccatcacatgaaccactcagtattgcgatacagacaactactgctgttatatccatcagctgctttttgcaacagcgggcttggagcaagtttgataaaatctgcgcccatatataaccaaactaacttagtaaattctattagagaatctgtgctatcaatgataatctttttgcctcttgaaattatgtcattttcgtattcatataagctagtttcatgacatacattggtgtatcctttcaagtggagagcatgcagtatagaaacaggacttcctggaactgtatctacgtcaaagacatgagcagtcttaataatgccataatcttcagaaggacaccaaccaaatgcctcgaatttattaattaaatctttgaaatctttgtcgaacgtactgtatagagcaacagtaaaaattctatcttggtctagacgcaaagctccttttgcatcatttcttgattgaactgcgcgctgtaagcttactttatagatttttgcgtttgccacacatagctccttcagtcatgttgttgtcttcaaaccacttatcatttgctttaattaaagcaggcgcagcttttagtaataacgctgcagctcttacacctctgtaccaacaatcaaaatgagacttctttaatggcgattgataccagggcttagtataacatatcattttcttctcctcagttagtaggaataatatactattcccagtatagcataaaaggactcccgaaggagtccttaattttatacttcgccatcagccggaacagcttcaaacattttcgcgttggtggttgcccaagtagcagcatcatcaactactgttgaataagcagctttttcagatgggaaaatctgatactgcgcattagcaatacgatgcgaatcagaatacaccttaaaagctacagatacttctgtgcctttaacttcaccatcagcagttgcatggtcaaaagttttgatgtttacgtaagccattttaatctcctatttagtttacagaagtatttatacagctgctgtaaacatctttaatatttctttatcaatttctcgagtgatttcttctcgaagggccaatactaaggccctttctttttgttttctgataatttttaaacgacgcttagatattcttttagccatcaataaccactgtcttgacgagcaaagttctctgcgtttttcagataatacagcttaaagatttcttcagaatccagaccaagcgccataaacatattcagaacaaagtgcaggatatcaatcatttcaaatttgatttcaagctggtctttatcagacaggtctttgatataagtttcctgcatcttgacgtggtcagctttccatggtttccatacggcagatgctgccttttcaccgttactcataccgccaagagacgtcagcaattcgcggaattcgtcatcaatgtaatctttttggttacgcagccactgcacgatatcaccggcttgggccaattcatcaggatgcatgttagtaccaggcttatcgtttgctagacgaacctgaagagatttttgcatatcaagcattacttgcagagggtcaccaccaactttgcgtacgatacctgcgtatcgagcttcagctttatctgcaccagcgatcagttgactacattcgttgaaatgtggcatattatttttcctttcaattaaattagataaatattatatcacttaacataaatagcaggaggattcatgtctgaagtgaaacgagaatgtaaagacaaaggaggatttggaagatatctttacgtcggaatcgccactgctgctttagctgcatggaattatgtggtagttccattagctagcacacacgggctagttcttcctccaatgccgttagaaaaagttgtgtcgtttattatgactggaggattgctttaatttaaggggctttggcccctatatcttcgcatatttgtcaagacgtaatttagccattaaaccttgcgatatattttgattaatataatccgttatttcagaagcagttgccccctctttcataatcatatcatttatatctttgcttttccaaggcgacttatcccagaaaactaccttttcaccagcatctactaaacgtttcatacgcttaattgtatcaggatgacgaggttcatggtccataatccatgctcggttatcatgacatggaacttgagctaaatctaaagacccgccagtgattgcaatagcattatcaatgaacaacgaatctattggtccttccatgacgaatacgagttttgactcatcaatggtgtcgagaccataaattttggttgcatgttcatgggctttgattgtgatgtatttttgtggagcattctttcgtagtgctcgtccttgaaacgactcaatctctcctttcttgttgaagataggaataaccaaacgtggttcgttcgtctcattcttataggttcctggattaacagagttaacaagagaaggccattggttagtaaaccataaccttttccaagaagtgcttggaatacatctggcagtcacatatttaactatcggatgttccttcggaagtctatctaatcgctcgcagaaattaagtttttctattacggggagttttgcattaattttctcagacggttctacagcctttggcttatcaaagacttgttcctttcttttctcaagaagatactctcgatagaggtcaggctcattatctttaagatactgtgatagccacttgttatactcacagttgaagcaatggcagcgtaatccttgacctgcatcaaaaatccagaatcgggctttattgatatctttctgtgagtcaccacaaattgggcaacgacagtttaacttgaatgttgaagatgtagtaacgtgtctaaatttaggtaggtgagatattgcgcgaattgcatactcgttatcaacccaagacataatatttcctctggccttaaactaataaggccattttatcactttttcttggcagcgtctttatccgcttttcgtttctttggaagagtttcgggtcctttattgacgatgtccccggaagttgtacctgatgcaatattctgtggattgccgcccgcatcacctgcgaccatctcagtaacaaactctttgtatgttttcatagagcctcctactatttattcatgcgtaatacgtaagcatttatatgtaggatacagcgtcggagacattgattttggattgtctttgataagcataaactgcttgcctgtatcttcacacttttgcttaatcattgcttcatctttaccagtgaatgccatcttttcagtagacattccgcctgaacctgtagatagcgccattattaaaacgtatgtaatcatcctaaaatccacttaacaatgttgaagttatcaaactgggcatcacagtaaagaacataattcaacttaagtgctgcgccgtcgtctttaagttctgcttgcacttctgtttgtttgctcgggtctacgttttccacaatatgaccaacatctgcacgaatctgctgagctacttcagactcatcagcagtcattgaccactcgcataagtctttgtcatagttggccatggcaggaactgcagagcaacttgatactgcgaacactaaagcaagtacaatctttttcattttggtttcctcaagcagcttgtacgttaagagcagaaatcaggcgataatcaccgtttgcgtatactaacattgacacattgccatcagtgtttttgaatggctcaacaactactaaaactgtatcgccttcatctaatgcttttcgtactacgccatcacaacgcagattagcatgtggagatttaactactttgcttccaactaccataccacaatgcggtacggtttccgctgattcatctttactcttaaagactacgtctaatgctttttcaattgtccacatgatgttttcctctactcgttttgtttcagtaaggccatagtatcatggcctttggagaaagtaaactaccttttgaacaattttttcaacaaaatgtcagaggtcagattcttggtaggtaggtatgtagcagagttaacccagatgccatcgctgtcatacaccttgacctctccatagtcgcatacagataggtctgctttgttatatgcctcgatgcctcggtgaatggtatctgtggctgttacgacaaaagagtgacctgattggtcacggaccgcgctaaacacaaaaatcataaaatttacctagaattttaactcttctgccagagcatcaagcttagaacgtgatactcgttcttgacgattagattcggctacacggttctgtgcaccggcaccttctcggacggtattgcttggattaggcttagttgggtcgttttgctgctcaatttctacccagcgttgattagccttatgcacacccataaagaacttattgttgatgttcttatcgccataacgtgatttaatctgcttaattaactgttgcttcatctgagcaagttcaggagtttcaatcacagctaacataaagtctgccgtagcaggtagacccgcagattctgcaatatcactcatgtccatatcagaagcatcccaagctgaacgaccgacctgagccgcggtccaaagaacagtttcagattctacagccaatgcacgaagttcttctgcaatagctttaactaatgtgtaactgttttcagtatattgacgaatacggcaagaagcacaaataccaagatagtcaatgatgataacagtcggtttaaagttcttcttgagtttcaactcattcagaagagctcggaatgtattagcgttagcaccgccagtcggatactgtttaatgattaaacgaccaagagtactagaactacgccatttttccattttgcctttatattcggcgtatgatacacaaccatcatcaatatcgtcaagtgatacatcaagcaaattagcatcaatacgtttagcacaaacttcttctgccatttccatactgatgtaaagaacgttatgccccatctgaagatagtctgcagccaatgaacacaatcctaacgatttaccaacgttgacgcctgccatcaatacgttcagtgtaccagtctcggcaccacctttagtaattttgttcagaatgctaagtttaaacggaactttacgagctttattctggtatgataaccaacgagcttcataatcttccatccaatcatgaccaatatagctatcaaacgatactgataacgcttcacgcatgatatcaggaatagcccccatatcaggaagacgcttatctcgcttatttggctcaagctgggcattagcctgaatttcaataattcgagacgtagcgttatacatagccttttcttgaacgtacttttcagtttccttaactaaccaattcaaatcttcgggagcatcagataacttatcaataagtttctttgcgccttcatgttccgtttcagttatagacgaattatccagtgctacacacaacgcagtctttgaaggaattgctgtatattcattaacgtgtttcttaattatgttaaacaccgtctgagcaggtccttgctcgaagtactctttgtccatatatggccaaaccttcgtaaagaaagcctggttgtaaatcagattagctaagattgtttctaccactttaacctcttaaaagattttccataatgattttttcttggtctttaatgcactctggatttgttgtttaacacaagcttccacatgaggataaagttcatccttatgagcttcagatggagtactaaactcaatagttacttcccccgaaggagaaatatttaatttatgaacataaaccaagtgtgattgaccatttaattttatcacaatttcttggataacagtcttcatagcttcttggattatttcatggcttttcttgaacactcgttcttgacgctcgaagtctccctcttccgagggagattcttgttcaaatttctcgagttcagattctaaatcaaactcagtcttcattcatgaagttctctaattcatcttcaacttcagcagctgatactgaaccactctcagggagtttaacaccatcaaccttagttgaaacttttgagttaatcatttctgctaccgcttcatcaaccgcagcgtttgaatcaatagcacccaactgatagcgagctttgatagcgtcacggaatggctcatgcttaaacagaggaccccaaaattccgtactgctcgtatcttttgcccgccaggatttttcttcacgaatcatctcaccggtttcaacgtccaggaattctcgtgcgtaccatccatttttcggtttaacaacaaatccgatatccagagccatatcaagcagaccactgtacggatctataccaccatcgaatttaacatcgatgaagaacttacttttctctttgacagtacgtgatttctcggcgttcaggacaaactgatatccctcaagctcagtaccatctttaatttggcgtttaccgatgatgaacacagtatccgcagaatacataggacctgtaccaccggtcattaccgtcttactgaacatctcgatggtctcgattgtgtggttaaccgcgacacaaggaatgttcttaatagagaagtaaggagttacgatacggaagagagacttcagacttttcgcacgagtcatatctgcgacagatttctcgttcagtgcatcttcggtttcctttttagacgccatgttaccaatagagtcgataaacacgatgactttttcaccacgctcaatagcttcaagctggttaaccatatcgatttttaattgttcaaccgactgaaccggtgtatgaattacacggtcagggtcaacacccatagatttcagataagctggagtgataccaaattctgaatcatagaacaagcagactgcatcaggatacttattaagataagcactaaccattgtcagagacatgttagatttgaagtgtttagatggacctgcgaagatagtcaacccggactgcataccaccatccaacgctccgctgatcgcaatattgagcatcggaattttagttctaactacatctttctcgttaaagaattttgatttagtcagttctgctgtcattttagaagtggatgctttaatcaggcgagattttaagtcagacattcattatattccataagtctccattatatttttctcacaggttaaaggatagggtaattatattaccttgttcttgaagctattaacagaagttccatttcttcttggtgttataaaccactgtttccgtatctatttcataatgcattttacatccaacacacatgccatgccaccagcaatgcattccatctgagccagtagttccttcatgaacaaactcatcagatttacatacgaagcatctgaattcttcagccttgaatatgttaccagctacatcagatttattatagatgttcataagaggtcctttgagggctttcgccctcacagatatggttctaccttaccaaactcgtggaaggcctgagatttcactcgagtgttaatacacatacgaattgatttcagaggttcgttatcaccgaataacccacgtctttcgccgtctttagatttccaacgggcttgatttgggaaagcagcatgtagttgttcaagggctctattctgtcgagcagtatcacgctgtgtagaacaaccaccaggagactgcaccttaccagatttaacgaggtacttaaacagagccaggtgaggatgacccatgttaattaattttagaaaagcataagcatcttcgttaaggtcaataattccgtaaccaatatcttctgctgtaagtttagtcaaatcatagaaagtattggtgaacccaaaactattctcgcgataatgaccccagcttgatgtaattttgaaaatcggcaagcgagcatggccatgataataaccacaatccatagcagtctctacgtatttgaccatatcatcaaatacctcttgactcattgcctcgccgacaccaagtggaacacggcgatcgtcgcgttcacgaatttcagtcagatgaatggtagtatcatcatcaagcatccaaattcgctgccctgcatacatttcagtaatcagacggcgagtaccagcgattccatcaacatcatcggggacagtaacgattttagcagcatgaccgtgccaagtttcgtatgcttctttttctgattcacgcactacaagatgcggaacataaccttcaggaaacatagtcagggcagtaactgccccggcacgcttataacttggaattacaaactgaatcatttccactcacctttatagtctttctttgcaatatgagtttcaccagtataagcatagttatctacaagatagaaatgacgctcatacacgtgcaaagacccgacgttccaaataatgtcgccaactgaataatttttacctgatgcattcagaagtttggttaactgttccagaacatagagctgccatgcatagtcattacgatatccaaatactacatcatttgaacgcatgtttacaacagcatgaactttattatcacgaatcagatactgaacattgttagtacacatgaaatcactcatgccatcgcgctcaaaatcatactgcatttgaggccgtgtataaatcataattccgcggcgagaatcaggattactgataagttcttttgcacagttagcaaactgcgaatagttttgtgatgaccaaactgcccagccatagttagaattaatctcaccatgtttggatgcaattgctttccaaatagctggggtttcacctggaatatctttaacgaataaactttgagatttataccactcaagttcccgagcaatatatccatcattaactgcgccaaaaattaggttttcatctgcaataaatgatgcacctacgatttcaatagtcttcacacccgtcttatcaatcacaaattctttgttgagcaaagcatcagcgaattcttgacggatatcttgtactgtcattggagttacaatcatgagacctcttatttaacttgctggataataattgtattctgctgtgcgttagaagcagaccaaatcagcgcaattaaccaaccgataatggaccaaccgaatactagatttgtgataaagattccaccccgtgatttatgcttacgactgcaagctacaaaggtcggcaaaaaatagatgaagaaaagaatgattaaaccaaatactgcttccatgttaatctcctcagttagacatgcatttgttgtagatgtgattttggagagattttaactgctccatacgttgtttatgctcattataactcaatccgccgttagcaaaatcagttaaacgaatctggtcattcactgctgccgcttgagcagtacatgtacgttctttttgagttttacgcagacgcttaatttcttccagctcatgcttattctgctcaatcatgtctagttccatcgcagatagctgacgattaggattagctttttctttcgccaaccgacgctcaaccgcgagcgattcagcagagacctggttgctagcacgatagtatcctacagtaccgccaattgctcgcacctgtccaacagaagaagccgggacgatatcaccttgtggcatttgacaaccagtcagcgtgagagcaacgataacagcaagtaacgatttcattgtaatctcctcagtatgttatttcgaaaaccatggtaccacatccttgtggcaaagtaaacaacttttttaaaaatcgaacatgtcaagaagagacgatttctcttcatagtctaaccctgctgcttcagacatacccgtcagaggtttaacgaacgatttttggaacagaacactgtggtcaagccacactagaacttcctgtcggatttcttgtggcagctcagtgcccgatggccatgccatgcatttctcaccgtacgggttaccttcacgcagcgggatgaccatcaccttctcgccttccatgattggtgttataccttcaaagcccgcggtagctcggttatacgctaaagcacctttgacgtgatacggagtacctttatctggatatcccgcaccatcatcatacttaccgatgttgttggcggtcttaacttctgctattactttatagtcaagttcacgatactcagactcaaactgcttataatattgctgtaaagattcttcaccttcctgcagcatacgccgaatagattcttccaacgcattctgaacagcagttggtgtagaactttgctgagtttccatacccatgattttcaggtgcggttctgcataacgagtaccttccatatcatacacgttcagagcatatcgtttcttcgctttccaaaatccaccaatgccgtttgaacctaacggaggacaagaaatagcttcacggtccatgaacattaaatgttctttgttgttcatgtattcacacatctcacgatatgattggtcaatccaaggttccattttcttcttaccgaattggttcaggaattctaccaaatcgttagtttctttgaaacgctcaagacctactttctcaataaccttatcaacacaaacgtaaattgagtcagtatcaccggctactacaaacgaatgtccttcagtaccgcataccttgttgagatattcattaactttacgttcaatccattggattgccatttgaccaaacaaggtgattgctgatgcgttacgtaaatcataataacggaagtaaatgttacccaatgcaccataaagggagttgatcagaatcttacggtttaactggttagtgttacccaagatttcagcgtgtttacattcaaacatcagtttgtcaagacactcttcggtatatgtcagcagttctgctttcatgtcatcagagaaatcttcatagacattaacttctgcgaatttatcgatagttccaaacttcttatcattcagaacctttttaatcagttcttgatttcgtttggcacccatcattttatttttccactctttacgctgataaaataccttcgcgatttcaactggaatgacaccatctacatctttacgatacatccaaccattgggtgaacatgaatattcatcagacggacgaggagcagtcttgttaatgtactcacccagcggatgaagtttaaattgtccaacgatagtttctggtgaaatattaacttgtcggattattgacggatacagagatgtcaagtcaaacgacatgatataacgatatgcagcaggaactggttccttaacatacgcaccaggatatgactgtttaacgtgagaacgactttgcggaataactttgtcttgctctttcagactgttaaagatgattgcgtcccaggttttaatcgggctcattacaccttgatatggcatcttcgcataataagacattgagattgccaggtcaataaatccacgaacagcatcaattgcttgtaccgattcaacgtcgatgatgttatatgaaatatatcgttggtgattagtttcacgcaatttattgatcggaccatcatatgctaatttacctttcttggtttcataataagcaatgaaatccaacttatatgtcggttggttcgtgaaactaaatttcttatacaaatccatgtaatcaagaatagtcacacccatgatagaataaatttctttatcaccatacatgtttgtgataatcttagatgaaaccttgttcagaggagagaaccgtttcatcgtacgctcaccaagaatctgtttcacacgattcatgatgtacggaatatcaaatccttcaatgttccagccagtaaaaattgctgggcatttctgttcccaaagattgatgtactcaagcatcatttctttttctgaattgaacggcatatatactacgcggtcaagaatatgttgtggaacttcatcaccgccttcggaatctaaacgagcagcgagtttcttgtcccactcggaaacggagccataaagcgaatgcagtaaatcaaacacatagaacttatcatcaaccgaatcataatgagtgatagcatcaatttcatattctgctttcatcgggtctgggaattgagatgcagtaacctcaatgtcacagtttgcgattcggatgaattttttattatagacgatttctgaaccgtaagtatcactgatatacgcgagtttgaaatcatccatacccattgcttccattcccatatcttccatacgacgcatccaatcgcgtgcatctttcatggttgggaatgtattcttcttgcaatacttgccatagatgtctttgtactttgtttcttccatgcaatgactaaacataacaggagaatacggaacacgacgcatgcgttcctcaccagtagaatcgatataacgttctacaatgtcattgcctagagtttcaacgctgatataaaattctttcatgggtttcctttgtttatagaccgagttattagtctttagatgggacaattatactccaatttttataaagtaaaaggcccgaaggccttttcttatgcaccaatcgtatatttagattttaaggtccattcatgtttctgcttgaacgtaatgacccggaagttattctgcatctgagcaagagtttgaccacgattaatactcagtagaccccagtcagcaagtagttgtgcgattgagtctcgacgaatttcatcttccaaatcaatagtaacagggcgaccatcaagcttcagcatttctttaaaatgaacaatatagtaacgaccttgtttctgaagaatgtggcagctttgatatagtaccttatctttgttattagcaattcccatacgggttagagtttctttaactttcaggaagtcttcaggctgtttcagtgtaatttcaatcatctttaccattccaatgctgttttcttaagagttttctgttctttcacgtttttcgtgattgtcttgaccaattcatcagtcacaagacctttcattttcttgagagcaggtttaagcttgtttttagcttccagggtctctctatacatcctagcatcaatcgcattgaccttgtaatatgtcattataacttgaagaatcaatgcatcctggatgttttctgttaacttagcccatttaccataccgacgacctctaggaacagaggccatcatatagttatagtgtgcttggtcagataacccttgaccaacaaggttcataacataaaccgaaggcatacagtcagggtgttgagaaagagcgttttcaaccatgaattttgaataatccatcgtcgagatattcaaatgctcttgcttttcgttaatagacccgataattgtgaagaattgattttctgctttttctttatatgaatcagataattcctggactttcgtccagtctttacctaaccacgctatttgatgctcgttatactgatcatcatcttcaaataaactcatcatttccactgcatctctacaacaagttgaataagcatataaaccaagtgtaattcaatcgaagctgctatgccatgatactggttattttcaccgatgatttcatacattcggataatgcttgggccagtaaccattgtatacagctcagaagaaagtttatctacaaaccaagtatagtctgctgcatatttcggagcaagagcacggagttctttgatgttcttagttttaatagcttcaatgacatcttcaattgaaccacggtcattcagaacgatagacaagatacctgcatcaatcacacccttagaagaataatgatcaagcatgttaatggtcttacggaattctgggaaattctttttgaccaaagcagctacaactttcttatcttcaactaccacgccttcattttcacaaattgcgagacaacgcttgagcatctcgatttgcattggcttaacatcagatggagatggtttaccaaaattaattacacggcaacgagactgaagaggtttaatgatgccatcaaggttgtttgcagtaatgataatagtacagtttgtgctatacgcttccatgaatgaacgcagatgtcgttgagattctgcaagacctgcacgatcaaattcgtcaatcacgataattttctgcttgcctgcaatagaagcagaacttgcaaatgcagttaacggtccacgaacgaaatcaattttacagtcagaaccattcacgaacatcatttcagcattaatgtcattacacaatgctttagctactgtggtcttaccggtgccaggagaagtgctatggagaattaaatgaggaatttttcctttagctactaaagctgaaaaaatttctttatcttcagcaggcaatacacactcagaaatagtacctggacgatatttctgttcccacatgaagtctgcttcgtttactgtcaatttcatttatatttcctcattcagattaaagatggggccgaagccccgaaattattactcaaaatcaaaggtactgtctgcttccattgctactacataagaggctgatgcaccttcaaatttcgctgcagtctgtttcttggagccattcatttttgcccacagcatcagtttataatcgccgatagtcattttcatattgctcatgttgatgataaagttgaagttaccgtcaccttcataatcaccgagtgtcagggaatacttcggacgggtcagtgcagcgtcttctactttattataaccgcgcagaacaattttaccatcaacattggtgatagcaattgtgtcaatctgcatgccacgagatactcgcatcagctgttgcaggtcttcacctttaaaatcgataattacgtttgccaccgggaatgggattggtttagtcgggaacacgattgtgctcgggtcagctgctggccagaagatagttgagcgagcatctttaattgccagattaccatcttcctgcatgataatatctgcatcatcaccaaccagagacagaatgctcagaaaactgttcaggtcataaattgctacatcagtatcgatggtatcagaaattgttgcttcagcataagtcgtaccattaacagcacgagtcatgataaaattgccaggtttcagcatgataccggagttgatggtggagaagtttttcagaatgttcagagtttctttagagaatttcatttcaataccttttaattaagttcaggataattatatcaagctgcgaatgtagcagttaattcttctgcaacaatctgacctgccgcaacgagttgctcatcagcatctacgcagtaatcattttctagacgttcgccaccatgacggtcagtaacaattttagcaccagccttgattgattcgttgtaatgcttacgcatcagttcaatccatttttctgcgacttcatcatcgatagatttatagaaagcaaagcgagcttcggaatctttaatcttatctttgatagcctgtttagtttcttcggtcagagccagaacccaagacttacgaatacgattttggttattcgggttggaatctgcacgtacgtttttaacctggatatctttcacatcaacaaaattaatcattatatttaccttaatcgtaataatcttcaaccatccaaccgggattcctgctggacatgactctattatattcatttcctgtaaaagcgtttcgtaacatttcttcagttacgagatgttgctcattagaaaacaaattaattaacacatagcgctttaattcaggaaaggccaacagatgttggcccgtagtaaactcattcattccatcaccgtgaatcgtccgaccttcttcatttgaaggtgttggccatatgcctgcgggtcgtggtcacggtgagaaataataaacacattagcatctaccatcttattcagaatagcagttattgccttaacaccttctgcgtcggtagccgagtcatagacttcgtcaaggaacaaacagtttattttaacaccagaaaccttttcagcaatatcacgccacgtgaatagtaatgctatatcaattcgagctttttcaccttgactaaacgaggcataactaaattcttctcgtccacgtgatttaatcgtttcagagaactcttcgttcagtgtgaacgaataatcagcttccataatttttaggtagctgttaatttgcttattgaacatcgggatgtacttcttgatgatagctcctttaataccggagtctttcagcatttcagttaaaataccacgacgatatttttccataaccaaattagttttgacgaggataattttatctaattcttcttgtagcagtttaatcttgtctgagttatcaataaactcctgagatgctttatcaatagctgctttaatgcgacgtgccttttccacagcagtgatagtcatttgctttaaactagacatttgagttttgatatctctggcacgtgaccggacagtgttatactcgcgagctagttcatccagttcactctggcgcgtctttaactcaccaagaatggtattacattcttcaacatgatgattaatcttagtgattagagtgtcattagaatgcaaatcctgcaagcacgttgggcaatgaccacctttatcatacagtccaagaacctttgaatatgattcaattttagaccgaattttaaatgttttaccttgaacttcttggattgactctgctgggtcgtctccaattactaactcaagcagttctctctggagagtttctaattctgctttatatcctcgtgcctctttcacctgctcatcatacatcgcctgcaggcgagctacgttatcaccagaaagtttcttctgcttttctgcatactcatgatgagttttaatttcattagtcaatgcttcacgctgaacatcattaacctggatttgctgattgatttctcttatctgtgtcttgttcagtttgtccatatcagctaaaagagacacttcaagcaaatcttcaacgagctttcgtctattagcagttgataaccccatgaacggagtatatcctgccgttcctaatacgacaatctgcttaaacgatgtgtatgacatgccgatgagactttcaaagtaagattgaaaatcctttgaacttgcggcttcatcaagcttattgccatctcgtaaaatctcaaagacattcggtttttgtccacgtttaatgtagaaactatgaccgtcatactccatccacagttctactacagagtccttcttattgaaggagttaattaattgacctttcttaatatcacggaacggtttaccaaataaggcaaaagtaatagcttcgagcatagtacttttgccaccaccattcttacctgtgattaaggtcttttggcatttatcaagttgaatgtcaatggccgcttggccaactgacattatattcttatacttgacacgatttagtttaaaagtcttcactgattttgtgcctcaatgtataactgtttagacataacctttaaggctttgatatcatctgcggacaggtcttcaagtgcttggatatattcttccattaaatccaataagcttttaacttctacttcttcgccatcttcagactcaaccgagttgtcaactttagaaacagttcttaattcatgtactaccttttcaagttctgattcaaacttaggaaggtcttcatcgaccgcagtgataataatgcgtactgcgagattacgaaactcttcaaagtcaatttttccagtaacaggataaatcagttttctatgccaagtgatttcattagggacgaaatcaaaggttgataattcagtgtcttgaacccagaagccacgtgggtcgttctcgtcacccgctgtaagcgtccaaggcgttccgatgtacttaacgtttgctgcgcttgatatggtgtggaagtgcccagaccatacttgtttgtactttttgaggaaatctggttccagcccatgagacttcattcctttataaaaataaaagccattaagctcccagtgaccaatacagtattcagcagacgattctttgatatgcttcatgatttctgacgtgttctcttcacacatccatggacacaagtcaatcaaagtcccatcaaaatccatagtcacgggcttttcaataacagtaatatgcttatacttaccaagaacttctgttgatgcattaggcgtcaacgtattcttgtagtgcatatcatgatttccgacgatcgtaattaagttaattccttctttctcaagagactccgcaatttcacgagcgaattccattgtcttatgagtgatagctttacgaacgtcaaaaatatcaccgtattgaatgatagttttaattccatgctttttggcataatcaatatgctgcttaattccgtgtcgttgtacatcctgtacccacgggtcatctgcgcggacacctaaatgccaatcgcctgagtgaataattttcatataacctctctagtagagtttaattttatattattccatgaatagcaaaaagggcccgaaggcccattacttattttgtcattaactcaaattgttctttaaagcaatgctcagaatcttggtgttctaccaggaattcaaatgctttatttcgctctttatcatagagcttctggtcagatgacagatgtttcattcgttcaaagacttcatttttattttcatcattcaaccacagaatgccagaatcatgagaagtcaacggctttccatcaacccggaatttcaaagcatcaccagtagctttatggaacacaggaatagttccacaagcgcctagttctaaatgcgtgtattccagcgaacgctcaaggaatttatctggaagacgtgacagctgataaccaaatccagactgagacatacgctcaagcatttcagagttaacatatcggtcaagaacttgaggattcagacctggtccagttttaacctgatgataatgacggcaataatcaatttcatagcgttctttgatgttaataaatgcaggactgcgttctaacccttccaagatagtcgttttgcctgcggggcgcagatgactttcatgaaagtcaaacatcaagaaatagcctttccacgtagtagtacgaccaatccaacgatgaatatcaaaatcaatagcagagaagtctttccaatacttatcacgaattgctttgatgttcatagcaggttgaaagttataaaccggaggagctgagtcagaatcatcaaagaaactcaacccgccgcttggaaaatattcttccattagcacggtattaaaatcgccgtttgagctatgactaaacagtacatcagcacgcttaacggtttcttcaagaccagcatttctacgaagtgacaatgctctatggtcatgttgatatacgactaccctaacttcaggtttaatgttctctatgagcttcttatagttatcaatcgctgcttctggagcattgatagcaggtactgagttaatgataagaatgtcacatgcgttaagcagagataaagtcttatcatagtcatctgcaagagacacaggaatagttacatctttatagctatgtgctctattacgagtaaacgctttatctttagcgtaaatgatatttacttcatggccatgttttactaaccactcacggtgctcgagactgaacttggttacgccgcatccctcaagtccgcgagccattaaaatattaatcttcatatgttgacctttgttgttaattttgaatattttaccattcccgtaataaagcaaaagggccgaagccctttaaattttcttgtatacaacataacccgctgcttcacatatacgcttagcttcttcaaagcgtctaagcatatctaccttagcattatgaatcgcttcataatcgggagcaggtgcttctctccgagcagtatcacatttataacagaagtaactacgctttggtcctgtataacgttctgaacaattactgcaccggcatgtataatttccttccggccaatcatgtccaggattagaacccatcaaattcgtcatacatcccaattctcttcactagtaataaaatcagggtgttcatctaaatcaatgaatccccagttctcttcatttaccattcataccaccgtttaacttggaaggtgtcaacccagacaagagagttcttatctattagcttacatccttcggtagagcctaacacgcgatattgattatctgctacctttactgccatcgtaccagtcgcagtgtttaaagtaaatcctgcgtctttacgaacacgtttaaattttacttgtaccagcatttagaatgtcccaaacagatttacgagaggtattccaacaagtcagaataatctcatcattaaaaggttgttttaaaatagtacgcagtttttcaatagcatacttgtaagcagggaaattattgtctaataccgcgtctccagcatgagctcgtaatcgctcaagttcacgacggtttttacgaacaactttgttggctcgagcaatagcttgttcttctgccgcttccattagtttctgttgcagctcgtcgcgctcttcctgggtaatattgttcatgttattcctttggatggtaatttatttcaaatgtgaattcagtatcagtccaattataactgtgttcaattatagcagaatctgacctgaaatcagcgtcatgtggatttttcgggtcaatgtgaatatcaagatcaagcacctcccttaaatacatctttagcaaataagggatagcgtctaggtcttgcacatcttctaaaaacccgtcgaggttaatcttcagcctcatataaaaattccagattaggtccatcgcttgtaggttcgctctttttagcagaccctggcgccttataagcggtggattcatactgcgtcattttatcgtagatgtcctgaataaaggtttcatctgctaacgcaaccatatcatcgtcccgtgaatcatacacgttgtggacaaaatagctgtatttctttgccatttctttgcgttcttttttgatacgctgaacgaatgcattgaaacaagcttgggttatatacgcatgcgggttatcatacttagtttcatcgaagttgattaagcctttaattgcggcttcaatcccgtctgaaatcatttcttgcttccaggattgggtgtatcctgaaaagttgaaacgcttactcagaccttctgcgatcagcataatagcaaggccgatcgtatcgttctgttttactactcgaggaccgccagcagcttcagactcccgacacttctctttccatgcacagattgatttatacagttccttgttatttacataattactcatattgcctcttcgcttcaattaataatatctattataacaaatttgggaagcgagaggattaaagcattacttaatcaattcagcgcatgcaattaatttcatcatgatacgataaaaatcgttatacgtgaaatctaatggaacatcaatgacggcttcaaaatcttcaaatacacgctccattccataaccagcgatatcatctgattcagcataccagtacgttccatcttgtgcaaaagttatttggctattttcaagacagaacacacctttaatattttcatgtgtaagagtcaattgaattttcatagttcacccttcataatacgatagcattggaacagctgttccatgatacgtttgaactcaaccaaactaagttcaaaccaatcagattcatctacttcatgcatcatttccatgaatgaagagtataaactttcataatgggtttcatttaacatagaggcatgcgtttcccaatacatgccctcttcattgtcaaaccaaacacccatataagaatctatagtaaatccgccaatgccttctactacaatcataatttggtttactttagccatgctttcaccgagtcaatagcatcttcaaatttagagaaagcatccacggatgtgtattcattctcaccagagcgttcataaatccaaaacgcgtcaaaatcttcttcaatgatgaattctccgttaggagtttcaatcgtgtttctgccatcaggcgttttagatataaaccatccaagaaaaccaacttctacaatttgttcttcagtcatttagaatttccaccaattgattatagtttaatgcctttccagaagaaatcataacattacaaaatctgtataatgcttcttttgatactttatacacataatcagaagttgttataatgtatgaaatacgtacaaatgttggggatttttctgccaattcatacgccagttttctagctctgccaatatcatcggcaaacttggtatcagcaagcaaaatactatcaaatacccaacggttagtaaaaatttctgtgtatagaataaccttacgcatcaagatactctcgcagttcctgctcgtttaacccttcttgccacatctctgacggagatggaagttggctgtctagagtggatgaatcaattggaaatactctgataattacgctagtatcttcatcccattgatttgcgagtatccgtttagcttgactaatgtcaggctcagaatgagcccggatatacttaatccttctatgccatacaccggtaggaatagatgcgcacacgatatatgaaatcatttagccgccttaaccgctttaacatcgcggaagcctttcttacgttgattcttcatcttacgaatagtgctttcagaaatttcaccgatacccggagtgattggttctacaccgaaggctttgatgccaaattcagacagaagataagcaaccactaattcacggatgcgggctttaccaattttttggccttcttctttcatcgtaccgtgaagctcaacttcccactgatcaagcaaagacggagttacacaacgtccttcttccagcattgcagatactttatcataagcaaaagagttcagtacgtttttgattgcttgggacatattaatttcctcagtaacgattgttttgacagaggagattttaaatcaaatctcctgtagcaaatcaatctttgagagattttaactcttcgagcatatcgtagtattctttactagcaaccggagctacagtacagtggtagctattgaattcatggtatttcacgaagcgttcaagttgccactcaatcaggttgttaattcggtgaagcagaaccccctctgaaccgacgtagacaactacttcaaattgaagcccatcccaaattctggtacggacgatatcacctacattaaatgttttcatgcgatgtaccaatgttcgttttgccaagactcacccttgtaccagcgagtcatatcatatccattttcatcacagatgaccttgttcttcatcaagaagtattcgtcatcagtaaaatgcacatgctttactttacagcctttactcatagcttctagagcttcttgccaatttaaccagttcatattttcctctcgagttaaacggtatgctgttatccgttgatagagctatagtatcactcatcaactagcttgtaaacaactttgtgaaaggagtttaaaaataaaagagaggtcccataggaacctctaaatgaagggtatagaaatatacagaaggtggtcaagatgaccttagaaaggaactggttaatcttctatgatatctgggtcatgcccagcagcaataagattggttttgaatgttggaatgtcatactgcttaacgttatccataaaaatgacaggataccgaatagcaagcgatggatagcacccgatgcgtttagcaagtgactcaatcaacggacggtcataaaccggttgaccgtcaacctcgttgattacgttataaaactcatacggaagttgtagcttatcgagcaagtcacgaactgctttacatccagggcatctccaaacttcttccgggatgccatagatttctatcatagttcagccttaatctcagaaatcaatctttcaattaattcaagtttatccgctgtagtcataggataaattttgtcaacagtggcttcttcgagatagcaacggtcagcatcattgagtatacaccactgatcaaaatcatcagcatctatgctaacaccgttgaaggtcttaactcgttcaacagacccgtcctgtgtcagagctgttaccaaaaatggcttaaatttaagcatgttgtagaattcaacatcctttgacgatgcgttatttagccatttatcaacagagtcttctttaaacttgtaccacttatcgcaacaaaataattctatcatttcatgacctgttgaagtttagcagtcagagtattaacacgcttctgaaattcttcattagacagtttttcatctttcttagtaggattaatccagtcagaaataatgatgagaacaataaatggaatagctacgaaagcacctgcggttaatgcaaccagtgcaataacattagaaataaatttacgaatagcattaatgaatttcataattttccttaaatagttaagatgaatgctgtcatagccagaaattctggtccaaacagttcagtagccatgtggttcagagtaaacataattttgtaagtcagcatataaatttcctcaatcatgtgtccaggtagaaccgtttcttacccagagtctttggttgtcagaaccacgccagtttttagtagttggcagtgatttctcatatttcccatcaattataacatcgatgtgttgtagcaaatctaaatctttgatatcttcaaacttatatcctgtccacatccagatatctttctccggaaatcttgctttaacccaagaaactaaatttgaaatctcttctcggttctgtggataaagtgggtcaccgccagttaaggtaagaccttggatatacgatttgcttaagtgagatgcaatttctttaacggtattcatagtgaatagctgtccgttacgagcattccaagtagatttattataacacccttcacatttatgcaaacaccctgtgacaaaaagaacgaccctgcatccagggccgttcacaaagcaacatggatatattctatcatagttcatttatatatttccaattatagccttcaacacttttgcgttctccatttaaacattttaaaatatttcctttactagaaatgttaaaatatttcgcagcatccggtatatagttaaatgtttttaaaagaacaccgtttttatatgcaccaaatacattgagagtatatttttctcgaagacgctggtgctttcttttcataatttcaggattttcatacgccagctttaatgaatttttgtgccgctcttttacttcaggcttttgcattgctagcttagttaatctagaaattttgcttctaactttatcgtctttcattgtatttgataaatttaataaagttttatttctaacttcaggattttgcattgctagcttagttagttctgcatgtctttttctaaaatcatcattcttccacatggtcttagacaattttgacatagaatgatgaagcagttctctttcttttgaatataatttaagaatttcatccaattcgtcagtattaaatctattaacgtttgagtttatcattctatgaaaggcataacacattttaccgtttccagtttttgccaaataatagtgagctaacgcatggtcatagtatgataagttaacgatattccatttatctgatttatgctcaggaaatatagatttaggaagcacatggtgtgcttccgtctttccttttattttagaattattgtaatttctttgtattaaagctgtatacgatagtaaatcgttgtcatcttcgaatattgaagatagcttatcattcacaaaatcagaagggtagattctgtcgaaattcattgaaccttacctcattacgtgcttctacttctgcatcatatttccagggctcatcagtttgaatagccccagccgataatccactttcggggtcacgggttatagcaattccaagcgggtgcagaacctctttgttgattttccaaatcaatccccattcgctaagttggttccaatcaacttgcttcattggtttctctaacatgttttaccctatgcataatttctttgttcttaccaagattgaacccacgctcagaaggattaccaagatagccacaggttctgcggatggtattcattttctttggatcagtttcaccgcaaatcgagcaagtgaatccattttcagtaggtgtcatctcatgagtagaaccacaagaaagacatttatctactggcatattaacaccaaaataatccaacttctcgatagcatagtcccataccgcttcaagaccttcaaggttgcgcttcatgtcaggaagttcaacataagaaatatgaccacctttagcaatagaatgatatggtgcttcgcggtcaattttttcaaaaggcgacaggttttcttctactgacacatgaaaactattagtgtaccagcctttatcagttacgcccttaacatcaccaaacttggcttggtcaatcttacagaaacgatagcacagactttcagccggagttgagtacagactaaaggcatagccggtttcttccgtccacttgtttagcttagtgttgatgtacttcaggacgagtttaccgcttcctttaaaagtaagcatatcaaattcgtggatgccaatatatcctaatgaaattgaactacgtccatttttgaatagctcaagaatttcatcatcaggtttcatacgcacaccaaaagcaccttcctggtaaagaataggagcaactgacgcagtaacaccttcaagtgatttaattctagttaaaagagcttctttacaaatatcaaggcgttcatccagtagtttaaacagtttattactgtcatctgaacttttataatttgcatccagagctatcctagggaggttcagtgttactacccctaggttattacggccatcaagaacgggtttgccagaagagtctctccaagcaccaaggaaacttctacagcccattggagatacaggagtttctgaacctgtaattgctctattatttcgagcactgatgatatcaggatacatacgtttagctgcgcattctaatgcaagctgcttaatatcatagttcgggtcttctttacgtagattaatgccttcttctacaaacatcacaagctttggaaagattggagtaattccatcgcgacctaatccacgaatacgattatcaagaatagctcgttgaattaatttttcttcccatgacgttcccataccaaatgtgatagtcacaaacggagtttggccatttgagctgaacaaagtattcacttcatattcatatgcctggaaagcatcaaatacatctttctcggttttagaaatagcgtaatcttttactagagctacttgatatttgcgtgcatcacgtacatgtttagcgaatgtcttctccacataaggagccaatactaaatcgacgttagcaaacgtagttccaccatactggtgagatgctacttgtgcagtgatttgcgccatgatagcagtagctactccaatactcttaggagtttcaatttgagcgttaccaagtttaaagccattctgcaacatacctttcaaatctactaagcagcagttagtgaaaggcaaagctggactatagtccatatcatgaaaatggataacaccttctttgtgtgcttccattacagagaaaggaatgacctgattggcgatatgtttagatacgataccggccatcaggtcacgttgggtaggaaaaacacgagaatctttgttggcattctcgtttaaaaggtccttgttggttttattaataagtccctggatttctaattcgatattcattttaaactcttacgaagctgcttcttgtattttgaagcaagttgtgattttccatcactttcctcgtatgtaaacccatgcaattccatttcagcaatcatctcaggcttaccaagacgtgaaaagcgtttagccatatcggcaacatattgcgggtgaatattactgtctttacgattctggcggagatagaccagcaaattctctaaccattcgaggtagtcaatatcttgaccttttaaaccagagcggttgaacttatgcttcatttggccttctgccgcattacacaggttacagagcaagcctctgacctttcctgcattgtcaccttctaacgcatggtcatggtcgaggtgattcttttgaatatcctcatctaaaggacgtttgcagcaaggacataatccgttctgtgcctgatatagtttttctttttcttctttatataacttaccggttaataacatactcttacctcagcgattagataagagtatttatagttaaattaacgagtaactactatagatgttatgattagactcttttatgcagaaagaagtacagaaagcatagatgccttcataatcatccgcattgaactcaatatatgaattagtttcttcatgaagaagactcattttagtccaagccattccattgatgtcatcgtcgtaatagcctccactaaattctactacatcgccaacttcataccaatgactgcgtaaaatttctcttgtaacacgatgaatatcagcgaaatcgagaatttttactgtaatagttttagtaatgcacgatttagacatggcgaactccaagacgggtttccaatgcgacgatgtaatccgcggctttttgcattaaagcatactcttctgaatcacaattttcctgtccagcaaatgcgtaaagagctctggtaattggaacgattgcgccttggaaatggttaagtttaatttcagaaatcagaggaacatcttcaccttgaccgatttctttaatttggtgcatcgtatcttcactgtagaagcaccagaaccaagattctccgtgtggagttgggtcgttaatagtaatgattttgtttgtcagcaaatcaattacggcagtaattccacacatttcaaggtcatcttcattaactacagaaatgacttggaacttaaatcccggaataaacacaggaaattgctctgttaattcgtcatcattaataatgacttcaaactgcttaccaataagtcccattcactttgtcctcataatcaagtaattcatttatagtgggttcagaagtattataatcttcttcaggaatagcatcttcctctggctcgacagtttcccagcgagccgcataccagggttttagacctttgctactttgcatggtgttggttcagaatcattagcagaatcatgttcaatacgccattcaacttcagtgcgagtaaccactttttcatgacgtgtaacgatatctacttcaggaggactataataccaatcagtatgatatgagcctgaacgagattctgataccatgaaatgaacgccacgcgctggataataccaaatttgagtgcggtcttgatacttgtgctcttgcgtccaatctccatcttctactaaaacaaagatttcttctgcatcatcgtctggtgcattaggcggatattcgaaatcgtagttgtcgtcccaaccgccagtgacgccagcgatatgtttgatttcttttactaattcagcgttagtcattttaacctcgcagcttctgtaaatcttcatcatcaatccagctttctaaaccggatggaagcgcacattcaatttcccacagcaattcttcaattgcttgcaagcgttcaagctcttctgctgaaatagttaccatgcgtggagcttttaaatcgccaatatcataactcatagttcttcctcatgttaatcataatttcaccatacactcgccgtatttccatttagacataaccttaactccattagagtaagttacctctacctttgctcgatgatttttgatttgtttaatctcaccggtttctaatccgccatagccataataaagggctacaatatcaccctcccgaaggagggttccacgataatcatgcattgaacttgaatttacggagttcatcaaaaccgccgatatgtgtaccgtcaggagcaaaaatctgaggcatagttaatccaacctgtgattcacgacctaaacggcgaagcaaatcactgataaccacttcatcaaatacacctttttctggcattacattgatgaatgcatattcttgcttcttaacgtcgagcagacgttttgcgttatcgcaaaatacacacttatgaatgctgctgtcgtaaccaaaaaccgtgaacatcttcttctatttccttaaatacttgagcttgaactgttttccaatctgggtggcgtactgctttaacgtaatttgtcataccaagacgcttcattacttcgccatcaatagctgcttgagcaaaatttcttccgcgggtcatagctcctttgagtttagaactatcaactatttgaccagtctcattataataaaccgaatacatgagtagcattactcgttcggcttcttccatatatcgtttacgagccattttcagccttagtagttataactaatgttttaccatctaacgcatcgagaatatctttgatgcaattatctggcattggttgaacgctagctaattgcttggcaatatcatcaggaattcccatacgtggtatatttaatttgctaaaatcaattttatccattagcagttaccgggaagtgttctgccaatttagcagcaatggcagcgttaatttgatcagcgaaatttttattcattgcattaacaatgatttcttgaattcggagattagctctttcaatagacatcttaatacgaccttcagcttgcttaacagcgtcatcaatagtttgacgaaccatatcatcaatagcatttttagcgcatgattgggcagcgttacgcatcatctgcgacatttcttctgtagcagacatatcattccaaccgcgagtatggaacatctgctgaacttgcttcttaacttctgctcggacatctggaatagtcacagcagcaatattaacttcagattgtactgcttgcttcagcttattctgtgaatcttttaacaccatttctttaacgatgttattgattactgactgttgcagttgagcacgggctgctgtaccttctgggaataactggcgtactgcataagtatcaagtttaatatcaatcattttacctttttcactccaggaatattagagatagtttcaaatacttcgtcaaagttatctttatcaacagtgactaccatagtgcgagcggtctgtttctttttccaacgtttaaagaaagttgcaagactcaaatcatgggaagtgaagaaatcatcggttttgtaaacatatccgctttcaatttttactacagcatcaggtgaagggtcttcatattcttctacttcaacatcatcaaagagaattaaagtatcatcatgataatagccttcccagaaggcttcatcgttataaaattctttccaaagcgcgccagttgttttcatttaatcaccttcttccaagcttcgtgagcagcgcatgctaatacttcatcatcagtcaaattaaacttgccttcattacgacgagcaatcatttcattgaattcagtatcagttctaagcatcatgttaagaactgtaaaatccattgtcgctcgaagatattctttaagctgcatagggtcgatgccactttcgtatgcgtcaagaatcatatctgcaatgatgttatcaaagtttttgtcttttatgaggttattagcatactcgacaaaaaacttagtattagcaccagtaatagttttagtaatcattttaattttctctcaaatttatgcttacaagtccggcatttcattttcagaatatcggttgtccaatcgacaagctgtacttgaatactaccacatttttcgcaaggcacaacttgtttagctgcagcttctcgacggtctaccatttcaagacaggcatcccagtcaattttaaattcaggtacaggcggatactcaaactcaatttcaaggtcgttatcatcaacgaccatgtcttcttttaattgatttttcacagtaagctccgggcatactcgagagattcataacgctctttgtattcgttaagcgatttaaccaaatctgccatcatcaattcatgtttagccaattcagcttctttagtatcaatgaaccgcttaacagattccatttcaattgcaatagaattcttagcaatttcaatatgatttactgctgtcatctgtaaaggcttaacttgagctaggtacatatgagctacatcggtatcaatgacatgttttgtcattggaggaaaaatcttaaatgggtccaaatgcacttcaagagtagatgaactttcaagaagcattttgcattggacttcttttactatatccatatgatttaatgcattacgaacctgagccaaaagagcacgtgatggataatttccactagtccaatggctattaatatgaatacgtactgttacgttgtcaagttcttctgcgcgaatactgtgaatccctcttggatttttcggattagtagatacttggtatttcacacgatcagtatctttaagcaaagaaattgagcgattaagaatacggcgcagattgctattgaactcagtacagaaaatccgcgaagcagaatgaccaaattcttcatcagttttaaatgatttagacgcaaaattataacgataagatggaattttagtgtctccaacaatgaattgcttcagttgttcagcagcagacattgcacctaaccaacgagagcgacgaatattttctacaaagaaactaactacattggattcgctagtcgccatattatctagagttcgtttggcaaccttacccgcaattgctacatcataagcccttggatttaaatcatgtaaagctgataacaccttaacatgtttctcacgcttcgtgagagttttatctttcaacttattaaattcagcttctacaaacatctttaattcattcttattcattatcttttcctctattttggactgggctcaaagagtatctcaaaatctccctgaacccattatacaacaactattcatcaagcataataactttgcttggacgcttatagaaagcatgagttttatcatctttcgctaattcaaatgtagcagtaaactgtactttgcctctgtattcaaacggaatactttttggaagggagccgtaaaccgtagctccattctcaagcacaaccatcatcttacattgtacgccgtaatagtcttcataaacttttactgacgttactgtaccagagacggtcactcgtccttccggtgcatcccctttattcttattcagctcattgaatatattatcaaagacctcttttgaatgttcctggatagcctctaagatgctcttatgagctctaacttctgccataacaacatctgtgccatcttgcaatttccactctttatatggaatgcgtacttcaagaggataaccatactcccgaagttctttgtactcttcttgagttaagcggattttccaccaaccgtggtcaccggtatactcaggcttatccagtgaatccaattctgtaacatacggcaagtaactgcctgcgtgataagcttcaacttcacctaattcattttcccaaagataaccatcaaagggagcatgaggacgatcatctttgccccaagtaggagctaccactttatcaaagtattcacgaccgaagcgggtcttcgcccatccagcattcaactcctcggcgcgtttttcaactttcgctcggtgtgcttggcgggctacacgattttcttcaacaagtgcagagataatctcggttaaagttttcattttattctccagtttggttgacgagaccatcttatcaacagcctcgccgaaagtaaactactttgtgaaaaattttctccaaagcagaactgcgtctctacgagatacttctactgctcctagagcaactgcttgcttgcgacgaacatcacacaaatcatagtgtggaactcgcttatcctggaaccaagaacgtttcattccgatggcttctgccatagcatgcaactcatcaagattgtcgctaaacatgtggcagttctttacttgatgacctctcattttccaaccatgattcatcaagacatctacgtatactgtcatttatgattctctatgtaagtttcaatgatgaactgtgctaaacacagaagattatcttctgaaggagaatctactaaattctcaaccatttcagaaatagttccaaaagcttcttcagtattgaacatttcttgaagttcgttccaagtaggtgctttcatttcaatctcctcattagttaacggaagctatcttatcatggcttttctaagatgtaaacaacaaaagggcccgaaggcccttaaaaagatcggaaatcactgttaaaccatggcgactggtgttgtcgccgtttaagcaatttcagttggtgtttcctattgtcttctataatcatcttagaggcttttagctcttcagccaatgagacctgtttacggtccatcaagatgaggttctgggtcttctgggcaaatgtctgaatatctttaaggcattccacagattcctccattcctcgcttatacttggttcgggcagcatttaactgcccttcgtaatacgcatgtatagacactatagtattaaacatgggttaccctttagcataattgacgatttgttcacgatcagcgggccaatttaaatcagaacgtttcttgtttgaccaagcaatattttcttcagcccaatgaagtttagccgatacgctcttttgtacgtctctgatggcttcttcaagataaatgcctaaatctctcgggttagttccttgagttttaaatgcattgagcaaaatatttcttacgacttctttaaattgattttcaacttccgggtgaataaattcacgataaccgttgcacggatatccaaaagcatctaccatacgagtagtactaaattctttgttcataatccgagcgcctcgcgttcatcaggatttaatttagccaaagcggattctttaattttttccaaccgtttacgcttagcttcaggtgtttcttcctgaacactaatagcagcgcttttaggaaaagtccacgattcaccattttcatcggtgaatgtaattagttccgttggcttacgattaactgtaccatctgagccccaccaagactgccccttaactgcttcttcggcaacgcaatatgaaccataataaccaaacaactcactacgacgatcgtctggtgaaacatacgctgcataggcttcactttccgtcattacccagtttttcattttagcacctcataacgaataagttcaatacgatttttaagctcttggtatgatttacgccaaggcttataataggcatttaaatcttggtgttgtttatgcatttcgtctaaatgctttactgcatcctgcacatttgcaaggaaagtatcaaatactttattagcgtattctttcctgagctcaatgaatggaggagcacgaaatacgtttaccattacacgtaattcatgataagaagaatggacttcagctaatacatttttcttatcgccaaaattaaacttataaagtttttcacagattgcttcacaagctttctctgctttacccttaggtttacctgcaaagatgtgtcccggtggatatactttaatatcgtttaaccaacattcaatatctttaatagctgctaaactcattgtacccacgctccgttttcatcaatgtaattaatccactcgttaatagtccaggaagaggtattacctttaggagtatcaacgatatacattccgcctttaaacaaaacacgttttacatcattagaaattaaagtagccattatattttcctcagttagggaggagaaatcctcccgtttaaattatttcagcattgttacttcagcaatttcacgccagtttttacggtcagtcgcgacgaaatcaccgatataaagagcagtacggagagatacgttacgcagacgatttacgttatctttcataaattccaaaacttcaataacttcagaatttcttaacccacggttctgtaacatagaagtggtcattattacatcttgaacacgaaccataatctcttcattagtgtgaacaccaaggtcaagataaaccgaacgtgataccagagcttgaagatgcggagcaagtttagaaccacgctctaattcacggtcaatatcaacgttagtgataaagaccacagtaccttcaaactcaaactcattaggaattcctttatcttccaagaaagaagatgcagtgctccagcatactttacgtttctcccctgaatccaaagcagctttcagaaggttaagaatgtccatatcagagaatacatccacatcatcaatgagcagaactgaatttgcttcacgtgattcccaaagacggcagtataaaccaattcctgagattttaccgttcactgatttgtaatcaatagcgttagtatcatgagcatgttgtaatgctttatccaaagagtaagtcttaccgatacctgctgctccggagataatcagagaacgaatattcccatgaattaaaccgttagtcattaatcccatgacgttaaagcgtttcttgatacgctctttcatttcatcaacggattcaacaacttcaatcttagcagctactccgtcaattacgatatcatctttgaatacccaaacaccgcgctttttaccattcagttcaacaaagactttaccatcaccctgacgagagtcttcagcacttaagctatccgggaaccactcaccgagtaactcataagtacctgaaatctctttgccgaagtaaatccctttcttgatggtgatagttgacattttattctccgttactctgttttgttttgatggagctatagtatcattctacagctccaaagtaaactactttttaattatttttctaaaatttcattgatgtagtaaggacggacctttgaaccaagatagaagtcatctacaaaatcaatcaagttgtcagtttcaccacggatgatagcaagcttagagaacacttctcccaccatcattggttcaaattctacaccgtgagcttcagcagctttaaaggctttatcaatgttgtttacgacgatttctaaagttttcattttattctccattgtatctgtttgggtggtacaggtctatagtatcactagctcgcgagcttgtatactactttatgcattcttttgaaacaaaaagaggagcccgaaggctcctcagttatgcgtgcttgttgatagcgttttctgcgatacgctttggaagtttacctgcccagcggaagaacatgataatcgctccggcaataaacgcagggaaccaaaagatgagataaaaccaatactctcctgctttctcgatggttccatttttgattagatgcttacagacagaccaacccacgataaagtaaattattgcaacaacgattggcactactacgctccaaagtaaaatcatatttcagcccagtaaagtgagaaccggagctcttctccggcccatgacataaattggtggatttgttttcgagttggtcgagcagagaatttagcattttctctacgaccagtctctctgcaaactgcttccaaataccaccgtctacctttatgaggtcttccataattcaagaagaccttcattgtatcatttgtagtaagaattgtggttttcaagataaaccttctcgacgaaatcgtcccagaacttcatgtctactttcttaggcattccattcttttcggcttgatgagctagaatttctacttcatctactacagactcgagaagctcctgtacttctttgaacggtaactcacctgctttgaccatcttgaccattttagcatgggtcagagggaattgaaggtcaccagtcatatagatttcctgaagctgcagacctgcacgaagagcatgactcagtgctttccaatctacaccttcgttagcttctgccttacgagcacgttcaccatattcagcatcaagcttctcaagggagtacttcatctctttgatagtgatagtcgtctggaatttacgacccagaacgttataaaacttctgctcgcctgatttgtggtcaacgaaggtggtccattcgaggaattcaccgagaggaagtttctctgcgatatcctgtactttccaacgctcattgatacccttctgctgaggacgatcgtcatatttccattcaggaacatctctgataacatccaggactttatgcaggtcagctaaacgagaacccttaacaccatacttacctgcttgcttacggacatatccaagataagccttcatgtcagtagtataaaaacgagctcggttgtcttgaatgaatttccatacttcaggaaggtcagatgcaactaccaattccggtggagtatgcagcatatccaacgcgacagtttcaccgtcagcagcgagcttgaagaaatactttaagctgaacagctcatggtcgacgtcgtctttcgtatttttggttgcgctgttattagtattacgattagtatgattcatcgcttgacacaacagaacatcacgcggatgaggtacaaagatttctttaaaatccacatctgactcgggagttgaagtaccatacagatgtgaaccaaaataagattttacgattgttttcataagtaaatatgattccctttagcgaatttaatcaaatcatttgaagatttagcacaggcttcaacatgttctttatcagtactcttcttagaattgcgatgaacattcccgattttctgcatagtatggtagtatactacgtcatggaaatgatattcttgaccgtctggatgcggttcgcggcgggcggttttaataacatgtgtatcatacataggaactaatgcccaatcattcccggtattaatgattgctacttggatatccattttgttccatttaaaggcattaacatatccaagaacacgatgaactcggtcaaacattgcgaatttgatttcagaagagcttgccattttcatctgcttaagcaagctcatagagagtttctttttggttgttacgatttcaatttccataacccaccctcataatatatgtctaaatcaatgttatctttgccgctgtacttgccagtcaaaggaataaatttaaccgtaatcttttcgccgtcatcaaaagtaaattcagcaataggatatgtagaaattataccacgttcggttttagcacgaaagacggcccgaaggccgttcacgatataaacttgatcattcttcactagttttaccttctacataatcaatcattgggcagactttccgcttacgggcttttaaatactggacaaataccgatggttcggcttctgcaggaagacccgcttttactcgagcaagttttttggtatactgtttcttattgcgatagcgtttaaatttttctaaaccaaaaataaatccaaacgctatagctgcaaataaaagcacaaatgctgctataaccactgcgccaactggtactgctacaacatttagccaaaaggcggataaactaacacctatccaagcgagaattcctgtctctgccacaatcggccaaccgaacatccatgcaatagaaccaatgaatatagcaattgctgaagagaacagaatatgaagtactgtggtccaaaagtatccacatagagtttttggcattttccatatattgccagatttaaaccataggttcattttgaaatgccaagaatttttattgatattcattataagttatcctgtttcatagttggaatcattgcggtaagatatttgaccagttcaatagcgtcgcttttatcaatagctacacaatctccgtcacgttcaatttcgatgatagtattatgttcatacgtgtgaaataccgtaagatacaaatcaataatatgcgggctttcatcttcaattactgcatcgcctttacgggattttccgtcccatactaatttactcgccatcttttgcctctatcaagaattgaattaatgaatcaatttgtttagtgtcaagatgaattatatcattgccttgttttagcacgatacgactcaactttttagtgaaatacgaattcacaacctttacatgcacatcgctgtacggattatctaaattggtactatcaagaatactttccataattacctcaattgtgaatcttttgaaccgcggcgattataggcagaagtcattactgtatcccactttccttgacattctacacaccgttgacagcctttaaccaacagacgacgagctactgggatttcctcatcacaatcaacacaaaactcttcggattcccgctgttcttggagttgtttctgaagacgggcccattcaatcccgtctgctattgtagcttcacgagttgcaaatccgtcatctgatgggccccatccattcatttcaaactctccagaatcatttgcaccaaattatatgtaaacatcggatactggtattgtaccacaatgtagatgataagtaaaacgtttctcattcttcgccatcatcaaagtcgtagtaatcataatcacaactgtcaagataagaatccataaattcttgttgacggcggaaatcttcagaaggggtcagtctgtctgcatatgcttgatcatctggatcgctgaacttatcttcttgcaattctttaatgaactgttcagcttcttcacgtgtccaaaacccacgattaagattatgaacagaacgcttttcacctggcttgaatacacccatatcatgggcagaccgttcagttgaataactttcagtttggccagcatagttttcatattcacaaatcacttggaagaaaggagatttacgtgaatatacaccacgaagaccaagttctacatcatatgtgcctgaagcaacaatgtaacgcgttatttcgccggttttagtttctgtgcgattaacaccacacacgtgataaaagatttttcctggttgaagctcggtagttaacttaatcataatgtttttctcgtttggttgttgatatgtctatagtatcatgtaatgaagggaagtaaacaactttttgaaaagaaaatgcctcccgaaggaggcggagggtattactgcaatgataacaaatacttagtcttgtagcatagacctgtaatgtcatccagaacactttggagggcggcaggaactgacttgtagataccatcggccttagctagaatgaggtctagcatttcaatggtgtcctttggcagctctttctgcgatggtaaagccggtgtataactcttacctgagaatcctaaccactgctcaccaaaagcatctatcaaatctggaatctcgttaaagaaaacttcatacgctttatgtctggcatacgatttggtatcaaaatgcgctgaatgaaaatacgcctgagacgccataagtaaaccgatgaattcatcttgtggagtaagtttaccgtcctttacaaaatcattgaatttcattatcgagttgtatcctcatgcggttagcatattcttcacctgctgaacgtcctaaagaatcgcaatctttagaacaagactcactcttccatttactttgtataaaagaatagaactgttcagactcttgcttactaggctccttaaatttagcataaacttgtagagctccctcaacatacgagttataatccgaaatgtcgttgtgtgatgcagctgggagtgaaatcccgcagcccaacaccagggctaagcaaatgtgattaaaggccatacggcctcctattatttttgtccagtattacgtttgtgctgaagtacagccttaacttctttgaggtatttgtccagcttacgtttacgggtataatctgcttttgaactgtgctgacgaatttcttcctgaaggtgcgaaataccatgcccaatctcacgacgaagttcgtccagttgttctacagtaagattacgaagttgcttttcacttaaatgctgcatatacacctcatcagttagtaatagtatttatataagtatgtgttacttaatcccaaagccattcgcagatgccttgctcaatagttctagcacctgcttcgtcccagttatattcttcgtcatacttcaatgcgcgtttaatttcggctttatgaaatagacgtgggatcggcatagcataacgggtccaacgtaaagttttccagaatccatcgcgctttgatttagcaattaatttcttggcctctagcggtctttcccgattttcagaaatacgcagttcaacatatttctgttgggtttctttatctttctgagttttaacgtattcgttatagcttttaatataagcaaattcgttattattctgatcgttccatttggaagattttactacatgccagcctttgcggcgaattgttctagacattattacctcgttaagttaaattacctcaacgatagtaaaatcctgatttgaaaaatttaatattcatgaatagatgaccttgcatttacattttggacattcaggttctttggttttaagacgcttggtagcagtctttggagcagtgttgttaatcatatacatgaagacaacgatagcacatcacatattttttcatattaaaccaataacgaaagcaatattacgtatagtaagaatccaactacgaatcctagtactataccaccgactataacaaataagctactcatgtttaatataacacccatttgtattagcaataaagtctttaccttgagctaatactttgcattcggaatcaagacgattttgaagttcttctcgtctatcgctttgaatagatgctgctacacccatccaaatgaatagcatacttaaaactagcatcaggatagtgttatacgttcttggcttcattataaacacctaccagttcgcaccagtgtttacgacaaagagaaacgtatttgtcttcaccaccaagttctactacttcaccatcggtaatagcatttccgttttcgtcaatacgagctaccattgtagccttacgtccacagtggcaaacgcccttgagctcaacaagtttatcggctacagaaagaagagctttagaaccttcgaataactcgccgcgaaaatcagtgcgaagcccatatgccattactggaacatcatacaagtcaacgattttacatagctgaagaacatgttcagcagtcaagaattgtgcttcatctacaaatacacaatgaatatcacgttgtgtttgtgcccacttgaaaaactcaaggatatcaatagattcgtctactgtattagcttcatgacgaagaccaatacgtgatgttacctcggtggcagaatctcgagtatcaatagcaggtttaagaatgagagttcccattcctcgttctttgtagttatgcgccgcggtaagaagattagctgatttgcctgcattcatgctcgcgtagttgaaataaagctgtgccattaaagggtctccataaaatcagaaatagcattcttagaacgaatgagttcatcgtattcttcgggtagaccatttccgtaaatggcactaatagctactacttgctcggcacctgcataatcgtcaatcaactgccacagtttatttttttgctctttagtaatcatctatttacctctaacaagatggatttagcttttagcctcttcatattctaccactgtaatgtcaatatcaggggttgctaaattaataagtttctcaattagttcccaatcaccgccagcaataccagcaccaatctttggaatgtatagaggacgattataaacaatacgaccagaatttagttcatggaatgcattaaaaattgcgccgtaatcaacatttggacctggagcatactgagtatacaaattatagcaatatgcagtgccattcttgtgaatggctcgagtatgagttccaagcttggctaaattattgtcataataacggtcttcatcgatgtcaatatcgagaattggaggatatgctttagcaagctgtcctgctacaccggcacccattgtagtaaagcaattacacccatgagcgatatcgcattcatgcttcatgaataactctacaatattgcccttaatatatccagtaatcatttattcacctatggaattttataagttgcgtattcattaagattattgtatactcttaaaaatatagcattgttacaattaaggatagggtttagcactccttgttctttaggatgcattactccatcaacagaaacaccgtcactctgcattccacatccgcgagcattatattcgacgtgtggaactattacctggtcatctttatctagataattataaaatgacattagcaattttctactgctaggaacaaatgctatttcaatattgttcttgaatggaccgttgctttctattttagtcccctgtgctgcaagtatagtttcaggatagcctgggagcttttcccaggcattaactgaaaatgcgcagcataataaaatagctgcttttttcattttgatgatagtcctgacatataacgagccattaattggtcacgatacattaaacatatattttcgttaggagcattgacacacaaatctttcatgctcttagccttacgatttattagtgttgtccactgggccgggctacgtgaatcttttactccatcgctgaatgctgaatctaattcaagcgctaatatatcaacgcattcagagttcgtattgcaaaatgttttagcgatacgaagtgaatctgtcattgaattttcagcattagcagagaatgccaatactaatccaagaagcgcggcgtactttaccattattccacctttatatgtagcattttatgtttctttaagaaatgagctttctctaggacatctgacgcataagagtttcctcttttgacattccatcctgcattataactagcaagagcttttcgcatattgccgttatgtatatttaaccaatatgaaagctcaatatatgcccactccgcagaattacgtctggatttaagcatttttcttatttcagaatcactaaggtttttaccttccagtttagctctggccttaacggtgggtaagtaattttgaaaaaccccataagaatgatggcctttacctgcctttaaattggctcctgccgaagactctttccatgatatagcagccattatatatcctaagccattattatcatatcggttttgtggaggtttttcctttccggatttttgatattgttcaccaaaattatatgcgtaatgcaagttgtcaagttggacattactgaaagttggctcagacccaaaggccgttgaacacaaggccattagaccgacaagcgcttttttcatgtttacctcaattaatgtgtataacttttgtgctgattttacctttcaaacgtttatcattaacgaatgccatacgacactttatactaggtccttttcccggtcttggaatatccatagtaaaccctagccacagatttccatccgtaatttctaaccgcatgggtttatactcgatattttcatcaatgtcttttgggtcaattggaagccaaggcattgctaaaaattcattaatttctttaaggtgattaggaattttggaaagaacagagaatacatactcttcatcaatttcacgttggatagcacggtccaacaaatgatcagagtacttagtgaagaaaggctctttaccctcggctttcgcccgggcacgaacagataaattcaaagagcgaaatgcttcctcaaacttacgacgcagtttagttctgcgaatgaatacttctgggttagttgacatagttcattctcctttgtttatagggccatagtatcatggcccgcaaggaaagtaaactactttttaatatttttcttctggttgaaacactgaacgacacgcccacattgaggcttccttcaggtgctgaatagcattgcgaatttgagtaatacgctcatgtgctaaatcaaattctttgtcgctcattgtgctaacatctaaattcatgtatttttcaacatgctcttcttctaatgctttaaaaattaatccaagacgaatttccgcgtctttgatagcatttactttaccaatcttttcatcggtatgtggcttatatcctttgatatcttcaattgccattatagtgcctctgtgaaagtacgagcgataacgtcgcgctgctgttccggagtcagggagttgaagcgtaccgcatagccggaaacacgaatggtcagctgcggatatttttccggatgctcaaccgcgtccagcagagtttcacgacgcagcacgttcacgttcaggtgctgaccgccttcaatttttaccgctggctggtattcaatttctacttcacgtgccttgtagccataaaaagtttcagcatccgtaatagtatcttctttaagaacttttgaaacgattactcgtgcgtcatcaccatcttcgatgtaaatggtgcctttaagttcaccttcaagaatttgatatgctttcatatttcctcttaattagattctttattccaaccacgcatgtatgcggtaattacactcattttattccattcgtctgaatgaaactttgcagctgcttctagataagttattttatcttcatgataagtaacttcttcatcagtttctttatcgtattccacaatttcaataggctcgttaactccatatccgcgagtgcctatatacgttgtagcttcttcccactgtttggttgtttcattccaagttccattctgatgggcttcatagaaatgctgctcgccagaattactgaaccaagcacagaagctttcaactaaatgtggaggacaccttataacaatttcagccattgcattgttttctcttgaatgcgttggtcatatgtgattaaacttgaactaatcacgcctttgagcttaccggatataaactcaattctaaaattaggatagcgattcatccacttcgtgttgggagcattagaaatgaattctgcgcctttgaatgggccagacagaaacttgtagcgcttgtactcaagcaggttgccagccgtaaccattgttattaattgcttcatatcggcaaatcctgtattttccatcactgtaatcatatcaacaatttctgtctgtgtcatcattgcattcctatcacgaaaaataaaggtaaggtatcattaggcatagaccatctgatagcttcctggtacatatcatagaacttcatcatatcgggaactttcattggttcttcaatgataattaatgctcttccaaactttcttcctctgaacttataagaggaatcattggatagaaattccctgattgtcatcggaacaattgatttagctatctcgttagccggtaatttattaattaaatgcgatgaattatattctcgtagaataccttccatcagttcagatgattgtgtgtatcgagtagataagattataaccgaaccatcttcaagcaaccaatcggtagcgaattggcataaggctgcggtctttccggtttgtcttccaccatctagacgaagggtaccgtactctcgcataaggcaagacggttcataaaaactgtagttgggattatttaatcgtctgtctgcagcgtctttgaaagcatgcatcagggtcaaataaattggtgttaagtatttcataagctctcttttaatggggccattccttggcgcatggagtgagtccattccgataccttatgtaactggcattgccacacttgggctcgaccttattacaggtaggcgggaatccctcatagaatcatgaggtccaggttattccaatgttgtttaaatgtaaatatgaatatactatcacaattctaggagaaagtaaactgttatttacctttaattactttagctgcttcgatagccgcttgctgaaggtcatccatagacataccgaatttagaagcaaagttatcaattttcttttcgacagcattcaaaggcttggcctgtttaccttcattagcgccaggaagagcgagaatacgctctttgtcaatataaaggcttacaagtttcttacggtctttatctgacaaatcatgaaatgaatgggcctttttatttatagcggcttctaatttacctgcactcactcgcgcttcagtgataaattctttataagttttcatttttaaatccagaaaggtaaaagttttaaattaaatggggccattccttggcacatgtttaatccatcgacacactatgtaaaccccttaccgcacttgcgctcgaccttattacaggtaggaaaagctacttcactcagaggactcgacgttcatgaggagaggtcgtgttcggctttattaggaaattgcttacttaattgatttagcgtaacgaatagcgccgcgatcgtttacgaatgcaattttaccattacgcatgtacatggtaaccgtacgctggtaaccgttagaagttttaccagactgataacctactaatgcaaagttatcttcaccaggtttgttctgcttagacttaatacgcatatgtccatgggccattaaagagcgtgcatcgccagatgctactgctttgcgagaagattcatcttcaaccgaagagacaaaatcatcgaatgaatcaaacttagcatggctcttattatataacttgccgtctactacgtagttatatccaacaacgtccatttcaatttctgtgccatcttctagtgtggcggtcatcttctggccttttttaaatttcagaagattacttccaacagattcagtcattacgccaactgttgctaaacgggattcatttaaaaattcttgataggttttcatttattttccttgataagcagaccaagttccggtccgcattgtttcaattacacgacgagcacgattaggtgtctgacgataccaacgtgaatttgcaagttccttggcagcagcatcccattttttagtgagtaataacttcattgaagctgggaacccggctacaccagacacacccatttggaataccatgttaatcagagcagctctacgaacatcatctaatacattatataccgggtttaatgtagcattagcaacaatacctttaattgccttctcaacatctttggcaaaaattacttctgcctcagcctgagtaatttgaccaccagtagaacgacctaccagtttgtccagattagaaatagccaaagattttgacgggtctttagtcagtaagtgaccaataccgatagtccaatacccttcgctatctttataaattttgctgtcgtatccttcatcaatacgcagcatgccaaaaatatccataaggacctcctattaattataggagtatttatttggccctgcacttggctatgaataactcaaggctgcacttctcgtatggtgtccatttatctttccaccacacataatctcttctatcgtcctctggaatttcattaaatccgggatacagcttttctgctatgtaatatgttgattttgtatactcgccgtcaccgaagacgtatcgtgatttcaatagtatacgcgacattttatctctaggatgaaatatgctaacccattttccatcgtgaataaatcgtagctcatgcttataaatgtgtggaatgcctaattcaacggcttcttccataataacctcactgagctgtgctatacatttgtgtcatgattttatacaaacttggtcccatcacatatttccactggcttggtttaattaaagcaaatgcatcgatttcaggaaaattaattccattttcatctttatggtaagctgtacaacggcaatttctgaacatttctgggctcacagggagcatatatccaaacagatggatatccttgttgcttgcataatcatgtcgtccaaggtcatataagaggtcttggtcaaactcggtaaatccagtctcttccttgcattcgcgaatagcagcctcttttggtgtttcaccaggctcaacatgtccttttggaatatcccatctagagcctctgccctggatatatgtatttgtcatacgacccatgaaaagccgtttgtcatcggtaaagaataaaattcctgcactgagctctttcattggcattcgttccagctttcttcaagaatatcttccatggcagtatagaccatagactctaatacaccatcacagttatatgaaccctctaccgagaaatcacagataggtccattaataccaagcagttcttctttaagtgaaatctcgataccgctcagtgattcattatcgctgtaacacagaaggcgagtatcaccattttcaaattttacatgcactgcaacagccattatttcatctccttaatccaggataaagtttcattgcgagagtcatctttagatttttctttctttactttgggcttatcaaatacaccccgctgtcgttgggaaacgaattgcaaccaacgagcaagcattgcaaaccaagttccaacacctgacatccaacctagatagtacaatgtatcaccaaatactggtgaaaagaagtagaatccccagaatatcccaacaccaacaaatgttgagaaggaaaacaggataagcagaaataggaagaaatacaagaaatcatcgtctttaatcattccacgataacaagttttaatcattttctgcagctcctaatccaggtgttgaaatcttctttttctttccacttcttgtatttcatacggtaagctaaaaatgtgcagcaattaatcaacgcgataattagcatccacatgaggctgaatacgaaaacacctaaaaataaaagcataatcataaactctgagacgttcaatccaaagaatgtccctccaacaattacaaaagcacaatataaaatccatgtcacgattccaaaagctggcgccagcccatcttggttccaaaacccgtcaggtttacattcattcattttcttctcacctctttaataaactcaaacgactttttgcggttccattcaagagttaaattcttgcactgttctttccattcagcctttcgttcacagttatgcttaacatactttacccaacgaaatagctcaattaatcctagaccaagtaaacctattaatccccatgtaagtaatagtacattcactaatgatgtactgctaatttcagccaaattcattacgtcgattatgataagcgttatcatagttccagcagcacagaccatccccggaattagaacataatcagtttggtcaaatttatagacataattataaacgggaggttcacttggcagatataaattactcatttctgcaccctctcgcggcagtatttgataaattcatcaatgattaattgtttgcctaccatgttgttagagtcaaacatacccatgacttttggtggtaattcattaacgcagtaatttaaataattgctataatcatcctgagatgtcacgtatttaaccagattaataccgagacgataactagttttattatagataatctcgataactactgtatatgttgtggagctagaagtaaaatattcatcggcattagtacgggctgattttaaatttgatggagaatcgttgaaagaataaattccgtaccgaagtgcaaaaatatccacaagcttaactccgtcggaaatagacgaaatactggaaattaagtttttcagcttgtagtagtctttaagaacgatagcccgcggcaaaactgtggtgttatacccgttatagcgagttttccaattttcaggccgagtatcaggatgagcaaatttttcgagaacatcagtgatttctgttgggaatcctgctgcaattaattctttaatttgaggtgttgccattggaatatctccagcgcattcatataacattttattatccaagttaggggcccgaaggccccggtaaaattacttcagactttccagatattcctggacatcagcagtggtggtttcaataccaggctgagtaccgctgaaggtttcaactttcatcatgatgtcttgtacatctactttagcgagttccgcgatttcaatcacgtcatcagcagaggtaatacccagagcagaagcattacgggtctcacggatgtattcgagtttcactgccaaatcaagacgctggtcatcaagcttaactacagtttcttcaatttgggcccgcatttctttatattcggcagctttatcacgtaaagccttagcagtacgacgatacagaagacccagtttagcatgggtttctacattcataccttctgccatcaagcgacgaatttcacgctctttggaagcacctgcctggtctttttcgtcagcaagtttcagcagacgcttttcttcatttaccgatttaacatgcgtggtacgcagtttagtgatttcatcaataatacgatttgctgcagtggtgtactggtcttcaacagaagtgttctgtgcaacaaaggtaccgaatttagaacggatgaattcaacaagttttttcagaatagacattttatttcctttcaatagttatggtggttttattcgtacggattaatccaatcataaacatatggtttaatgattagaccctgttcatttttgctgcgctcgaatatctcgatataatcagtaacgtatgattctaatccgagaataagtacagactctttgccttcttctactgttgctttaattaaacgctcgatggctattttagcttcaagacgaatatcagcaagagtttttggaacttcatttgtatgcattaatgagttcctccattttgtccaaaactgcgatatcaacaagacgattaacctccgggtcatcggcaaattcattgtaagttgaaatcaccaggttctcgatagttttcagtgcagccattcgttcttcaccggatggaaaatttggagtttcaccaaacagcctagcaaaagatttaaaataagtttgcgctactaatttcaacttatcttgatacataccaatttcctcagtaggtggggagttcattataactccccaaaattattagcagttaattaccgcttcaattcgtttaaccaaagcaggaacagttttagcaaacttgatagccatttgaaccgtagcagcttcttcatggtaaactcgaacatagtactcttcaacagcaggccaatctttgcgaacgtgtttaatcaaatctttcagttcacgggtttctgctacgctgaacactgcattctcatgttcgcctttaatccaaaccgcgcgataacgatcaggagtaccgtattgattataaccacgttcaatttggataaagttgaatttagacattttattctccgttactctgttttgttttgatggagctatagtaaccgagttaactggcgttgtaaacaactttgtgcacaaattttcaaataattttagggaatctggaaggactttctggagagtagaatggatttatacagcttgggatatagaaatgccctagatgatttctagggcaataggatttcattatacggtataggataacccagtttggcgacttagttcaacaagatgatgacgcagctgagacagcagaacttttacttcgccaatgtgttgtgtctcatgggcagatggcttagatccttgtgacgcgcgatatttgtatagattatcgagataaacctcaattgatttgtagagggctccattgtcacgtactagcggaatcatctggtcgattgcgctgaacagttcgccagaaccaataatgctaccatattttccacgaacttttagacctggaacatctttcggagcttctttaacaactggcttaacaggttctgctttaggtgcttgtggcgcaggagttgcttttgtggttggcgcagatttttgcccagtcagagatttgaatgcattctgtactttatagtagtcaccaggattgttagtgctgatgccataaagcttttctacggacgcagcaaatttcataaaatctccacgctcaccttttggtaccatgtccatagctgactgccatttaccctttgtcatccgtacggatgcttcgtttaaaaattctttaaaattcattataaattcctaagtattagtgttgatttactatatactatttatactaaaaagccccgtccgaagacagggctctgagaatcgacagcatcacctactggcagatgacctgcgaaattcatttctttggactcggaggcatcagtctcatccaaagaagtatagcgtcaggaggttatgcttgcgacagggaacaaccggctagcggtaatggacgaaccattctcttctatctgacgactcaacgagggcatacgcaagtttcccttcgaattacattacatcgtattcttcaactagatactgataataggaatcgtttgcttcaagttcttccgcatatgatgttgcttcggatttagtgtgaaaaatcttaagaggcaaagaatattcttcatagccatattcacagttccagttattttttactacagcatatactttcatattttcctcattaatttttggtatgggtaggaatcgaacctacaagccattcagcaccagggcctcacgctctacctatttgagctatcacataccagaatttggtgccgattgcaggagtcgaacccgcggcatcttcattacaagtgaagcgctctaccaactgagctaaatcggcgtggtatccccacctggactcgaaccagggactagggtttagaagacccttgttatatcctcttaactatagggacatttggtgcgtcgaacgagactcgaactcgtacgggtttaatcccgggagattttaagtctcctttgtctaccaattccaacatcgacgcaaatatttgttcaggcaggactcgaacctgcacgactgattccgtcggcgatttaccaccatcgccagcatatgatgcaatatgcgagctcaaaaggtgtccgtcaccatgtctaccgatttcaacactgaacaagataattatattactgattatttatagcatttctcaaacgataaagttgattacagaattcgcgttcagtcaaaatcgtttcagaaattttatttttacccatactgtgagtgagcgtagcattccgggtagcagccaaagcttttctgaatccttcatttttactaagtgcatcatatgctcctgttagtaaattctgatatgcttctgaagctcgatgaataggaacacctttccaataaagcgtttgtgttggccaccaacgtttcttcttacctttaaacttagcggactttccgactagtgtacatacatgtgcttgcatttcaggcgaagaaaatttgagggactgcaagaatccctccattgatgcgcattctacgccatcatagataaatttatgaggagcgaaattactcaaagcacatgatggatatgaactacctgaaccgatatccattacttttccttcacgtatttcaaccaatcaacttttaatgggctttctttctgcttatacgtaattccaacatggaatgcaatcggtgcgtcaggaatacgaatttcttcttcaatgttgaagatttctactttctcaaatactcgcatgaaatcatagtcatattcaattggattacccagccaagcctgaatagcatacataacttcatttgagcaagaataatggttatctaaataagcatcaaactcttcatctgtgcaatcatatgcaggaacatcaacaccaaagaatttcttggaaaattcaggagttacatacttctgttcagtatgaagcttttcaagaattgcttcatggttgtaatcattatttccaaggcattcaccacgccgaccattagaagagaaccattcaagaacatgaattacttgattaatctcttccttttctaagccataaaccatttgggtagaataccggtcagcatcattttcccaagtggtaattgccattgctaagcctttaggaataacttgtccaaatttaatatgcatttcaatttccttagttgataatttggtgaccctggcaaagactcgaacatgcaaccaatcccttatgaggggaacgctctaccaattgagctacagggcctttatagaaatcttatgacttttataaaagccctccgaagagggcgccttgtcgggcttatccacctgctaggcagaattactcacacataaaatcagctacttcccagaagtcatttttaactgctactttaaccaccggataaatttcagatgttttaatagaaacaattacatcacctgcgacagtttctaccagaccaacgattttctcgctgcgagcaacaaatttactcaccggatgaaatttaccggtagcagcgaacatagcttcttggtcaacaatcagtgcgatacgtttcattctttttccttgtttgttttgatgtagtaataataacaggttattcttgtagcattaaatctcgaaaatcgttccgttttcccacattgttgtgaacataggagaaaccttaacgaatgatttgcttcgcattgcaacgtagtcgttatctactttagccaatcctgaagcaatatcagtaatgcggccacacttcatagaaccgcgaccacctttattgtatgtgcgttctccgtagaaaacgatatcaccaacttgtacttctcggcctttagaatctttcatcatattttgcctgctgaattcgtttaaaatcgttaacaagttcttttgggtccaacgcattgttaaatggaagaacttgacgtagtttacttactttacaaccagagtgataagcaataacctcttgaatatcacgctcactgaagtattcatatttaatcagtgaatcatatcggcatttaatccatacccacatacctttgcgttcatcaaatgcatatgcaaagtcagcgttaatcattaaatcccgtttagcaaaagatgaaagccctaatgctaaattaaccggtccatccaaagacagcttcaccgtaatagcatttactttatttgcaacaccaataaaaatattcattctatttccttcgcttgttttggccttcttgtcgtgcacgagaacgtcctgctttatgcagtgattcgtaatatgctcggcgtctatcaatgttttctgtacgatatgctttcccgaaatgggatgttttgaagccgtaatatttcataatataattctcaatggcaagtgattggacggtatgcccggcctcgaaccgagtcacatggactttgcagaatccgtgtgtttaatatatcacccatactcgatagcatatctgaacgagactgcaatcccgctactcagcttacaccatcttgtattgtgtcataccgataatttggtctccatagaatgactcgaacattcgacctctccatcccaaatggagcgctctaccagactgagctatacggagtaattttgatttaaaattcttcttgcttgagtgtgacttacaccaatatgtttagcatatttagataattcgcctcgtttagaaaaatcatataatttagaaatttccattctgtaagctctttcatctgtactaactctagctaagtttaattcggatatctttttcttgaattcagccgaatggtgttttcctgcaaatccgcttggcttaccagccatattatctttccatgtaggtaaatccaaggatttcactgattttgaaatctttttcttatgctcatctgataaaggtttattagcacaagattttccaacttttgacatattagttcttcgttgttcggacaagatttcattattacatatgtggtcccatccgccttcaccaccaagctttaagttatatgtatcaggccttttaataaattcttcatttactaggtgtctttccgcatcatacatatctttagcattatcaaaagtttcgagaatttctttttcaaaattttctttgccgtactttttaatagcacgctttaaattcttaccagaacccatgtatccatcttccaacttagaagtagaatgaactccaatataaaacttttgatttattttatttgtaattttataaagatagtaatgcatatcagttcctattaaaagaaccgagcgtctctcgacgagtcacaatttggagcatccaaagggaatcgaacccttatcaagtgagtggaagtcacctataatagccgttatacgatggatgcaaatttggcaggccctgaaggaatcgaaccctcatcactgggtttggagcccagcataatagccgttatactaagaacctgttatttggtgggagtaactggactcgaaccagtcaccgctcgattatcggtcgagagctctaccaaatgagctatactcccatggaaagctaatcatctaattgttgatgtaccactgctatgggcagcgtttaactttcataaatttggcggagagtaaaggagttgaaccctcaccgtttccgatggcccggatttcaagtccggtttgctaccactagcgctactctccaatatttggtgaaggaagtgccatatagacacaattcgcttagcgacaacccagcatgactgtgggtcgtgtatttttccaccattccttcattgttggggtgaccggcggaatttgaatccgcgactacgagaatcacaatctcgagttctaccaactgaactacggccacatcaatattcactccatccatcatgaggacttcatacgaaattaagagaagaatgatcagttcaacccctgtagacgcgttgaatgaatattaatttggctggactatctggattcgaaccagagataccggagtcaaaggccggtgacttaaccgcttgtctatagtccaattatttggaggcggaggcaggactcgaacctgcgcgtgtcgggatatgagcccaacattctaccaactgaagttactccgcatttatccgggttcttgaagtactaacaagtagcttgatgtagaacacgctaaagatataatcttacgaatatagagcttattccgtgggaacaaacagcttcgtcctcggcattatctcacaggactcaaactcatcttcaagaactgccacgttcttatttggcggacctaacggaattcgaatccgtgactctcgcgtgacaggcgagtattttaaccgctgaaactataggtccataattcgctttcagagatactctggcacgatgccgaagcaaaggggaacaggactctcatcaccttggtaccagatgaatcttgtttagcactctgttctaagatgtatccctgaaagcgaactttcaacgccgtaagaaattataacatgaacaagcattaagcaggatgaaatcatactccttaatacaaacgccatgccagggatttctgtgccgacgattttatcagaacgtcttctgacttcttcatttggcgggccgtgcaggtatcgaacctgcctagtcatttctgacacggattaacagtccgtcgcttaccctctcagccaacgacccgaatttggtgggacaccgaagactcgaacttcggacacccggattaaaagtccggtgctctaaccaactgagctagtatccctaaatttggtggggagtaatggagtcgaaccactcgagccttttgagcaacagatttacagtctgtcccgctacccctacggtctaactccccaatgggtaattttatttatactgctctaaaattaatcagagcagttgatagattaataataacaaagaaaacctaaagcatattacacaatcggtgagctctttgatttaaccaggaatacccgatgtggtgaatccatatgagagagcaatacccggtgctcaggaattggacttgtatggaaaggaaccacacgataacctttaggagtaaatcctagcaaaataccaacgcttgctgcagaaagtgacccaccacagtagtatgataccaaatcaccaggctggatttcattgtcaagagaatcggttttgacatgcttaggcgtaactaaatcactaggaattggaacgccttgtgcatcatagtattcatgggcaagaagcttataattctcttgatagaaagtattaaacgcagctctgatattcatcacaatttcctcacaattaatctttgtatgcttcagttgaacctttagcaacggtctcaaatcgggaattcagtatctcaaaatagtcttgatacgttccctggagggcttcatagcattcttctaccgtagaatagacacctctgatttggtcagagccaggagcaggataataattagaccaagttaaaagtgcatacattacttacgtttccagctataatgagccaaaataagaagcactgcaatagcaagtagtgatgaatgcagtgctgccagtagtgcacctagtcctacgcccaaagtaacataatcatacttagttacttcttcacggtgtaaatcatagtttttgatgaaccactgcttaatctttttcatgtgctattttatccattatgaaagaaatgatacccattagaaatgcaacacttaacactgatactgtttcaggaagagacataaaggctgcaccgataatgccaaaacctaacgctcccatgcagatagttgatgcaacatttctaattaattcacaacgtttcattttattctcctcaagttgatagggttatagtatcactactacaacccgttgtaaacaactttattcagcgccagcggcttttaaaagctttttaagattagcagaacctcgggcagaaaaagttaccttaccatctttttcaccgatgctgccggtcaatttagaaagtttatcgctaggaacttttttaaaatcggctaatgtcccgtcaacggtttttgtaacaatcggcagttcatcatcctgtcttttagcttctgtaataaattcttggtacgttttcatgttgcttccgtttggttagtttgttttgatggagctatagtatcaccactaggaccggttgtaaacaactttgtgaaataaattcctatttcaaatcttctgaccagtccagttttagtggctcttggtactctctatcaagcactacaggtacttgaacttcaccctcgaagtgagctggacctacattgtagctgagagtaatgtgcggtgagtaatctgggaaatcatgagttgctcccaaagctcttgcatattggtgacggaattttaagtattctgaatctagcttaagaactagcgtacgtccgtcttgtgtgtcccatacttcaagtttacctgatgtagcaacttcaaaacttcctgaagcacaaacgtatggaacatgaactcttgaatagcatatcgtcgtatgaattttatgacgaggaactggattagggaccttcaactcacgctgaaggtcctcaatagcatcaagagttttctcagagaatttagcagctacatatagaccagtgctaaaatcactgaagttcattaggcatcagcttcttcagtggtttcttctgcgaactgtgcttcgatttttgcaacgaggtcatcaagtttaacctgaccgtcttcgctgatttcaacgccggatacagcaatcagcttctgcagtacttcttcatactgtgcacgcagagcagaaaggccttggatagtttcagacaggtcaaatacacgaactttcagagtatcgacttgggcttgcagttgttcagtagtcatttttgaattcctaatatagtgttgatttttgaataaagttcttctagagaaccgtcgttagttattacgatatcgccttcgcgaatcggaagtccacgctctgtgacgtgagtatcttttttagaaccttcttgctcaggacgaactacatgaataactgtagcacccatcgccctggctacatcaagttcatggtcttggcgggtatctgggacaatgaaataatcataatcaccaaaagtatcagccataaccaaagtgaatcgttttacccaatacatgcgatcgagcttatcacagacaatgtcagtcccaagggtctgcatgagacgacgaattgaccatggctcaacaggtttatttattacaactttacggatgacttccatcgtatcaccgtcaagtattttacgtttgttatcataaaccacaccaggtaaaggcaaatcatgatgaacatattcaatcgcgttcgccatgatacgaatcacgtctttagtagacagatttaaatcttgttcacgatcgtaatcaataccttcaatcatcgaccgagtaatgcgaggaaactgacgtgatgtatcgcgataccactcagtaagcattgcatcagccaacgcatctttaattggacctgctaactgatgctttgttgcgttatagttatccataatgtagtcagcagttgtatctttgccactacgttttttaccaatcaaaaataaaagcttcaaattattacctcatagaaggatgcattcccataactttctgttgatactgggattcgcgagtatcattgacagaaggtctaccagtaattattataccatctttttcaacttcgatgtatttgtactgcaaagttgctacacataccattgctgggtcggattcttcggttaaagaatactcaatttcagataaatcactcacccaacctccgatgtagcggacagttaatactatatcatgtttatcgttatcaagaacatgcattaaaactgcgccaggaaatccttcaccgccgttattccatccagacttgtctcggtcaatgtagttttgacagcttaacatccatttgtacatttgtacccatgaatcaagattttcatctactaaaaatctaacaggaacagcgtcaaactcaaaagtagacccaggcaatttagcacgatgcatgccttgaggcgagcctacagtatcagtagcaggaatatgaattccaggaactacagctgtttgaagattagctttaaacgcttgggtgaggcccccatcagggacctctaatataaagttagttgtgttagtttgattaaacagtccagtagacattatgatttccatacagaagtagcagagtagcgtttgcctttcgacatgaactgctgcagtggtaacatgactacattcgcccaatcagccggttttatctcaattaaagcaccctttatattaccaggaatatatgctttaatcattttgtcagcgccagcaaatcctttaacttggctccagtttatctttaatctggtcttattagatatcactggcgtattagcatactgtttaagaagttcttctaaaaactgctgacgagcctttggcggaatgtagtgaaggtttaacccatacatcaatgtggttgtaccttgctttccaagaccaagataaactatcaaaggaaatttatcccagaatggaagagtgtctttgtgcttagcgtcatacatgtaagcatatagctttccaggttgaggcttggttacagaatgaccacgtatatttttctttatagtttctgcaaaccatttagcagatttattgtttactgctgcgccttcattacgaattttatctttgatagagcttcgaaatgaatttaccatcacaagagcacgctcctgtttggtcattttgttagcaggttttttctcaatttctgctactttaattgccgttttaattcttgatgcatgacgagccattgctttactgaacgtagcaggatttattcctttgctttcagcgaatgatttagacgtcatgccttttttacgagcagcagagtattcaactcctaatgctacccattgattttcactacgggatttagctttaggcgattctgcagcttcagtgataaattcaaatatagccatcagcctttccatcctaattttttaagtgaatcttcggtaattaacctaaattctatacccattttactggcagtagcttgagctgctttccacttatcaacgtttacagaccatgtgtaaatttcatcaatgtaccgtttcttcgctgatgtcgtcaactttgtgggtttgaccggaggtctagtttctttcttcggcttaacttcaaaaaagaactgttgaccattagaaaacttagcccagaaatccatgaaataacggcgtttctttccatcagcattgctgaagtatggaattaccacgcattctgagttccaactaactacatctgggtggttatctaaccaccgcatcatgaaattgctcccaagtagatcggtatgtgatcttacgagggtcccccttatatttgcttaagttttttggtaaaaattttccgctatacgccattaggcttctccttacatttgtcaaagtgccaacacttcattccacgaggttttcctgatttgccacagtgaggacatgttactacaggttgagattctgaaacagccctaagctttgctcgagtttcttccgatctcttctttccggtgttagctaaatttaatttattttggtgctctttagttctatttttagctgcagtagacatgttttgtttcattgtatcgctttttgaaacacctgtcatagaaatactgcgcttttcatttgattctaatgtctgagactttccagtaagagctgcagacagtttagctgaccattcctttgacctttgacttcgcttctttcctgttaatatcacagaattagcaatagaaactcttttgcgaatccattcatatgatttgttatttcttcctgctaatttagaagacatgatatgaactgcgtatgataacttgtgattatctggataaatcttagctaaaagctgatgcgcaacataatgttcagctgcagtcaaatctacgaggttatcttcatcatcagtaccacccatacatcttggtacaatatgatgtcgttctttatatccttccaagctgcgagatttgcctctctcaataagctgatcataaattttacgataattcatattattctcctcagtagttgatagggtaataataccataaaccactcgtcatgtatactacaactttataaatactgttattaatatttataagaggataaactatgctcttctcattttttagtccgatagattattctgcaaagaccgtaaaaggtgctaaggcaaaagctatcccaaccgctgacatatttcgtaattatcgcaaatattttgacactgtggcagaaaactatcttttacaaacatattacataagtggagctcctagaccagaagaattagcatatattctttatggaaatagtcagctgtactggattcttttaatgtgtaataatgtatatgacccgtttagagattggattaaaacccaggatgcatgctatcaatttgcacaacaaaaatatgcagatgtaggtggagaccaaatactctatcacgtggatgcaaacggcaatcgttattataacctcgagcaatatcctgaaaattcaggcatttggtatgataaaggggactttaatcaccagtaccctcaatatactggggctttagctggtgttgacatttatgaagactctattatagaaaatgaaaaactgcgccaaataaacattatcaatcctagtgatattgaggcatttctttctgatattatacgagaaatggaaaaagcacctgacagcgaatacgaatcaggccggtacaaatcccagactacaatcggagaagttttatgattgaaatgaatgattcattaaaatggtttaccggtgttgttgaagacagacaagacccgttgaaacaaggaagagtgcgagtacgtgtttatgggcttcatccatttgaaaaggtgcaaggagctataaccggtcttcctaccgaagaccttccttggatgtcagtgattcagcctactaactcagctggaatttccggagttggctcgtctataactggaatggtggaaggaacatcggtatttggcttatggcttgatgaattcaaaacagcaggattagtaataggaacatattctgcgcacagaaaaactaagccaaactacacggaaggtttttctgaccccacaggtcaatatcctagacaggttgggtcagataccaacccactagttcaaggcgatgaaactgggtatagtgctataccaaacatcatccaagatagaaacttggatattggcattaatcctgacgatgctgacctaagcgatattcctgaagacccaaatcctgcaattacaataacagatatgcttaatagggatgaaggtcttagattgaaagtctattgggatacagaaggatatcctactgtaggtattggacaccttatcatggcacaaaaagtacgtgatatgtctgtcattaataaaactttatctaatcaggttggtcgtactgttacaggaaatcccggtatcattacaatggacgaagcagttgcactatttaagaaagatcgtgataaaatgctttctgatattaaaacgaattcacgggtaggacctgtatatgctaaagtcaacaaatcaaggcaaatggctttagaaaatatgagttttcaaatgggcgtaggtggattagcaaaatttggtaaaatgcttgatgccatgctcattggtgattggaaaaccgcttatacagaagcaagaaactctgtttggtttaatcagacaaaaggtcgtgcttctcgtgtttccatgattattctaacgggtaatatggaatcatatggagttcctgctccaaagccagaaggaaaaaacctgtctgcggcttatgtagaaccgaagtctggtggtaatcctgaagacccatggaccccagaggattcaagaattctttttaaagagcccgaatcttcatataatggtcaatatccatatgtacatacgatggaaacagaatcaggccatatccaagaatttgatgatacgcctggctatgaacgctatcgtattgttcatccaaccggttcatatgaagaggttgctcctgatggacgtcgtaccagaaaaactgtagccgatttatatgacatgactcagggcgatggaaatattttaatctctggggataagaaggttaacgttggagggaacgagacctattataacatgtataatcgtcgacagcaaattgatggcgataacacgctttatgtacgtggaaatgaaactaaaacgattgaaggtgatggtactatttttgtcaagggtaacattaagatagtcgttgaaggaaatgctgatatccaagtcaatggtgatgccactactaaagtagatggcaaccacgacgtgaccgtcggtggtaatttaacttggcaggtagcaggtactgtgaattggaatgttggtggggcttggactgaaacaatggcttctatgagctcaatcgcccaaggccaatacactgttgatggttcacgaattgatgtaggttaatcatggctgatatacttcctattaataccacgttacgcgaagtaatagaaggtgaatacgttgagcagtactttactgctcaattatctaccaacgaaacattaaaatcaataaatattatcgactatcaaccagtatctgatatctctgtgtctgaaacctattataaaggtaattataactcagtttttacttttggaaacgatgtgcttaaataccgtgaaggtgatgagctaaagtccgcttcagcgtgggaggatttacctaatcccaaaactgctgatttgtatctatggaaagcccccagaacactagagaagacatttacctatacagttgagataatatatacagtgacagaagaatcgtctggaggttcatccggaggttctagcgctccaatcataacagaacataaaaagcaaaagatttactctcaaaccgttaaaggcaactggagtagatggggcgaccaacttcgtgcttacgtatatgcggggaattaaatggctggtctttcatatgataaatgcataactgccgggcatagtgcgtatcctccgacagaagtaaatgctacacaaagtaaagtattcactggtggaatagcggtattagttgatggcgactcaattaccccacacaccaagacggttgaccctcatgatacgcatggaggagttgttcaacctcgcacatccaaggtatttgtaacaggcaaaaaagctgttcaaatggccgatccaatttcttgtggcgacactgtcgcgcaatcaagctcaaaggtattcatacactaatggctattaaagaacctttaaattatcagttaacgcgtactgcaaacgctatcccagacgcatttactggagcaacattcgatgaaattaaaaatcagcttattaactggcttagcggtcaaaaagagtttcaggactttgattttgctggttcgcgtttaaacgtgctattagacttattagcatataacacgctttacatacagcaatttagtaatactgctttatacgaaagctttatcggaacagctaacttgagaagttccgttgttcaagcagctcagcaaaacgggtatttgccaagttccaaatcagcggctactgcgtctattatgcttgaggtaactcatccaaatccagagccagcaataaaaatacctcgtggaaccaagtttttagcatatgcacgagattcatcagtagacccatacaactttgttgttactgaaaatgttattgcgctaagagatacttcagcaccagaaggggttaatagatatcttcctattgtcaatttggcgcagggacgtattattcgtactcagttgtcatatgacccgaagaaacctattgttattcgcgatcagtcaattgaccgcaagcaggttaagctgtgggtggatggcgctgaatggactaactggacagaccggtcaatggttcatgcttcgtctatttcaacgatttattatatgcgtgaaactgtcgatggaaataccgaattcttctttggtgaaggcgtggcagaagcctctgtagcaggaggagttcttgaaagtaatttcattggtggattaaaacctactaagggtgcgcaagtcgttattgaatatattcgtactgatggtgaagctgcgaatggtgcgactgatttcagctatgctgataccctgcaatatatcgtagtaaacaaaatcattgaaaactggtcagattctcctgattatgttggtgctgatggtggtggggaacctgaagacatcgagcgtattcgtgagctcgcccagattaagcgcgaatctcaaatgcgttgcgtgtctaaaactgactatgaatcattcgttagttcacgctttggttctatcgtacaagcagtgcaatgctttactgatcaggacaaacccggatatgcatttatcgcaattaaaccaaaatctgggttgcagttaactgcggttcaacgagaagacattcaggattatctaaaacctttctgtcttgctccgattactccttcggtaatgagtccagactacttgttcatccgtcacaatattaaagcttcttatgcattgaataagttgcaagaatcagagcagtggttacagtcaaaaattatagactcgattaatagatattatgttgatgaagttgaaatgttcaacaaaaatttcagtaaatctaagttgttgacttacattgatgacactgaccactcaatcatcggttcttctgtggatattcagatggttcgtgaaattgtcaactatttcactcttcctagcgcaggtattaaatactataatactattactccgcggacgttacgttctggtgatttggtctttactgttaccccaactgctgaaccgtattcagttaatatcgttggaactgacccagataaaaatggcaaaggaaatatggttattggaccatttaaaccaggtgacattaaagagaatactcatatccagccatatactgaaaacgattttgatagaactaccgtcggcgaaagaactcgttggtacaaaatcggtgaagtagattattatggtgataatatttactggagccttggagctattggagccgatcctcttcagtttgaagaccagagtattgagctttattctactcctacccaggatatcgtcttcgcccgcgatggaacacttatcgtatttgagaatgaccttcgtcctcaatacacaactattaaattggagcctattacagcttaatgaagtataatgaaatttatgatagtttaattaaaagaggcctcgaaagaggccttaataaaaagaagcttgattatcatacagaaaaacatcacattattcctaagtgtatgggaggagttaataataattctaactatgtattgctaactcccagagaacattttgtagctcatcaattgttagtaaaaatatataaagatactaagtatttctataagttagttagagctctcaacgcgatgtcaatgtttaatgataaatattctagacccaacgctaaagaatatgaatgggtacgaactttatgttataacgcgaataaattgactaatgtgggaagaaagcataaacctgaaactctacgtctgttctcggagcaacgtagaggtgctaataacccaatgtatggaagaaagggtgaattgtctccatcatttggtaaaaagaggagtaaagaatctaatgataagatatggttaaatcgaagcagaaatattagtcagaaagcaaaatataatatttcaaaggggaaacgaacatctcctatatggaaagaacctatgtataatgaattgtttaatttatacataagtaatccggtaggaggatgcgcgtttagaactaaagccgtgtctttaggatatcctaatacttcataccacagactagtacaagaatttaaggaaattactcaatgacaattgcaccgttcgtcaccagcttacgaattcataagctatctgcgaatcaggtcaatattcgttgggatgacgttggtgcaaacttctactattttgtagaactggccgaaactcgaaacagagcgggggaagttatccccgctgataacttgagttggtcttcactgggttataccgcggataatgattggttcgaacaaaatcgtattgaaccgcttacttattataaaatgcgtgttcaaactacgtcagcagggtttgagccgtctgaatgggttgaaacagaagagttccaaacttttgaagaaaacgcatacacatttgagcatatgcaagaattcagtttagtgaaagaattcattaaacagaagttttctttaaacaacatgtcgtatgttaacttcaacacatctgccatgatggcatctttgatgactgagtcttttcagtttagtcctgaatattctcatttatcagctattgaaaacttcgttgtaggtgaatctggatatcatgaaattcagggacctattgaagcagtgtgtgttgataaaaatagaactatgctgggagaaatagacggaattttgtatctgtttgaaagattccaacatatggttaaagtatcaaacgataaaggacagaactggcaatacgttcagttatttaatgaccgtgtaggaaatcctgtttcacgagtagtaatttatcaatcaagtaccacatcatatgttttaggctatgataaaatcttttacggaagaaaatcatctgacgtacgctggtcatcaaatgaggttaaatttagcgataacgaagtcacgttcgctaaattgggagaccagttaaaactgggatttgaagtagagttatttggtacatatgcatcactacctgctgatgttaccaaatatgcagaagcctttacatgcaatgatgaccacttatatgtagttgcaaaggatacagtacgcagagttaaattaaaagatgctccaatagacactgaccctttaagccctacatttggtgaaaaagtgtttgaaaaggaagtatctcatataacaggcaatcctaaatctgtatgctttaaaatggattccgttggaggcaaaatctttgcccttattaccggggaagttaaaaccttaggattagacccaacagacccaaggaacgttgtggattctgcaactaaaggcgtctatgtttaccaggaaggcacaaatacttggaagcgtgtatttggtaataccgatgaagaaaaacgtcgtatagagcatttatggacttctatgtcaactgacggaaaggaaatattcttttcatcagctaattttaagacaacagagtacgctcaggatattgagcttgagacgaaatatccagaactaatttctactgcagttaaaaatgttaatccaattcagtatcactctgataagcattatcacatgatgagtttcagagcagatgaattttcaggatgggaaacatttgttcctggacctatgaggttttatgctgaaccttggtttgtctggatggctcgtgaaggcaacagatgctggataagtacagctgaccatgcagttgtcatttataatgatattctttatcaaaaaagagtagatgcagcggcgcagggaactaccgagcgtattctatcggaagtgtgggataaaggtgacgcaacgttttattgccctccagtttcatttaatggatttttgcagtatgcttctggcatcatgtttcacgaaccagacggaaaactgataggctattacgcatttgactaccgtgttcgtgaccaggtaacgcttaactggaaaccaactgatgtaatgtttaaggcgtttctgcagaaccaaacacgggaagaagactggacacctgaacatactccaggcttacgtgacccagatttgcgtccgtatcttactaaaatgatgccggatagttacttgctacaagatagtaattttgagcacttttgtaagtactatctccaattcctttcagatggaaatggaacacattacaacagtctcgttaatcttgttaagaacaaatatcctcgcgaagaaaatgcatgggaatatctgtggtcagaagtttataaacgcaacatttatctgagtaaagacgctcgtgacgctgtcgtccgtttctttgaagcacgcaagaatgatttctatgctactaaaggaattgaagactcatataagttcctgtttaaacttctttataacgaagacgtcgaaatcgatattgagtcaaagaacactaccgaatatgacattattgttgaaagtacaaatatttctgacgatttagttggtcgtacgatttatactgcttccggtcgtagtaatgtgacttatatcgagagagaataccgggatggtcgtctgttatggcgtattactattcataacttatcaggacggttcattgaaggccaggaaattaaatcagagcgtacggactttgagggtattatagttcaaggtgtccgtggaaaggatatgctgagtaataacattgattatataaaccgcagccgttcttactatgttatgaaaattaagtctcagcttcctacttctcgtttccgcgacgatgtattaaggtttgttcatccggtaggtttcggtttcattggtataacattgctgacaatgtttatcaatagtggcttaaatatgaagcatgttgagactatcataaataaactcaagaactataaatgggatgcaggactgccatcagtttatcctgatagagttgctattatcgcctcagatgatacaatagaaagggatccaataactaatgagcctagatattcttctcgtgctcaagctggcgaacctttcccattacctgctaactataatcaagaaaataataatagtgttatcgctggacaaaacccaggacaaagacgtaaacctctgagtcctacatttgaccaatcagcagtaacgtttgccaattatcgtgatttagttaaccaacgtcttaaagacgatgcaggtaatcctcgcgatcctgaaaatccgacacaggtaaaaattgatgagtaattcaacaagagcaagttcaacgcgtagcacgatttatcgtgctatcattacatctaagtttagaactgaaaagatgtacacattttataaatcgattggtccgggaacggaccaaaacacactgtatgtttcatttggcaaaagcactccgtggtcagataacgaatctgaacccggatttgcacctccatatcccgctgataatggagatggggtagttgatgtttggacaaatatgatgggcgcggtcaaaattgaatcatcaatgcttgattgcgttgttccaagaagagactggggtgatactagatatcctaacccgcgtacatttttgattggtgatattgttgttgctaactctgcgccatataacagaactgacgctggatttggatggatggtatatagatgtattgatgttccaaaagacggaatgtgttcaattggaaatcttacaagcaaagatgaatgtattaagcttggaggtaaatggacaccatcagctatttcaggttcagctcctcgtggtcgtggtgatgcaaatggtactgtcgatttaggtgatggatatctttgggaatatctatatgaaatcccagctgatgtatcaatcaacagatgcacaaatgaatatattgtagttccttggccagaagagattcaagaatctccggctcgttggggatttcaaaacaacttaacatggcagcaaaatgactttaatttaatttatcgcatgaagtgcaatacgattagatttaaagcatatcttgacgcaatttatttcccagaatttagtcttccaggaaatactgggtttagacagctgtcaattataactaatccgcttgaagttaagccaatgccaaattcacctaatgttaaggctgaaaaaggctggtatagtgcttctggtcttgaaagacagtcaggtgaaatgatttacatggaaaatcggcaacctattatacgttcaatggaccaaacagaagagttaaatttaattttcgagttttaattatggggagcctttggctccccatttttatataaataagactatactttgatatgaggttaacctatgtatacagataagggtaaaaaaataattgacgtcggtgagattggtaatgcttctaccggcgacattctgtatgatggcggtgtgaaaattaatgataacttcgacgccatttacaacgccttcgccgaccaacgattatttgcagctggcggcggagcattgaaccaaaaaattcatgcaacaagctattaccaaaagataaaatttggagatgctaactctgcagggacagttccaatggggtcatgcatagatgctgattgttcagaaggcgcagttcaaatacgtctttcaaaaggtaaagcgggagaagctgtattcgttgtaaatagtaatggctcagcatcaaaagctagatccataaaaataacaacaaacggcgaaggcgtagcagatgcatttaaagacggatcgcgagagttgattatcaacacgccaagatgcagaattgagctatggtgtgttgaggtaaaagctaacggtgctgctgtttgggattattcaatttcaagtatgtttggcagcacatattcgccattagaagctacatataatttaacaagttctcctattaatatccgcattggatataatgatgattactccaccgttaaattgttattaagcttcagtgcaaatccgggtggtcaaaccatcaaaaggcaatcatctgaagtcatgcttatgattgacccgactattacttcatcagcgccaaacggaagagtatttgacactgaatatgcagtgttaagaagtggtgaatcatctgaaaatgaaaagatgtattctatttcatactctattaacgcgcagaaagatttaatatgcacagcttcaacatcttatggaaacgcacgtttggcagttaaagttattgctacacagaccgtaggggtatctcaataatgaaacaaaatttgatagtaggccaatcagtagatgatgggtctggtgattacctccgtaaaggtggtcttaaaattaataacaactttgatgatttatattcagagttaggtgatggttcagttccattcgcagcaggtgcatggaaaacttttaaagctagccctactggaactactttaaatgctaagtttggtcaggcctttgctattaatacccaggcagcaagagttaacgttcagcttccaaagggtacagccaacgactataacaaagttattaaacttcgtgatgtttggtcaacctggcgattaagcccaatcacagttattcctgctcaaggcgatacattaaaaggttcagcttctcctaaaattttcaatactaacttccaagatttggaattagtttattgcgcccctggccgctgggaatatattgaaaataaaacggtagataagctaactaacggtaacttaagtactgtagcgaaaaaatcaattattgctactgcgggtcagactgactttcttaacatttttgatggcgtagaatataacgaagactcgcttaatgtatatcgtcgtggtaatattttatattacggtgaaaccagtgttatggataaagccaatgctgattacggttctcctggaacagtagcaggtcaattggtagaattaaacggtaaagacattcgtttaaaagttccatgcgttgaaggggaagtaataacatttgaaaccttcctagatggaattggtgtttatcggtcttcatacaacaagttggctatccagatacgagattcagcccagactacatcccagacgattcctgggtcaatgatagtagataaccttgctactctccgcagaatcactctggatgacatgggtgtacttccaggcgtaggggtaaatcctaactcgcttgaaatttcattgaacggaaaggaattactcgaagctggaactgctggtcttcctttattttattgtgaaggcgcagaaggtggatacgcagaagactgtataaacaatggtggtcaatgggtaaattctaaccaagattatagactggaatttgactcaactggtactaacgtcgaagctattatttttggtgaggcgtttgaagataaagaccttcttaccgtccgttggttcaataataacatcggtactactatggatatcaatgatatcatggcagaaaccgaccaagtgtatatgaatgctgagcaattagtaactctaaaaaatcgcattgaatacacaaattatgatgaacctaatcagaaaaatatgcgtccggttgctgacgatattatgattaaagtcaataatattgcagcattttttgacgtaatttatccgattggcacgatttatgaaaacgctcacaaccacgcaaaccctgctgactatatgggatttggggtgtggaagctttattcacaaggccgtgttactgctggttggaataatgattcatctgatccttatttttcgcgtaacaacaataacttaaacgaaaatggtcagccatcattaacagcaggtggaacggttggagatttgacatttacgttaggaaaagaacacattcctgaactaatgtcaagagataaagttctaatttcagaccctgaacatggaagcgtagttatcggtggatgtcaattagacccagacgcgcagggaccaggttattctaaataccgtgaagacactgttgcggtaaacaacggtgtagttccaaatgacatcactaaaattcagccaacaatcaccgtttatcgttggattagggtaggttaaaatgacgattgaaactaaaactcgtgaaggagctaaagttaattcaagattagctgctttttcagaatatcgcgttgacccgcaaaatattgcggtaggaaatacggctcctatagggagcctaacctttgaacaaatggatttaggggtttggtatccaaatactgaagctgctattaatgatttgatgtcattgcagtcagcagaaattggaactattatttgcaatgacactggaatatctccacagcccgcacagcaaattacgcgtgctactttttcaggtgtcgttgcgttagagccaaaagaagacggctctgtcggtgacccagtaataattcatattcttggcttaccaattagaattgcaaacggtgatgactttgcagcagtagcaacacgttggtatgataaagtaaaagaattagaagctgttggaaaggttgttcaacaggttactcaatcgccggcaacaccccagtatgttgatattattcatttagattatcagaaccataattttgaaacatataaaaagtatggtttaactgttgaatttactattacttcaccagctaaagcaggttatgggcaatgggatgctatcggcaacgaatctaaaacattcggcgcgaacacatttactttccactattttagaaggatgggataatggcccagaataactataatcactacagtgatttggccaaatatacgatatttgacccaacaaatacacaatggcctgttgctataaaagacgtccaatcagcgttagagctgattggtagctgggcaagaactgataccggattacctgtagcatctcctacagtagccggtgtaattcgcacagcaacacaggctgaagttgatgctggaactattggtaatgctgcggtaactcctgctacattaaaatccacagttacccgtcctgaagcaactacagcagttcttggcttaacacgatatgctactaatactgaagccgcagcattaaccgcaggaaatagaactattaccgcggcggctctcggtcatgtgtttaaaaccgtaaaagcccaagaaaacgtagatggaactgttaggttaactactgcggctcaagcgcaagcaggaactgacgaaactaccgcagtaactcctaagcgtgttgtagaaatgattggaaagttcagcgttagtcctcctagttatacctctgcgacagaaagcaacttgggattagttcgtgtcgcaacccaagcccaggtagcagcaggcgctgttcacgatggatacgcagtaactccaaaaaccttcatggaatcaaaagcgtctgacagtgtatttggtatagtaaaatttgctaaagactcagatgtggcttcagctacttctaacaatttggctgttactccaaaaagtcttcaagcgctaaaatccaccaaggataaatatggattaaccagattatcaggttctccaactactgatgcttcattggcagcggctgcaacagatgcagtctttaaaacccgtagaataaacggaaaaactcttgacaatgacataacgattactaacaatgatattaattgttatacaagacaagaatctgacgggcgttacatgccagctggaaccagagtaggtaatgttacttgggttgaaggtcaatcttggattagtcgaggtgcaacgtttacatgtaatgcaccatgggaagcttctagtagattagctctaaatgttaatgtaaaatttgagcgtaacaacgacggatatgacaatcgtattttcagatttgttgtaatagttaacggttcccaatggggcggtgaacttactcttaacatcgaaaatactaaaggcggacgaaatggtcattcatggagatttgaagcttacgcatctagcaactttttcttcaataacattcctccaaatgccactgttcaaataagaccaacagaagacagtcgtattatattttatgactgcatgcttacattctgtacaaatagaccgtaaggaacaatatgaccaaactagtagattcgcttccgttcgtagacggaattccagacgattttcaacagagaattaactggataaaaaatacagagcctcttaatggggcttcaacccgctatggaaatgatggagaactgaatagagcttctgttcaaatccagaaaaacgttgttcaggtacataacgatttgaacaacgttggaactgctgtagaaaatattcaagtagatgtagaccaaatcaaaaaatcgttagaaattacaggttcttctgacgccattgagcaggtttatatcaataaaaagaatattgaaaagcatgatggacaaattcttaaattagaagaagacaccgaaaaacttcgaactgaccttgattttctcgaagaggatgtaggtgtttatgattctagtaaagatgactattacagaacagttcgtgataatatagtttgggttaaacgtgaaattggtgcgtatcctgggcaagatattaacggacagccgaagcaagactctccgggttctggtatgaaataccgaatcatcaataatgcgtcagctatagtaaaacatgacgagcgtattcaggcgctagaggatgcatacaatgattcagacgtaggttctctgactattgaagtaaacgacctgcgtaaagaagttggtcctaaatccggagctacgtcagcttcaatttatgcaaggcttgtgaataacgctgatgctatttccgcagctaataatgaaatctttgctattaaccaagccattgattttaccaatccagtaaaaattggagctcgtactactagattagaaaacgattatcgtatagttgacgcaacacttaactctgcacaaaccgggttagttcctcgtgtcaataatattgatgctcgtttagggtcttctgataagcctgatactattgaaggaaaaattagttctctttcaactgaccaagggtacatttctgatgttgtaggacgtgatacttcatcagggcttcagggtcaagtagcatggataaaccaacaggttggtattgttcctagcgagcagccgattcctcctgggtcaattttagcgagaatgaccaatgttgaaggtatgcaaaactctcaacagtctgctattcaggacattcaagtagaacttggcaataacaatgaagggttaaagggttctgtatttacattacagactcaaatgaatggtgacttttcgtcagaaaacccagttcaacgtgatggtgtatacgctactgtagtagaattgcaagataaattcgtgactgcagttactgacgtagaacaagctggagcatacctccgtaaacagggcgaatggtttaaaaaaccttcatcaataggtgaattcagtaaagaagatttcactgttgatttaagttctgatgcattggtaaatcctaactcattggtcgctgctccattcaatgctggcattcgtattgtcgatgacattgttgttgatgacgatggcgtattttgcgtagaaactgatacggttatcgaagcttctgattcagataaaggcgtgaaaattgttattctcgttaataacattgaggtgttttcctacggacttggtgttaaagcagtaacgggcgagcagttgattaaaaccaagaaactcattgagttttcatctggtgatgcaatcaaaatcgtgtatagagctgcttcagaagaatcgcaggttcttgttaaaattaaatctttggatattactattcatccagctgtataacaaaaggggaccttcgggtccctttttcgtataaataggaatataaagaggagttcatatgtcatacaacacgtacaacccaaaaacgcttaaagacgctatacttcgacgtctaggagcgccggtaattaatgtagaagtaactgaagaccaaatttatgattgtattcaacgagcattagagttgtatggtgaataccactttaacggattgaataaaggttatcaggttttttatattggaaaagacgaagctgacaacgcaagatttttaaacggcgtgtttgatttgcgcggtcgtaatgtatttgctgtcacccaaattgttagaacaaatgtaggttcattaacttcaatggatggtaatgcgacatatccatggtttactgactttctaatgggaatggcaggaattaatggcggaatggggtcaagctgtaataaaagctatgggccaaacgctttcggtgctgaccttggctattttacacaattgatgacttactggtcaatgatgcaagatttacttgctcctctcccagattattggtataactctgataatgaaatgcttaaagtaatgggcaacttcatgaagggtgacatcattgtctgtgaatgctggaccaaatcatttatgaatacagatgtgatggtaggcaatacagcaggatatggattcgccggagcccaaactgctgaccactggggtttaggagatagataccagaatcctgaccttcgcaataacggccaatatgctggtgaaggcaatacaaatagagaaggtgcatataataatcgttgggtaaaagattatgctacagcattaactaaaaagctgtggggtgaaattctttttaaacatcagggtctgcaattggcaggtggagttacagttgatggtcaaacacttaaggtagaggcccaagaagaaatcgagaggctccgagaggaacttgatttacttgacccgggttgtcctattctgttggggtaaaagatgtctacatttgattctaggctcttcgctaaactcgaagattatcgaggatataataaaactaatgagactgaaattctcaatccttatgtgaatttttacaatcataaaaatagccaaacgttagcagatgctttatcggctgaggctattcaaatgagaggaattgagttttatttccttcctcgtgaatataacaatcctgatttgctttttggagaagacccatcaagtaaattcaccaaagcttggaaatttgctgcttatttagattcatttgaaggatattctggcgataacacattctttagtaaatttggtatgatggttaatgatgaagtcaatctgactattaatcctaatttattcaagcatcaaactaataattctgaaccaaaagccggtgatctaatttattttcctatggataactcattattcgaaattaactgggttcagccatacgatccattttatcagttaggtcaaaatgttcaacgcaagattactgcacaaaaatacatttattctggtgagcagcttcagccagaattgcaacgtaatgaaggcattaatattcctgaattttctgagcttgatttagaaccaatcaaaaatatagatgctcttgctgatatttctgatgtgcaatacgcagaaagtgacgcaatcaataaagaagccgctgaatatgttcatccgtattatgttaataacggaagaggacttgaatctcctcctaaagcagattcatttgatgacggatttttcgaataaataaaataaagatgggacctttgggtcccttaggagaaatcatgtttggacattggtataattcgtccttacgccgatacattgtattgcttggagatttattttctcatgtacaaattgctcgttggcgtgaagacactggactaaaatatattaaagtacctatcacttatgcttcaaaggaaaagttcctttctcagcttggaaaatggactgctattcagtctaccgagaataaagcaaaaatagaaactgttttgccaagaatgaatttgcacttggttgatatgcaatacaacgcgatgtataaaacatcacagctgaatagaacaaaatcatataaaactccttcaaaaattacatctcaatataatcctactcctattaagatgatttttgaattaggaatttatacacgcaatcaagatgatatgtatcaaatcatcgagcaaatcgttccttattttcagcctcacttcaatacgaccataactgagctttacgacaaagacacaagttttaatcgtgatgttagaattgtattacagtcattttctccggatgaagctgttgatggagacaatatcactcgtcgtagattagaatggtcattaatgtttgaagtcaatggttggctgtatccgcctgtagctgaaattgatggcgaaattagaaccatttatttagatttcttcgctaacagcaaagagttaactccagaaggaaactttgaatcagtagatagcgaagttactccacgagatgttcagcatgaagattggaatggttctagtaaacaaacgtattctcatgatattcctattccggtaaatccggaggctcctggaccgagaggtgaaaaatgagtgaattacaattagatatggctaaattattagacatcgaaggaattcctggaatagaaggacaagaaattccggtttatgaaaaactcgaattagttgaggttaaatctaacccaaatgaccgtaagcctgacctcgaagatgactattcggtcgttcgtaagaacatgcactttcaacagcaaatgttaatggacgcagctaaaatatttttggaaactgctaagaatgctgactctcctagacatatggaagtatttgcaactcttatgggtcagatgactacaaccaacaaagaaattcttaagcttcataaagaaatgaaagacattacttctgagcaggttggcaccggaaagggagctaatcctcagcaaggaatgaatattcaaaatgcaacagtctttgtagggtctaccgctgatatgatggatgaattcggtgatgcctatgaagcacaagaagctcgagagaaaatagtaaatggaacagactcaaccgtttaacgttctgagcgatgcccatcctttaaatgacgggaaactgacggttattcgtcacccgtctgaaatggaaacgaaaattgaaaacggagttcgtttctttaaatcgcaatgggatgataagtggtatcctgagaagtttgaagactatcttaagttgcatgggatagttaaaattcgtttgcaaggtgaagacccagctcatttccaaacgtttaaggacaaaaacaataagcgcacccgctatatgggattaccaaaccttaaacgagcaaatattaaaatgcagttgacgcgtgaaatagttgcagaatggaagaaatgccgagatgatattgtgtacttcgcagagacctactgtgcaattactcacattgactatggtaccattaaagtccagcttcgtgattaccagagggacatgctggaaatcatggcagccaaacgtatgacttgttgtaacctcagtcgtcagctcggtaaaactactgtagtagcaatctttcttgcgcacttcgtgtgttttaataaggataaagcagtaggtattcttgcgcataaaggctcaatgtctgcggaagttctcgaccgtactaagcaagcaattgaattacttcctgactttcttcagcctggtattgttgaatggaacaaaggctcaatcgaattagataatggctcatctattggggcatacgcttcgagtcctgatgccgttcgtggtaactcatttgcaatgatttacattgacgaatgtgcgtttattccaaacttcatcgatgcatggcttgctatccaacctgttatttcatcaggtcgtcgttctaaaattattatcacgactacaccaagtggattaaaccacttctatgatatttggactgcagctgttgaaggtaaatccggctttacgccttatactgcaatttggaactcggttaaagaacgtctatataacgacgaagatatgtttgatgatgggtggcaatggtcacttcaaactatcagtgcttcttctcttgaacagtttaaacaagagcactgtgcggaatttcatggcacatccggtactctcatttccggtatgaaacttgccaatatggattggattgaagttactcctgactcgcacgggttttataaatttaaagaagcggaagcagaccacaaatatattgcaactcttgactctgctgaaggacgcggtcaggattaccatgcactaaatattattgacgtgactacatctgaatgggaacaagttggagtattacattctaatacaatttctcacttaatcctcccggatatagttattaaatatctaatggagtacaacgaagctccgatctatatagaacttaactctacaggtgtttctgtagcgaagagtctttatatggatttagaatatgagaatgtcatttgcgattcaatagttgatttaggaatgaaacagacgaaaaggtcaaaagccgtcggatgttctgcactaaaagaccttatcgaaaaggataaactcattattcaccatcgtgctactgttcaagaatttcgtactttctctgagaaaggagtatcctgggcggcagaagatggatatcatgacgatttaattatgtcactcgtaattttcgcatggttaacaacacagcaaaaatttgctgatttcgtggataaagatgaaatgcgtttagcatctgaagtttttaaacgcgaattagaagatatgaacgacgattacgctcctgtagtgttcgttgacgccgtgaatagcgcagaatatgcgcctcaagaacatggtctttcatttgtataaataataaaaagcaaacaacattgaggatatatcatgcctttagtctctcctggaattgagctcaaagaaacgagcgtacagagcacggtagtacttaacgctacaggtcgtgccgcaattgtcgggaagttccaatggggtcctgcatatcaagttactcaaatcactaatgaagttgaactggttgatatgtttggcggccctaataaccaaactgctgattactttatgtcagcaatgaactttctgcaatatggtaatgatctacgcaccgtccgtgtagttaaccgtgaagctgctaaaaacgcatctccgctggttgataatattgaatggactatcactactgctggtagtaactatgaagttggtgataagattacggttaaatatgcagaccaaactgtagatgacaccggttcagttactgaagtagatagtgacggaaaaattaagtcggtgttcattccgacatcgaagattattgcatatgcaaaaagcattaatcagtacccagatttagggtcttcgtggacaactaccattacttcacagagttctggtgtttccgctgtcattactttaggtaaaattatttctgagtctacagttttactgactgagcatgaaactgcccatgaagaaatgacaaaaaccgaattccagactgcgcttgcgcaatataaaatgcctggaattgtagctgcgtatccgggcgagctcggaaaccaactggaaattgaaatcgtatcaaaagctgcatttgataaaggtgaacagctgacgatttatccggctggtggaaaacgcgcttcgactgcaaaagctgtatttggatatggtcctcagaccgatactcagtacgctatcattgttcgtagagatggcgcggtagttgaatcaactgtgttatcaacaagtcgtcaagataaagacatctacggaaataacatctttatggacgattatttctccaaaggttcttcacgttatatatttgctaccgcgcaaggatggcctgaaggattttccggtgttattcgtctgggtggtggggtttcagctaatgaatcagttactgctggcgatttaattcaaggttgggatttatttggtgaccgtgaagcactgcgggtaaaccttctgattgctggtgcttgtgctggtgaaacggatgaaatcgcaagtacagtgcaaaaacatgtgtcgtctattgcagatgaacgtcaagattgtttagcactcatttcaccaccaaggtcaacgattgtaaatattcctctgacccgtgctgttgataatttaattgattggcgtcaaggtgaaggaagctacgactctgcaaacatgaacatcaatactacgtacgcagcaattgatggtaactataaatatcagtatgataaatataacgacgtaaaccgttgggttccgttagctgctgatattgcaggcctgtgtgctcgtacagatgatgttgctcaaccttggatgtcaccggctggttatcgtcgtggtcagattctgaactgcattaaacttgcgattgaacctcgtcaagcacatcgtgaccgtatgtatcaagcaggtattaacccggtaacgggtcaaggtaccggtgatggtttcattctgtttggtgataagactgcaactactgttccaacgccgtttgaccgaattaacgttcgtcgtctgtttaacatgctgaagaacaatatcggtgattcttctaagtggcagctgttcgagttaaacgataactttacccgttcttctttccgtatggaaacaagccaatacttggcgggtattaaagctctgggtggtgtatatgacttccgagttgtatgtgataccacgaacaacacccctgctgttatcgatcgcaacgagtttgtagcgagcttctatatcaaaccggcgcgcagtataaattatattacgcttaacttcgttgctacggcaactggtgcagatttcgatgagttgatcggaccacagtaatatgaaccccaggacattctggggtcatctaacctttagatgataaattatattaccgcacactttaatagcctctatgatgatgtagtcaatcgagaggctatataaatatctataggaaacaacgatggaattaacagacatcacccgtgcgtttgaatctggtgactttgcacgtcctaacctgtttgaggtagaaattccttacctgggtcgtaacttcagtttcaaatgtaaagcagcaccgatgccggcaggtatcgtagaaaaagttccagttgggtacatgaaccgtaagattaacgtcgctggtgaccgtacttatgacgactggactgttaccatctataacgatgataaacacgaagtacgtaaggcaattattgcttggcaggctcaggcccacgctcaaggcaatgatatctctggtatgactccagccgattacaaaaaggttgctacggtacgccagtttagtcgtgatggcaaaactatcacaaatgaacacaccattactggtctgtggccaactaacgttggtgaagtacagatggactgggattcgaataacgaggtagaaacgtttgaaactacctttgccatcgactggtgggaataatgctatggggcttcggccccgtatcgaagttctgtgagttatttgcttaaatatctgacaaaacttcgatataaatatacttatagataatttcggagactccaatggcctttcatattttggacttattcgctccgtgggaaaaacgcgacgaagctgaatataagcaacaaatcaacaatgacctagagtcaatcactgctccaaaatttgatgatggagctcgtgaagttgaatcaaacgaaaacgaaatccagtacaattcattcaaccaaatgatgtttggttccaatgaacctggaatgaaaacaactgctgatttaatcaacacttatcgtagtttaatgaataactacgaagttgacaatgctgttgaagaaatagtttctgacgcagttgtatacgaagacggtcatccagtagtttctcttgatttagattctaccgacttcagtcaagcaattaaagaccgcattcttgaagaatttaatacagttttaacatgccttaatttcgagcgaaaaggagccgaccatttccgccgttggtatgttgactcaagaatattcttccataaaatcgtcaacacaaagaaaatgaaagacggaattcaggaactgagacgtcttgacccgcgcaacttacaattcatccgtgaaatcgttaccgctgatgacgctggtactaaaatcgttaaggggtacaaagagtatttcatttacgatactggcaaagaaagctattatgcagatggcagattatattccgccggaacgaaaattaaaattccacgcgatgctatcgtatatgcacattctggactagttgattgttcaggtcaaaacatcattggttatttacaccgagccgttaaacctgccaaccagttaaagctattagaagatgcgttggtaatttatcgtattactcgtgctcctgaccgtcgtgtgttttacatcgacactggtaatatgccttctcgtaaagcggcagcacacatgcagcatattatgaacacgatgaaaaaccgtgttgtatatgatgcgtcaactggtaagattaaaaaccaacagcataatatgtcaatgacagaagactattggttgcagcgtagagatggtaaagcagttactgaagtagatactcttcctggtatgtccggtatgagtgatatggatgacgtccgttactttagaacagcgttatacatggcattgcgagttcctctttcgcgcatgccggatgcaaataatcaaggcggtgtgcagtttgatgctggtacagcaatcactcgtgacgaacttgattttgccaaatttattcgtagattacagcataaatttgaagagattatgcttgatccacttcgcactaatctaattcttaaaaaagttttgtctaaagatgagtgggaagacgaaataaataatattaagattgtgttccataaagactcatatttcaccgagttgaaagatgctgaagttatggagcgtagaatcaatatgctcacaatggctgagccgtttatcggtaagtatatttctcacaagacagcaatgaaagatttccttcagatgtctgatgaagaaattgaacaagaagccaagcaaattgaattagagtctaaagaggctcgcttccaagaccaagaaaatgaagaggatttctaatggaaaattatatttccgcaattgaatccagagacctcgtagcagccaaaaaagcttttggtgcaattatggctgaacggacatctggtttaattgaagagcgcaaaaaatttatcgcagcgtctgtcatgattgagggtgaagagcccgttgacgatgaagatgaagacgacgaagatgaagataagtctgagaaagacgacgacgaagaggacgagtaatgcttatactgcctgaaaatcatgaattagttatcgacgctgtcgaagcttttcttcctgaagcacaggcacgttttgataagttgtccgcagcgctttctaaagatgatataaataaaattgtagagaacatggttacttctgagcctgatttagcaattgctttaggttcaattaacgaatctctacaattaaatgaatttatcgttaagcacgttgattctaaaggtactattacccgtaccaaagatcgtaaaacacgtgagcgtaacgcgtttcaaacaaccggactttctaaagctaaacgccgtcaaatcgcgcgtaaagcagtaaaatcaaaacgtgctaatccatcggctcaaactcgtggattacgtaaacgtaagaaagcacttaaacgccgtcaggctctggggctaagttaatggaaaacctcaatgaacaacttttaattgagcattggggtcaaccgggcgatgtaattgatggtaaacccatgctggaatctattatcgttgaaggcgaaaatgaatctggcttaaaacctggtctgtatatcgaaggtgtttttatgcaggcagaagtagtaaaccgtaataaacgtctttatccaaaacgcattcttgagactgcggtaagccgttatattaaggaacaggttgctactcgtcaggctctaggagaattaaaccatccacctcgtgcaaatgttgacccgatgcaagccgcaatcattatcgaagatatgtggtggaaaggcaacgatgtttatgggcgtgcaagaatcatcgaaggagaccacggtccaggtgataaattagccgctaacatccgtgctggttggattcctggtgtatcaagccgtgggctcggttctttaaaagactcaggaaaaggatataacatcgtacaagaaggctttcgtctgactgttggtgtagacgcagtttggggtcctagtgctccggatgcatgggtacaaccgaaacaaatttcggaaaatacctcggcacaagttgccaatagtgctgatgatgcttttatggctctcgcagagaagttaaaagcgttataaagtacgaggaggtaaatatatatggataaagtcactgataattctccagatgtggagagcacagaatctactgaggggtcattcccaactgttggggttgatactggcgatacgattacagcgacgcttgcaactggaactgaaaatgttggtggaggcggtggagcatttggtggggccagtgaaagttctgctgcgatacatgcaaccgctaaatggtctaccgcgcagttgaaaaaacatcaggctgaacaggctgcccgtgctgctgcggctgaggcagcattggcaaaagcgaaatctcagcgtgatgccctgactcaacgtctcaaggatattgttaatgacgctttacgtgctaatgccgctcgtagtccatcagtaactgaccttgctcatgccaataatatggcaatgcaggcagaggctgagcgtttgcgccttgcgaaggcagagcaaaaagcccgtgaagaagctgaagcagcagaaaaagcgctccgggaagcagaacgccaacgtgatgagattgcccgccaacaggctgaaaccgcgcatttgttagcaatggcggaggcagcagaggctgagaaaaatcgacaggattctcttgatgaagagcatcgggctgtggaagtggcagagaagaagctggctgaggctaaagctgaactggcgaaggccgaaagcgatgtacagagtaagcaagcgattgtttccagagttgcaggggagcttgaaaacgctcaaaaaagtgttgatgtgaaggttaccggatttcctggatggcgtgatgttcagaaaaaactggagagacaattgcaggataagaagaatgaatattcgtcagtgacgaatgctcttaattctgctgttagcattagagatgctaaaaaaacagatgttcagaatgctgagataaaattaaaagaagctaaggatgctcttgagaagagtcaggtaaaagactctgttgatactatggttgggttttatcaatatataaccgaacaatatggggaaaaatattccagaatagctcaggatttagctgaaaaggcgaagggtagtaaatttagtagtgttgatgaagctcttgctgcatttgaaaagtataaaaatgtactggataagaaaatcagtaaggttgatcgggatgctatttttaatgcgttagagtctgttaattatgatgagttatctaagaatttaacgaagatatcaaagtcgcttaaaatcactagtcgagtatcttttctatatgatgttggttctgattttaaaaatgcaatagaaactggtaactggcgacctttgtttgtcacgctggagaaaagtgcggtcgatgtaggtgtggcaaaaattgtggcattaatgtttagttttattgttggtgtgcctcttggtttctgggggattgcaattgtcacaggtattgtttcttcttacataggggatgatgagttgaacaaacttaatgagttgttagggatttaaataattatgtaacttaacacaggacatcaaaaatgcttaaagaacttttaatgaccgaagctaaaactatcgatgcttccgtcgctcttgacagtattttcgaatcagttcagctttctccggaagctaaagctaacttcagcactgtattcgaagcaacagtcaaaaaacacgcagtagctctggcagaatctcacattgaaaagattgctgagaaagcagaagaaaaagtagaagaagaaaaagaaaaagctaaagaagaagctcgcgaagagctgaaagaagctgcttctaaatactttgaccatatcgctgccgaatggatggcggaaaatcagctggcggttgatcgtggtattaaggctgaactgtttgaatccatgtttagcggtatgaaagaactgtttgttgagcacaatgttgtaattcctgaagaatcagtagacgtagtcgctgaaatggaagaagaacttgctgagcaaaaagcagaaactgctcgtttatttgaagaagtttctaaacgtgatgcttatatcaattacgcccaacgcgagtatgctattcaagaagcaacccgtgaattgactgatactcaaaaagagaaagtagtttctctgacagagggtatggattattctgactcgttttcaactaagctgaaagctattgttgaaatggtgcagggttctgtagagcagtctgtaacggaatctgccgatataaatactatcgacaaagaagcagacggtttaaacttcacaactgaagcagtcgaagaaactcctgcgactaaaaccccatccgttatggatgcttatgtagcccaagcggctcgtctttcttaatttaaaaggttatacaacacatgaaaaagaataaacttatcgaaaaatggcagccgctgcttgagaacgaagctctgccggaaattgttggcgctagcaaaaaagctctgatcgctaagatttttgaaaaccaggaagctgatattaatcaggctccggaataccgcgatgaaaaaatcgctgaagcatttggttctttcctgtctgaagcagaaattggcggtgaccacggttatgatgcacagaacatcgcagctggtcagacctctggtgctgtaacccagattggaccggcagttatgggtatggttcgtcgtgctatccctaacctgattgctttcgatatctgtggtgtacagccgatgtctaacccaaccggtcaggtattcgctctccgcgctgtttacggcaaagacccgctggctgctggtgctaaagaagctttccatccgatgtacgctccggatgcaatgttctctggtcagggtgcaaccgagaaatttgaagcagttaaagctggtgatgctctgactgttggtgatatcgttgttcacgatttcgcacagaccggtcgtgctcatctgcaggttgttgaagatttcactgtagacgctggtgctaccgatgctgctaaactggacgctgcagttactgctgctctggaagctggtaaagttgtagaaatcgccgaaggtatggctacctctgttgctgaactgcaagaagcctttaacggttcgaaagataacccgtggaatgaaatgggcttccgtatcgataaacaaaccatcgaagcgaaatctcgtcagctgaaagcacagtattcaatcgaactggctcaggacctccgtgctgttcacggtatggacgctgatgctgaactgagttcaatcctggctactgaaattatgctggaaatcaaccgtgaagttgtcgactggattaactactccgctcaggttggtaaatctggtatgacccagactgttggttctaaagccggtgtattcgacttccaagacccgattgatatccgcggtgctcgttgggcaggtgaaagctttaaagctctgctgttccagattgacaaagaatccgctgaaatcgctcgtcagaccggtcgcggtgaaggtaacttcattatcgcttcccgtaacgtagttaacgtactggcagctgttgatactaacgtatctccggcagctcagggtctgggtcgtggttataacaccgacaccactaaagcagtatttgctggtgttctgggtggtcgctaccgtgtatacatcgaccagtatgctcgtcaggattacttcaccatcggttataaaggtgctaacgaaatggatgctggtatctactatgctccgtatgttgcactgaccccgctgcgtggttccgatccgaagaacttccaaccggtcatggggttcaaaacccgttacggtatcggtattaacccgttcgccgattctgctgctcaacagccgaaaggtcgtattacctctggtatgccttctatcgtcaactctgttggtaagaatgcttacttccgtcgtgtatgggttaaaggtatctaataccaataagggagccttcgggctccctttagttgttttaatggatataaataaacttataaatccacagaggaaagcgcaatggctaaaatcaacgaacttctgcgcgagtcaactacaacgagtagcaacttaattggtcgccctaatctcgttgcattaacgcgcgcaactactaaattaatctataccgatcttgttgctacacagcgtactaaacagcctgtagcagcgctatatggtatcaaatatcttaaccctaatggtgatttgacatttgcaacaggtgcaacctatgcaggtcaaatcggagccacagaacgtgagtcaattgaagaactcactatggcaaataaagactcattcaataaagacgatatgttcaaatatcagaatgtggtctttaaagtacttaaagatagcccgtttactgatacaacagaaaccgatgaatttggacttgtatctgaagctgtagcagctaataatattcgtatgctgtcagatgctgcagtcactgaaaaatttgaaggacctgattcagacccaatcaccgaagccagttttaaaattgataaatggcagacccaggttaaatcacgtaagcttaaaacagatttaacggtagaattagctcaagatttagaagctaatgggttcgatgctccagaacttattgatgatttacttgctactgaaatggcagaagacattaataaagacatcctgcaatcattgattacggtttcttctcggtttaaagtagctggtgtatccgataaaggtgtattagatttaactaagcaggattctgctccggaacaaggtcgtactctgtatcgtttcatttgtgaaatgaattcagcagttcaacgtaatacttcttattctggtacttatgcagtagcatctactcgttgtgctgcggtgcttgcagcttccggttggttaacacagaagaatgatggaagtattccggaaaacgcatacggtatgctgaataacggtttacctctttattgtgatactaacagtccggttgattacgttattgttggtgttaaggcagaatttggtgggaaagaaactgtaggttctttattttatgcgccatataccgaaggcttggatttagacgaccctgagcatgttggtgcatttaaggttattgttgacccagctagcttgcagccttctgttgctttactggtacgatatgcgctgtcagttaacccatatactataggattggacgaggacgaagctcgtgtgattaatgctgcggatatggataagatggcaggaagaagtaagatgtctgtactgctcggtgttaagttacctaagcttattgcggactaatttgcggggagcttcggctccccttttttgctataaactaaatatgtcaaacctcggggagtattcctcctcgagggatttaaacacgttcttatcatagagattgacgcattctattccatgtctacgggctatatcaacagctactctcgtccctccagatacactcccgcatcttttttcaggcgcccaatataataccttatctacaggctcagtgcattctaggcccaatacctgcatagaattccgtgcaaatagtgtctgtactatcttcgagcattcatcccagtacgacgtaacttctctcgccttaatgatgcttttgattttggcttcgtttgataattcagaccatacaacaacacctgtatcaggaacatggccacaaaagccagaataaggaataatcctacaagaatttgacctatcgtatttcgccaaccacgcttcatctgaacccggagctccacctgaatatgaaaaatgcccctcttccgagaggcgttgaccgattatagtcattagactcagaactctgcgtggcgcttctcttgaaccaatcagcgccagcctcattattctaaaacctcatgccatttgctacgaatagtgttttgaattaaagtagtcagttctttcttaacagcagaaggattatcagcgaatagcatgtcatgaccttcacgagctgcttcgttgatgatatctttcatagtcagtcccataactcgaccaaaatctttggcagttacagtaccaatatgagacagaacgttacttacacggttccaggttacatactcggaaaagatttccagaacacgcttatcagtatcagtgagttcaaccttagctttaataggcttatcagatttagctttctcgctgaacttagaattcttacacttaatagctacacgggtaccgttattaaagaatttaggattaaccggtttaagaacatagccttcagctacaccggtttcagaagaagcctgtggaccgaacacatgtttatttgcatgttcaaggtcagtcgtgtcaacaagttcattatagtaattgacaatagatttaaagtcatttacatactgagatagctcagcgaatgaaccacgaccaagcagtggagctaatttaagaccaagaccagtagcaaacgattctactacataatcgtcccaataaactttttcgttaccggaatccgacaggatatcaaacacgtagaaatctttatcaccataatctacgcccttctgaataccaccgccagcaaattcaccgaagatttgaacagatactaaatccatggtgttcagcatgttctgcatcttaacgaaagaatccttgtacttcttcatgataatctcatgaccaaagaagctttcaccttctaaaataggaccagtacgcttagccggaacgatttcggtaggggtaataatcacactgaagttagtgccatgaattttctcacgagccacccactcaacggtatgcatatcaaaaccagcaccacgaatcttctcgatgaacttaccgttgtaatgattctcaagactagaatattttgcaaacattataatttccttagaatgtgattttcataaagtcagtatcaccgttacgctgggaactggtataatttgtaacaaatccttcatcatgcaaataattaagaacacttgtaatgtgtttcttaactagactactcggatacataattaactcacgcttacccgctaaagcggttttctcaatctgagttaatacttcttcttttgctgccgataattcttctgtagcaacattaatagcagtattagccattctatcggcaaggttcataatttttctctcaataaataaaataaaaccaggagtccatctatcttggacaagggtaatggtatcagaggatttcccctgagcccattataccacatcgatttttaaagcaattaataaccgctcggtacgaagcgatacatgatatatccgcttttagttagcatgatttcaaattgacttttgcttccaacctcaagtactaatggaatatctttatccattagcatccaatcaatttttccataccgttcattaatcaaatccgttattttacgtgcaccacttttatagtagtaagaactctgaacagccatcattttactaacaaatttagatgcaaacaaccagacatttaccccattagcagctggcgtaaatttcttagaaagcatttcttcaaatcgttctactacaattgggtctactttagacattataaagtcctcatgtgtttaacaagtttcttatgacgagattttataccaacgtttgttaagcgtttccgatatacgactttttctttttgcttaaaccgttcgtgtgctttctcaactgagacccacaatttagcagcttccgctggagtgatatctaatgctctcgcaatttcttgaaaatctttaccgctttcatgcattaagtgagcttgtagtgctttcataataacctcatctatgtgacgaggacataataaaccaatccgtgaatagcaaaaaagggagcccgaaggctcccgaatattaaggatagataatacccgcttccagcgcagtacgatgaacaatgtatccatttctagattcttgtacatcgacttctggataatcatctagcattttagccagagtataccgatgcaggtaatagtcgctgtcagggtcgtcgagtttccaatctttgccctcaacagtcattcgctggatttcatccattacccaccatccgcaccagatataggctgttccacggaacggtagaggatgaatatacggaagttctccgtctggctcaggggctactcttttggtaatagttacatcgccagttttagtgactgtaatcggggtgtaatcttctgcggaaacctcaacagaaacctcaatcacttgagaccctatatcagacgtgtcaatcactaaagtgctagtagaaccttctacaggagaaccgtctttggtccaagaataaaccccagttgcaccttctggagcaccgataacgttggctttaaaagatgcttcagacccttgttctgccgtaatagactcaggagtcaaagtaacagaaacaccactcattgtctttttagtaaaagcaacagcaatacctttagttgcagttccattattataatctggagcagaaaccgttacttcacaattcaatgtgtagctggtttccgttgactcggttaaggtaattgttttacccgtttggccagaaataacagaagagccacgtttccaaacataagcaatgcttgctcctgacggggcgccagtaacatcagctgtgactacttgggattgaccaatttctttagaaacagaagttgggctcaaagttaaagtaatggccggcatagttttgttcttaactgtcagagtagtttctgcttcagctgtttcgggatcgccttcagccggagtaacagtagcaactactttaacggtcttactacctgcaggtcctgcagcaacataattcatagctgcggtaacagaagattgttttacaccatttacggtccatacaaacgtttctgtgccttcagctgcggctccagaagttgttgcagtaaaattggttgttgctccaatgactgccgaagcagccaaaggagcaatagatacgctataagccataggtgttccttattttaaagttacaaatgaagaattacgtgtttcacgaatcataacagacccgtttcttttgatgtaatagattaaactaaacagtgtctggtgtgctgatgggtgttcaaacgacgttggccgagatttccaatctggggtatctttaatccattggtaaatccaccatggaagagtaatatatcctgggttcttacctagcaattgcatgtttggactaaagtttttaggaagctcaatggtttcatcagttttaacaattttaactactttgtccattgctttgaagaattcttcagggtccgtagtactaattggaatgtttgtaagttttccttcatcatcgatatggataacgctgtctccaataggagcttcagcataaaatcctttatcattgatagaaggagtttttacttcaaatccagggtcatttactttgggtgtttctttataaaaatctgggtcaatatcatgaattttaacacttgcacttactggagcatcaaacagtagttttgcttcatcagacgcttcatcattgaaaagtgcttttccttcaatttcatcatctgcttggattaaatcagcaattgatagaccatcgttgtcttctggcataggctcatcggccaatttagccagttctttttctaagtcagcaaccatattgtcaaatgagcgggtcttcttcagtttaataccgaaggttttggcatattcgtcgagcttgtctttagcttcttttttatcgagtgcctgaatttctttaatatagtctttatctagcattgggtgtgcctcatgtaatgtataaatatgattgtatttataaactgaggatagtacagtgcacgacatccaagtcaaatttaaagattttagtcatgttcatattgagtgtgatgactcaattttctatgaactcagagactattttagcttcgaagccgatggatacagattcaacccgaaatatcgttatggacattgggatggaagaattcgtctgctagattataatcgtctcttaccgtttggtcttgttggccaaattagaaaattcgctgaccaattcggatataaagtttatttcgatccaactatattcgagcaagaaactctttcacgggaggattttgacaattggttatcgactaaagaaatttattcaggattaactaagattgagccacactggtatcagaaagatgctgtatatgaaggtctagttaatcgacgtagaattcttaatcttccaacgtctgccggtaagtctcttattcaggcattacttgctcgttattatgtagaaaattacgaaggcaaaattcttatcatcgttcctaccacagcgttagttgaccagatgattgatgatttttgtgattatcgtttatttcctcgcaatgctatgttgggtattcgaggtggtactgctcgtgattcgaatgcattagtttatgtatctacctggcagaccgctgttaagcagcctaaagaatggttttctcaattcggcatgatgatgaatgatgaatgtcatcttgcaacgggtaagtcaatttcaacaatcattgcgggtctcaccaattgcatgtttaagtacggactgtctggttctcttaaagacggcaaagctaatatcatgcaatatgttggcatgtttggtgaaatcttccgtccggtatcaacttctaagttaatggaagacggacaagtaactgagcttaaaattaatacaatcttcttaagatatccagatgcagccgcaaatgctttaaaaggaaaaacgtatcaagaagaaattaaattcatcaccaatgttaagaaaagaaaccgttgggttgctaatttagctgctaagctagcatcgcgtgatgaaaacgcttttgtgatgtttaaacatgtagctcacggtaaagagctattcgagatgattaaagctactggtcatgagcaagtttattacgtatcaggtgaagttaatactgaaacacgtaatgctttaaaggctatggcagaaaacggaaagggaattattatcgtcgcaagttacggtgtattctctacaggtatttctgtaaaaaacctgcatcatgtaattttagctcatcccgttaaatcgaagattatcgttctccaaacaattggtcgtgttcttcgtaaacacaaagataaatctttagctactgtctgggatatcatcgacgacctcggtgtaaagccgaaatccgccaatgctaaaaagaaatacacgcatttgaattattgcttaaaacatgcattagagcgtattcaacgatatgctgatgaaaaatttaactacgtaatgaaaacggtaaatctatgattaaatttgaagatatttacgaagccacaattcgtgaggctactatcgataacttcatgagtaaaattaatgcttgccaaaccttagatggtctgaaagaactcgagaagtattacgataagcgctctaaagaaactactcttgctgattctgatgacatcattgtgcgggatgctttggcggggcgtagacaggctcttgaagctgattctgaagatgacgaagacgaagacttctgatataaaaaagccccaaccgaaaggaaggggcaaagccaattggctacatcaacactagactaaattaaaagttgcgtttcttgtaattgctcttctgtgtcttcagtgacaggcaattcaatcgcataattatagcaagctccgggatgaaccgggcctttgtctgtgtggacaaccaatgcttcatcgattggtcctttacagacgacacataccgtattcgacatgattgtctccttagtttacaagtttatttattacgcgccagcttcaaactgacgaaggtcaataatgtgcttaatgctaaaacctcgtgacttgatagcatccattgcatcgctacagaactccaaaagaattccccaatattgcaatttagtatctacacccaagatttctttatcagcgcttaaaacagttttcatttctgatttttcatatacatccatgcatacttcaccaccaacctcgccacggccagtgtaataatccaaccgtgctttaagattttgctttttgagggcatctaatcttaacatctcttttcgacaggtcgagtgcttacgcacccatttaccatacagaacggggttattagccgcttcatactgtagtttagtctggtcgataatcaaatcattatccaattcatcctgtaattcttctaatctcattctatctccactctactgtttctttggaaggactagtcccattatactctactgctagagttagcattactacgcatctgtatgcgtatacgttctagcgtatcggggtcgtctactatagaaaactgcacggtgacaattatagcattatcgtcatataacggaagcacatcaactgatagacgattaatcctaggctcataattacgcacagcagagactatattacgctttatcgtatcaccagttaatggagtcatgttttcaaataattcgtttgtgatatcacaaccaaacgctgggtcaaatggccgagacccctttcttgtggttattattccaagaaggctgtttttaactgatcgagctcctactgtttttgacacgtcagtgtcccaagcaagtcgcatttctgggtcaaggtcagaatagagtttatcgatattgctcatgacataatcttaaagaattctttaagccccttaattacatgaatgtgagaaattccgcattcacaagtaatgggaactgccaattgaacctgtggcttcaatagcatatttttaatgttaactacatcttcggttgtaatagcagaatataaatcatcgatttctgcatcgtttaaatcattaaagtaaatctgctcatttccaaccacgatataatctatgcattttgatatcatcattggaatgtcggaatcgtcaaaaagattaggatacttgaactttatcttgaatccctttaagtcataccagaggtcttctggaggatcgatttgcgcatgtgtataatttaatggcacaggaattttacgcccacaggtgcaattccaggtcacctcatgattaacctcgcctatactatgcgcccaaagtataactataagtaattccgattcttgtttgtttaacccagtagcattagtacattctctgagcaatgctttaacacattcatcgattgtaccgtttttcttcgctgcaattaaattagcgtattcttctagtgtaaaagctcggcactggatattcttgccatttattcttgtttcaaatttatatgtgatgttcatatccactcctcttattcaattatttataaatagtataaagaggattaccttatggccaacatagttagatgcgaattaccagatggtgtccaacgttttaagccatttaccgtagaagattatagagaccttttattggttagaaacgacatgaacaccaagtctgaagaagaccaaaaacagcttatagcagaattaatggatgattattttcatgaccatcctgtcgagtatcgtccttatatatttcttaaagtatttttgtcaagtattggtaaaactaaaataccagtcagaatgaagtgcccaaaatgcggaaaatataagcagtatctttttaatcttaatcagcctccgttgacaaatccgaaagtagaggttgcaggattaacgcttaagttcaaaaaacctatagaaataattgatgatacaggtaaaatgattttagacaacattatatctgtgaaggattcatctggggaataccagtggaatgaattaagcgatagtaataaattgacagttatcgatgctatagatgttgaaaccttggaaaagattttatcgcagatgaagccgtttaactttgagctaaagacgtcatgctgtgataccacgacagtattaaaatatgataacattgttgatatctttaagctattgctacatcctgacgagattttcacattttaccaaattaaccatagattggtttctcaaggtaaatatgacttgaattctataatgaaaatgctgcctatcgaacgtggcataaccttatcgcttattgaaaaggaccttaaatcatgacagcacaaagattaggatatcctaatataagcataaaattatattctggatatgatgcgtggctagctaatagattcgttgaattagcagctacatttattacattaacaatgagagattcattacgcgggactaatgaaggtctgcttcagttttatgattcgaaaaatatgcacacgcgtatgaacggtgatgaactggttcaaatatctgttgcaaacagtaacacatcaagaacacaaactcgaatttacggaattaaacactttacagttggtgttgatgataaaggcgatagcattatcacccttcagcttggaacgctgcatgacataatgaatctcaagttcagtagagcgttttttagttctgcatatgaaactataaaagaaatgataggcgcgatgtatgttgaccaaccattgattgctcctcctatcaacggaattaacgcttacgtcccacgagttccatggactagtactctcaaagattacttacgatacgttagaaacgtaggcatttctactgataacgaccaatttatttttgcctgggaagatatcactgggattaacatgatggattatgaatcaatgatatcccaggacccaaatgtattcatgttcggggctcctcaaacaataggtcagtttgcagcaggattaaaatatccattagcatgggattttgaatggcttgttaagtcaaatagatataatagaaatcccatgaaaaacgcaacattttatgcacactcatttgttgacaaagatgttacccgaattattaatggagaaggccaaaacagcgtattcattaatagatcaggcggatattctgacatgatttttaggaatggctatgaagaagcactacgcatttctacgatggctcaatatgacgggtatgctcaaactaagtgttacggtaattttgaactaactccaggaatgaaaatcaactttgttgatttaaaggaccagttcagaactgacttttatatagatgaagttatccatgaaatatcaaataacacatctataactaacttatatatgttcacaaacggctctgcccttgaacctgtagatttgattaaggtgaaaaatgaacttaaacgtgattcttcctattaagaaaatagtaataaatgaaaagacgatatcaattccaaaactggggttaaagcaccataatctgatgaaagatgttaagggtccagatgaaaacatgaatcttcttttggattcaatttgtccaggattaacagcagccgaatctgatattgttgtattacatttattagcatttaacaacagaataaaagaaactgctgttaaagatgattttacctacgatttgaataaggtttacatttgccagcgattaactcaaaggttagatggtaaagaattcaaattcagagctcctcctcgttattccaaactaggttcagtagattcaattttgagcgaatttcttgaatcagtagatggaaaaccaatggatataaactttatgaagcttccagcttttgtgacaaagtgggctgatgacttagtaaacactatagccattgatggacctgaaggaccaatcaaaggcatgcttaacgtaatggaaatatttgaatgactaagaaatcagaaatgaattcaatgcgtagaagagttattgctgactcggctccacagaaaaaggctgagtctcaagctgatgctcagattaatacgctagaagatattggtcgtcgcttagacgaccaacaagcatctactgatttgatttcggatgtaatagaaactaaatcaaacgaaattatcaaatcggtagaagatgtttcagctggtgttgaattaactgctgaagcttcagaacgcacaacagatgctgtctctaaactaaatgataccgcatcgttaattaatgataagctcacgaaacttgccgacttgttatctaaaaagcatgatgttcagcaagatgtccaaaagactggtactggaacatcattagaaacgataacagaacaagtcccggatgctcctactcagcagccgctagaggaattactcgaaagacttattcctcctcaggatggcagacgtcctgacgcggatttctttcctagcacagaagagcaagaggaaaaagctgagcctaaaaaggaaactgaggacaagaataaaaagtttcttgacctaaaatttggagaattaattaaaagcgttaaatctggttttggaaaaactatttcattaacagataaaattagcagtatgctgtttagttatactgttagcgctttggcccaaatggcgaaaactgccgccatggttttgggtgtgataatgcttatagatttaattaaagttcattttaattattggactaaattattcgaaaagaactttgttgaatttaacaagcaagccaaagaatggggtccgctattaacagcaataagcgagatgtcgaatgaaatagtaaaatcattcgtcaagggagattggggcggattagctaaagccataggttctggcttggttgatgtaattgacaagctcggagaaactattatgctcggaatgagtaagcttcttgctggaatgttacgcgcattaggatttaacgattcggcagataacattgaaggcgctgctttagacagatttcaaactgttactggagcagaactcgatgaagaagatgctaaaatgagagcaaaatatgttgaccgtcaagaaagagaatatgacgaacaacctgaatggaaaagaaagctttctgctaagttccaaaaattcaccggtcagattgatgacgatgaatataacaaactgctgagcggagagaaaaagcagtcagcgtatgcagacttgccagaagaagaacgcctcaaaatcatcacagctcgtaataatgctgaagcagaaatgaagagaacaaaagcatatgttgaaaaaactgatgcatctgattccactcgattagactctgctaaggatgcagtacaaagcacaaccaccagatataaagaattggagaaattatctccagaagttgcaaaagatttaaaggttgaattagaccaattgcaaaagcttcttgattctaaaatatcagaacctgctccaactgccgaagctatacctgcagcagaacaacctgaggttaaacagtctgcttctattaaagccgccgcggatagtcgtgaagctgctcgtacacgtgaatctaatacacagtcgcaacctattcaggttaataccgctgtaaataagaatagcacatacgtttatagaacgcctccacagacttcgacagctgctcctggaatgcaaggcgctatgaaaacctcttaaggaaaaataatgatttttgaagaactggccgatggccttgaaaacatcaaaaaatcaggaactcgaatttcccaaggtaaatctaaactgacgaatgcgccaaccactaaggtggcgcagttcccagctgaacgttcagctgggaatgattccgcccaagatatgagagtacatgacttatatcgcaatgggttattattcacagcatatgattttaaaggaagaacaactcctgatttgcgttcatttagacgagatgtaatgttatcgtctgtattcgattcaccaatgtcagcattggctaattcatcaagctctaccactagtactgcaccagtagctaatattctattaccgcggtctaagtcagacgttgattcagttagccataaatttaatgatgttggggattctcttgttacgcgtggcggcggtactgctaccggtgtattaagcaacgtggcttctactgcggtgtttgggtcgatagagtctttaacgcagggattaatggccgataatggtgaacaaatttataacaccgctcgtagtatgtatgccggacctgacaatagaacgaaagtgtttacttgggatttaactcctaggtctgcagatgaccttatacaaattattcgcatctatgaaatttttaactactattcttacggtgtgacgggaaattcatcatacgcaaaagaagttaaagctgctattgatgaatggtataaaggaactcttaaatccgcagctccagatggggctaaagtagaaaacacagtgtttgagcaaataacatcgtttttaagcaatgttattgtagtttctaacccaacgatttggactgttcgtaattttggatattctacatcaatggatggtagagaggatatatttgggccatgccaaattcagagtatccgctttgataaaacgccgaacggacatttcaatggtttagcaattgctcctaaccttccaagcacgtttacgcttgaaattactatgcgtgaaatacttactcttaatagaggtaacgtttatatcggaggtattgaataatgtttactctcgaagaatttaagagtcaagctgctgatatcgatttccagagaactaatatgttctctgttgtattcgctactgtaccctctagtaaaacccaggctcttctaaacgactttggtggagagctgtataataatatgggtttagatggaaattggcttggattgacaccaggtgaattcaatcagggtataacaactatagtgacacaaggaactcggcaagttgttcgtaaatcaggtgtgaatacatttatgattggcgcaatgactcaacgtgtggtgcagtcattattaggagaatttacggtaggtacttatctgctcgatttctttaatatggcatttccaacagcaggattgatggtttattctgctaaaataccagagaacagattatcatatgaaatggataagttccataacgctcctaatataaaaatcacaggaagagatatggaaccgctggttctttcatttaggatggacccagaagcaagcaactaccgggcaatgcaagattgggtaaatgctgttgaagacccagtgactggtctgcgaggattgccacaagacgtagaatgtgatatccaagttaaccttcatgctagaaatggattacctcatactgtatgcttgttctcaggggctatgcctgtagcgtgtggagctcccgaatttacatatgatggagaaaacacgatagcagtgtttgatgtcacgtttgcatatcgtagcatgcaaacaggttcggttggaaaacaagctgctatggattggttggaagataaggctattcagaaaattgagacgattaatccaaatcagggcttgagtgcgtctgcttcaagattgtctcgtttaggcggggctggtggtggaatttctaatatcactactacaacaagtagaataatttaggggccgtaaggcccctttgttttatgcaatgcagccaataaaccctggctcagtgcgaagaagttccatttcgtctgtggtccaaactactttaacaggaatgataccttctgctttaccgtttagaaccgcttcgacaaacgatggttcagttggcttacggaagatatcttgaataagaaccgtcggagtaccttcgttaaacccttcaagcatgataagaacttcttcattgaacttctctgcatctttaacatcagcagaccattcaataccgttaaagcgaaatacgtgtttcatatcaatttcctcattggtttgtgtaagtctatagtatcacgtccttgtgataagtaaacaactttatgcaagtttttctgggataccatccaggttgatagcaccagccagtagctccatggtacgcgtgtagctaaccttatctgtagaacggtctggcgaaaagtaaatctcatttaaaaagcctttgaacttgctttcttcaagaggttccactttgccctgttccatcaagatgtcaccatcatagagatgaacggattcatcgatttgctctggaggaactaccgtcatttctaccatgaatgtcttgttattcgctacaccaactccatttctaaaaggagttccccataccttgttaactttcattgccaacccgcgaggaagaataacttcagcctcatcgctaaagcttgacaagacacccgggataactaccttaactttatcggccccatgaataacgaatccaaacttaaactcatcaccataggcaacttcctcgcctctatcaactctttccaagttgtctgttccaataacggaagatactgcatcaatagttgtttctttgttttctaaatcagaactaggtgcgtctggcattaatgaatcaccagcatttgaataagcaccaaagataattggacttaacgaagtagaaacatagttctggaaataaaacattttagactcaatgttatctttaaagtcttcatattttcctcgctgaccgcgatacaaaagagtgcctggttcaagacgcaaacctttttcaaaggcagaatcgagcggacgaattttcttgtcaataatcggatcgcctaagctttccataccaataagatagttattaacaaatgaataaccagaaccgcagtaatggtgtattgcatctctttcttcttcgcttaaacgagattgcatttcacggttatattcaattgctttggatatagaatcgccaacaattgacacataagcggatatcatataattgacaagattttggtattgacgtaaagctccgaaatcgtcagctggaggcatatcaaatccacgagtagctacttcaacgattttacgcattgtttccatagatgcaggatttttagcttgagcaataacgtcagcaacgtctgaaattcgttgttcagcgattttcattttgtctgaacccgaaggaatgaaaaccttccagtcgtcatgcattctagacatttggcctacaaataatctctcaactgcatcgccaaaattacttccatatccgccacgaacacgatagtgcttgatatcatcaacataaaaaggaattgatttttctaatccggctttgatatctttttggaggtctaccgtatcgccttctgcgtttagtactggagtgttagtagttaattcgtaccagcgttcacgtttattttctggccaatcttcatcaacatatgaaacaaatttgccgtactgtgctcggattaaatcttttcgagacactttcattttactcattacagcgagttcagatttcttgtcttctttttcgccaatggaattagccaatgcttcggctttggtaacgttttcgccggtttctttagacacataaacttcgcctactttggaatctactttggtgtaaagttcttctgaaatttcaggaattccttcaatctcttcaagtttcttacctttacgaaccataatagaataagcatacttacctttgtagtaagccatatctttcattagattgaaacgaccgccggtgcgagtagtaatcaaccgagcaagaatgcgttgaatagctttatcctgtccttgcattttcttcggattaaagcggaacattaccgcatcagctttaatttgcttaactactttgttgacggtctcaaaaatggtattgatagcaccaatcgggtcttggcctaaaccacctttaagcgcgccgatgttgcctttttccgacacagagaaaacatagacctggatgaatttatcacccatcttgatgttcttaactgcatcaccttgacctgacccttgtactaaccgaatcattaaattgttattacccggcaccttaatcaaaaagacctgtggtaccttaagttttggcttaacgttctcgacgggatagattttactattctcttcatcgaaaacttcatttaaaagttccatgacatatcctcgtttgtttattctatttatacgaaaaaaggcccgaaggccttaattaattattgttactgtacgccaaacttgtagtccatttacagactcatactcttcaatgttttctttgaagtttcttaatgtgttaatgttattaaactcaagaacttctgtgtgaacagaaataccaccacgtccgtcaagagatttagcaatcacttcgtataaaactttcattttattcctgttgcctcagtaaagttaacaccaaacgcggcttcgaatgtattagccacttctttatcatatctacgctgtttaatgataggtaagaataatcctactgtaccatcatcacgaccttcagcagttacccatccattgcattcaagttcccagatagttcccggaagagaatctctgagcttccataaatgagtacggtcaagttcatgtaattcttcgggcttatctttaagacctgacccagcgttaacacgaatacgaccacattctgatacgaacattaagccgcccattttaccaggttgttttctatgctcgtacgaaccgacacatttcaaatctacggtgataacctctttaaatttaacgaggttcttagaacgcttatcttcccaataagcaccgatattcttaaggataataccttcgagaccttggtctacgtatgtcttatagatagcccgagcttcatggatgttatgtacgacacggttttcaattagaataaccttgtcatagcctttgctcatcatttccaatgcacggaagcgtacatcataagcaaatccaggaactttaccttcggaatatactacatcaagcggaacataatcccaaacttggaatctcataccttccgcttcttcagcagagattgttcctttgattgctttattagccaatccgtttgattctgtacgagccgtctgttggaattccttagccttacttagctcaggaagctcaggctctttaaacatatcaaacaggtcgttttcttcttctttcacttcgacatgatataccaactcgccgtcaatcatcacaccattaggatggcgttctcgggcttctttggtcatctcgataagttgacgcttaagtttatctagacccaggtattcattaccggaacgagtaagaagagttacatcatctaaatcatctccgcggatttcagcgaagcaccgggctccatcggctttaagctgagcgaatgcaggaaatttaatatatgatagcgctttctcagaataagctgatgctaacatctgtggcatctcaggaattaatttcttccataccttgttagcaatagaacctgaagcgccgcaacgcatatccttaagaaggacacggaccagtacactagcatcaccctcgttcatcttagagagcaaatctactagcccctggattgccatattaccagtaagtactcgtgctgccagaatgtcttggaggtaatctagaccatcagaaaacgtctttgaaggaacatttggatatttaacgggagtatattctggaactttcttaataaagaatttaaatcgcccggaatacgccagcagataagctcgttttaaatcaacgttatctttattgtcaataagaatttgggttttagctttagaacccttagcatcttcaattgctttgatgatatcaaaaatcattattcacctaattcttctgaaagttcgcttacgctacgatgataagttaatccatcgatataaacaaacccgttattgatgcattcattccaaatcgggcacgcctttgcttcacgccaaattggattccaacgataaaactgattaacatgaccgtaatcacatgataaccaacgtttacccaccttagtatgaactacaaacattattcctccttgggtatggtcattataccatacccagattgttagcaattaatttggtggttatcacatgtaatacgaccgttattccaccagtcgtttccaggaggaacatgcggaccaggactaaacggaatgataggttgtttccaccaatctcctggaacttgtcgtggaggccaattaaaaggatgttgctctttacgaatttggtctttgatagcttcttcccacaatccagaaagagacttctgcggtttcttaacggatttcagagattccaggcaagttacaatttgatgccaatcttcaaccataattccaggagcagtcactgaaccttctcgctcaccacgaggcatataaaacacacgagtttcagtgtcttcaaatactttgctggccgcagcaatatgtttaggcaaatcatctacatagcagacgatgcgatcgccgtattttactttagccttttccagtaaagcatctttagattcatcataatcgcagaccatgatttctgtaaatgcatcagggaacaaagcatttagattgaaacgacgattaaggttagcatctactgagttaccaagagccgtgatagcgacaaaatcgtatttttctttgagcttattaactgtagctaaagcatcagcatacggagcaagataacgaataaaatcgctgttgttgtacttcagaagcagcttaacagccagttcttcttcacaatcaaacagctcagcgggtttaatgaatttttcagtagtcatcatatcaaggatatgctctaccggaagattatatttttgggcaaaataaggcagaccactttgccacttaacgatgattccatcaacatcggttgcgattactggctttgacattcggggaaattcctcaatgcttgtttaaatttggcaacgctatttgcggcaccggtgaaattgaaccagattaaccctggagcgtccgcgggttctatatcaattatttctatattataatactcagcagtctttagcatttccctggtgatacgtcgggcaaccatatgaccgaagtgaggattaatagacatcgtcgttagcagcccttaattgagtaattggataaagctcggattctgcatggattgaacgattgccatcaacccaattaacttcataccacggttcaactgagtaggctttaatggctggagccgtatcacatacaactccaggaattccatttgctaatcttactgtactgaagatatgatatttcatgcatcaagtctcactgcccattcaggcaattcaaagaaatccggagcatcaatttcatactcaacggtgtgttgtttaacgttagctgacatgatatcaaccattgggtggtttttcaaactgcaagaaaaaataccagctttaggtttaggcacggatacaatcatgttgatttcctcaaaatttagttatgaatttttctttcggcattttagcatttgagccatcactgtcagaatacccaattggcatagttgcattaatgaattcaattttagcatttataacattaatgctcagagaatctacaccgtcaatcatacgaaattcaggagggcaatacttatcaatgtatgctttcacaccatttttattagcaggtgtaccatcgcgggtatcgctgataatggtttcaacttttttctttcgtgaatcatagaaagctgatacaatcatttcaatttcctcttaaaacgggcgaatattaacgtgaaccacagggacagcaaaaggttgcatgattacaacttttgtgtctttagttgcattcaggcgttgtacttttgcaagattaacagcttcttcctttgtcaatccacctttgtaggtatcatttcctttatttgaggtccaaacaccccaatcattgcttccatcgtcggtcttcggttcaagttctttgtagatggtttcttcaaaataatgctgaaattcttgattagtaataatacaccacatgtgagaaaagcgaacttcatctacactaacgcgtttgcattctccatctggcttaatgatttcaaattcaactaatccggtattttccgcatatttaaaggttctggtaattttaattggattattaccgatttgctcaaaaacacccttgataagagcgcctggagacaagcttggagtctttttaagcttatagaatttacctttttccattatcatttcctcaatagtggggccgaagccccgagttagttaaaacttgatttcgtttgaaacgatatcccagattgcttcacgttgttcttcggttgttttacgaccgaggatgtggcgcagataaattttaacaagcagctgacgatttgtgttccaagacggatgtgaagataaatcacgtttacgaacttcatcatgaaatccaactttgatttcagaaccgttgaactgaatatccagagtaggaccattttcaaagctaaagaatacgtagttatcttcccagtacatatcgatttgagctactgtgccgttgttgtgttcccacagcaaagtagtagaaacgtcccaagcattgttctgtacgtatttgcggttgaagttagtgaagttcatttttattctccgtagtttgtttatctgtttgggtggtacaggtctatagtaacccagaccacccaagaagtaaacaacttttattcaaaaacttcagacatttttcacctctacagtttttacagtttttacttctgcaaatccgatgcttttaaacagttcatacttggtagtttctggaacgatatcggttagctcaaggatgatttcttttgcttcttccagagtaaagatgcttcttccgtccttaacgaccggtgctggtttaatagcagctgatacttcaaaaaccacgtagcggtcagtagtactttgattttcaaacgctcctatttgcacaacccgtccttcttctaactcgtgagaagaaaataagcatgacagagaccggtcatattcatctcctatggtttttgccgaaatgattttaccagtttcggttttaatcttaacaacccggcccagcgaatcaagttctaatggcgtccagccttgaactccaacaacggtggcaatgagatagttaattgtgttcttagcgtctttccatctacggtaagtttctggggaaatgcaatatactcggtttttgctgtaattcattttgatatcctcaaagatggggccgaagccccagtcaagattactgtttagtccaattatccatgtttaatttaccaacctttttcatttgttcaattaaagcatcggcacgattacgaccattttcataccaggttacatcttctgagtaaccgtcttcttcatctgtgtaggtttcagaacgaatacgaccaacaactggagtgttcagaacatatacagaacccgtgaaccagtttgttaaagtgatatgccagcagaaatcatctgatggaccgtccggtgtcatgcatggaacgatatcaccttgaactttagacaaaatccacattttctcatggacagtttgagctttgtaaccgtcatggtctttagtcttgatagttgcgttcaggttgatggtattcattttattctccgttgtccgtttgggtggtacaggtctatagtaaccttgttgaacttagaagtaaacaacttttttcattctgcggaaaataaaaaagggactcccgaaggagtccctgaacttatgctttcggcttaccaaaacgagaagcatcatcgcgaagaaccgcacgagcccgacgcatgattttctcaaccgtctgattgatacgcttgttcgacccacgcttgtagccagcgcgtttagaggtaccaacaacttcttttactgcagtttttgctttagcttgtttagccattttatcatcttccattttggagaaatacatgggagcacgttcttccgaggttcaacttctttcgacagttctttcggttgtagctcccgcaagccctcaagggggtacgtttaaactcttatctgttgcacaccgttagcttaaaggttccgggtccgatttatcggggataagatatacaccgatggatgtataggccttgaggcgtactcccgattggccatcgcctcggggtagcatgcacttgccgtttattttctagctgcactttggtagcaaatcaccgttggtttcgggtgttttacgtggggataaccaacaacgtccacatcatacgttacccatgcgtacacatggtgggcgtacaaattacttcagcgttaccacaaagtggcgaacagctttgcgagcagcagaaccaagatgcttagcatacttcagttcgtccatcgcttctaaagtatcacgaaattcagcttgtgctgggttcaggtgtttaaaccctttcagaacttccagtgcttctgcatagatatcgattgaagcaccgtagttttcgtgaccggaattccatgcattacgttggagttccagagctttagtaagttgtttgttcattgaatcgttcctcaaatgaggttaaaatttggtggacggtaaccgaggtttagctcgggcatccaccgcgtagaattgctcgggtaactaattgtccgacgcccaattcatattattatttatatacgcatgcaagggacttataatgacaagtcacaaacttctgccgaatttctttgggtttcttcacacctgctgctactaacggatgaggtacgtttctgatattaccaacaggcagtggagtcaaatcaccgacttcaacaaatcctttcggtacatcatcaccgatagaatagatttcacacatatccggcagttgtccttgttcttcttttccaagaataataccggaaggagaaacaatttcatcaccttgctgagcaggttcagatacgagaattacatactcgcctagagctttaattggaagttccatgtgttacctttattgtttgaccatgtagttatattaacatggtcagtttaaagcaaattacttaccgatcatctgcagcagatgctcaactttcataccatttaccgagataagtttatcaaaggtaaatgagcgccaaccttctttctcagtatcatataccggaagtgaagtagtgctttctgctcgggcagatttaatagtgctttctaccaaatcagatggaataatatctttatcacgagtacagcgcagagtacgaatagtgccatcagctttttcaaacacaatctgggattcgcccatgctcagcacagccttcagagtttcacgaatatggatgttttgttcagtagtcagtttcattttgatgtctctttaatagttttgataattacagatttgcgcttggataattcttttaataatcgaactgcttgatcttcaaatttaaatgttgctaatggtttccatttaaaccaataccggcgttctactgagtatgatataacaacatcaccacttaggttaagtttattaatttcaacaattctaagtttcattattcaattccacagaattctttaatgttataccaattcaacttatccaaattacgttttggaacattgaacacctcgattccagcagaacgaagaatatcgtcccaaccgggttcgttcttgtcgtatgtttcgcagtatactaattttttaataccagactgagcgatggcttttgcacaatctggacatggagacagtgtgacatacattgttgctccatcaatactactgccgttccgggcagcaaaaagaatagcattaagctcagcatggatttcattgactttagaccatgcagagtgggctgctcgatgttctttgagcaatccgacttttttgacttggaatccgtcttgacgcaatcctgtagatttgtaaggaatttcaccaatccaaccttgttctgctgcatggtcacaacagttcacaccaccagaaggtgaaccgttatagccagtagaaataattcgtccgttcttttcaattactgcgccgactttccacgagcagcattttgactcttgagatacgagatacgcaatttgtagtaccgtcgacgctttcatttaaatcaccagataagttgtgttatttgttttaaccaattttaactcgtcagtaggagaagcaaaactctctactcgagaagtacgaatgcctgtaccatctggaaacggatgattccctcgttcaagaacatcggaaaagacataaccataaagaggttggccttccttaacattaacgttactgtacaaaatagcatcatattcttcgcgtggaattgaccaaacaccttggtcagaaccaataacagcactgatcagccgaatgccatttgggctgatttctgctttaatgccacgagcatgttcaattaaaagagcttctaccgcttcacgtaaagtcattagatatgtcctaaaatgttagtcatttcaacttggcctgttccggttaaagccaattgagtgtgttgattgctctttccattattaactgtaatgatataagcatcaacatagttaaaggatgactctcgtcggagagtcactttacttccaggaacccggtttgctacttcctgtgcgaagattttaaccttcgaaataaattcatcatgcgaaaatttagcgtcagacaacataagtctcaacctgttgggtttcaaaattagcaataattccaacgataaaccagtcgtgttcaccttcgccgcaagaaattttaatttcagacgaaccgcctgaccggtcaatagaaaatttaataacttcgccgtttggaataagtgcattcattgcagataaaaactctgcatgcattttggctacttcagatggagtaaactcatctgttaaatgattagcaacaacttgcgtaaatgatacttttactacttcggaatactttggaaacattatactttcctctaaaaatcaccgtgggctacttgccagcattcaacaccgatacgacgccacatttcaactacctgcgccctgtcatctactgcaagtttgacattataacgatcagcaattcggtcccagaagatttcttcttttaccacatcgtctttgcgtgaatcgccttgcttacgttggaagtgttcgcctgtttcgccaacatggtccaacaaccatttcttcgtaatgcgttgataaacagtagggtcttctttagtaccagactctctgccggaaacagtaagaattttatatcctttgttacgaagcattttaagaaattcaattaccatttcctttggatggtctttaccacatttggccaagtcataaggagaacgatgattgttatctgctaacgtgccatcaaggtcaaagataactgcttttggcaatgattcatctggaatgtacaaatcatacggatgcatcttagagtagaagctacggagcacttcaataggaactgcattcgcgccacgatagaggttacgcttaactagttcagtccaaggaacgtcaaagcgtttaatttcccacttgacaccatcaatttcatatgccaactcttgccacttcttgatagtcgttggattaaggttagtatcagcaatgatgacacctttagtggtttccatctcgagtagagtcttcgccatagaaaactggcatacagatacagacttctcacgaagcttagaatatttgtaatcattacgtttatcaaggccaaagatgccttcacgcaaatcatcacgagacaaaacataccaaccgggattagctgctacgtattcgttagcccaggttgttttaccagagcctggagccccttgtgtcaaaaccaattttttcattatacatccttaagagtgtcaataaaatcatgaagagccttagacttttcaccccaatttgcacgatatttttctttaattgctcgcaatggcttattcattgacagtatatcatttttgtcataattttcagctgcgcgtccaaacacgatgcacgccaattcattttcagcaattaaccctttaagtgtttcatactgttctcggttcattataataccatcacttaacgcaacgaggttctttaaggtcagaacgataataacatatcattccgttagcatctttagtataacgtaaaatgtcattcatccagatgcgatactcttgagactcttcaaacggcataccaacccaggctttaccgtcaattacttttacttcccaatgtccttcccatttttgaattgggtctggccactcaggatgcaaaaccgggacatccggtgcactagaagaacatccaacaagtaggctgataatacccatggctaatagacttcgtttcatctggtagcctcctggatatcttctgcaaacttattgaagcttgcattaatctgtttttcaactaacccaggtttagctgcaactacgtttccacgcttagcatctttattcattttagcgttggaagtatcacgagctgctcggttttcctgatagcctttataggttgtctgcagattttttatagaaacaccgatattttctatttcttttgcttgtcgatcagattcatcttggacgactttgaggtcagctttaagattttctacccgccacgaaagatatttcaatccaccgacggataatgctaacacaccaatcatcaaccaagttgtgtttattttgagcatagtttaaggataacctctacgatatcatcacgggataatcccgaaatgaggatgtgacgatcagaactttccgaaggagaacacttgaagcaagcttctacatattctgccatctcagaataattcagctcgcgatgcataatgccaagacgatgtttgccataaatcgggtcaacgattacatagcatttgcatccgttggcatgaacgtttggttgagtgatgtttttaaacacctctgcaccatacttcgcgagatgattatctaggaaatcaatcatttcatctacggcttcaggcaaggcttcggcacgctgctcgttcacacgattagtgtactctttttgcttcttacgagcagcttccttgcgtgccatatgcgttcgtaggtcagtgacgaatcccactttcttggtgccattccacacaaaatcccgtcagaatgagtaccatatttgttaacaaccatatctaaagtaattgcttgcatatccatttcattatcctcatcagttggtgtaagtctatagtatcacaccttgatgaggatgtaaacaactattcttcagaaatttcaatttctttttcgtactcttttggaacatatccagcccagtacttcaagaacactttttcgaggtctttaagcagtttatcaacatctacagttccttcgtacatgttcatgataacaccaaaaagatgacgctgattaaccgtggctttctgcgcagcaatagcgtagtctttacgagcacgacctctgtattcatcatagaatgactgacatagctcaagtgactttccgaggtaatctagataagcttgctcaaacgcagaaattttcttaattgcgtattcatctccagcaaaaagagaacgcaaatcatcggaatttgcagatacgacagacgcaaacagtctttcatttgacgttattgagtctttagtgtgatgaagagccgagtaccattcggttttaaccttaaatctctgcccagtgtttagaactgcaatgtatccttctacgccttcaagtgcacgaacaccttcaacccaagtgtcggggtcagaaattccataagcattaattaaataaggacgaattttagcattagcgtacaaatcgtcatatttaacatactcgccggttgcgttatcacggacgtttaacacaaacagctgtggctcctggtatgcaagaacaacacgattatcaggtgaaacaaattccatgtttacagtatatccatctagtgctagttcaagaacaacttgatgaagcgaagagtattcttcactattaagcagggcagaagaccttctcgcctggtcactgtagagagatgtttttgacttaaggtatagatacccatcatcaacataagatgatactagagagccatcagccttatccataatgtattctacatcgctaatatcaattcccatcgttaatgggttttcattcaaattaaagaatttttccattggacgagaagcaattcgaattggagtatcaccatccatttcaaacatgatgccccggcactcaagagcatctggttttaaccactcgctgtagcttgcatagtgatatgaaaacactctgaacttaccatccataggaccggtaaaatctttataaaagaattttgcaacttctgagctttcacacagattcattaaatttttatatagctctaacatttctttaccttatgtttgcaattatcgtagtgccatctgatagcaatggcctttgaagttattataccacaatgcgggcatggactgtacaaaggctttttctttcctttttggctttctgaccgcttgagtttagtttcttcagattgtgttttaccggttaaagattttgatatcttttcgcgtgtttctttggcatgagtctttccttgagtgggacttactctgcctttcagtgctttagataaattctttctatgttcttccgttcgtttctttccggagaataagttagatgtataattagaatgctttattctagagctttcataaaatctggaatgaactttaaaattctttccagaagaattacacatcatccaaagagcataattcattttagaattattatgtatctttgataatagcaaatgggcaatgaaatgttcacgtccagtcaataaaactaaattagaaacatcgtcatttcctcctaatgattttggaatgatatgatgagcttcagtataatagtttaattttcctttatcattgcctcgtaatttaccctttgctattaggttatcatatactttaacatagttcatttagctttgttagtatgttgtgtgttccatggaggattgaacttcttaatcagaagaggttcttccaagtccatagtggatattgacatctcgccaagttcattattaatcgaaagattaaaacactgacgagcatagaactctacttttttgccagccattagtgcttcaaaaatcttggcagatttagctgaatcagaggtttggtctttccgattaatagcagttctataataatttatacgtttacgaagattttttgtcttaccaatgtaaaccagctcatcatcaactgcgatggcataaactacgttcaacttgtttgctatcagaattggtttgatggtaaaatctggttctaactcaagttgaacatattttataaaagaaaactcgttagcaatatcattcataataaagaggggccgaagcccctttccttataagtactttttaaatccaattagaacatcatcagtgacatcattgtcaatctgagctaccagataagaacttatctcaacttcctgaggagcagattggactgcatcagagttaagatattcacgaatccagggaataggatgtcgagttggtgcgtcagtgattgggcacggcagaccacagctacgcatgcgagatactgttaagtagtcaatgaagtcatgaagaattttaacgttcagacccggaagaccaccattacggaaaagatggatagcccaatctttttcttggcggttaacttccatgaagattttaattgcttcttgttcacactctttagcaatctcaacccattcttcgccatcagtgccagtttgaagttgacgcagaatgtactgtgtgcccttcagatgaagttgttcatcacgagcaatgaacttcatgattttagcattaccttccatgatttccatatttttatggaagttgaaggtacacgcaaaactaacatagaaacgaatagcttctaatgcgttaataacatgtaagcaaagataaagagatttcattaaatcgcgtttagcttctttaatttcgatattatcttgattaaagcagcgatttttggcattttcccatgcgcgagtcttcgctataacatcatcatagtaaacaccaattgactcagcgcgtttcatgattgcttcgtcaagaacgatttcatcaaagattttagctgggtctacataaaggttacgcatgatatgcgtgtacgaacggctgtgaatggtttcactgaacgtccaagtctggttccaagtatctaggcttgggtcagaaataagtgcagataaaactgctgctggagctcgtccttgaattgaatcaagaagagattggtacttcaagttatcagtgaagatattacgctgatgttctgggagtttttcaaactgaccacggtccatcataacgttaacttcttcaggacgccaaaagaaactcaattgcttctcaatgagttcctcgaatactttatgacgctgaatatcatagcgtgcaattcctagaccagaaccaaagaacatcggttcggtcatgatatctacttgcttggtattaaaaactgtactcattctatttcctattctgtggtgttaaccatccgtggtctaattataattcccttttattaaagcttacaggccgcgcagtcagcagagtcttgaatcatatcatcgttaccggaaccgtcacgggtgttatgatagtaaagagtcttaccgccaaagtaccagaaataaagcaagtcgtccatcattaccgacatttcaacttttcctttagggaaattcgccgggtcgtaataagtattagcagagatgctttggtctacaaatttctgcataatcagaacctggttcagataaggcttattaccctgtttcgcgagctgccaggcataatcataaagggaagcattgtgctcaacatttggaacgacttggttgaagcttccttcttttgattctttaactgacactggtccacgtggtggttcaataccgttggtagagtttgatacctggctagacgattcgcatggcataagcgcagataacgttgaatttcggataccgtatcgcttgagatcttctcgcaggagttcccagtcacagacatagtttggagctgcgagttggtcaattctttcgttgtaccagtcaataggcagttcaccacgtccgtatcgtgtttctttgtaaagcgtgcatggacctttttcgctagcaagtttaacagaggctttgatgagtgcatattgaatacgttccatcatttcgtgagtaatatcattagcatctgcgtatgaagcaaagttgcttgctaaccaagctgcatagttagtaatgccaacacctagtgctcgacggtctttagcttttaacgctttgtctacaggatagtcttggtaatccaaaaggttatccaaagcccttaccattacttctgcgatttcgttgacttcttcttggtcttgccagttgaagttgtcgagtacgaatgctgcgagtgtgcatagcgcgatttcgccatcttcttggccaacatccgaagttggtaacgcaatttcgaggcagaggtttgattgcttaaccgtagccacatcacgaataaaaggaccatattcaccaacgttatctaccatgtacgggtaaattcgagcagtaccagcacgttcagtaaggaacaactcaaacagttcacgagctttaatacgtttctttcttacgtctgggttcttttccagctcttcgtataaagtacggaacgcttgtgcatcacggaagtattctgtgtacagcgtgccaagacatacatcgggactgaacaatgtgatgtaatcattcttaatcaaacgttcaatcatcaggttattaatctgaacaccataatctaaatgacgaatacggttttcatctacacctttgttgttcttaagtacgaggaggttttcaacttccaagtgccagattggatagtacagtgtcgccgcgccaccacggactccaccttgggagcaggatttaactgctgtttggaagtgcttccagaaaggaataactccagtatgtttgacttcaccgaatccaatttttgaaccctctgcgcgaatcatgcctgcattaataccaatacctgcacgcttactgatgtatttcgtaattgatgcagcagcttcgttaattgaattaagactatcaccaccttcaataaccacgcatgaactaaactgacgtgtcggagtacgaacaccagacataattggcgttggcaatgaaatctttttagtagaaactgcatcatagaaacgaataacgtttgctaaacgattttcgccatcatcttggtgcaagcacataccgatcaacataaaggcaaactgtggagtttcatacaattcaccagtgtgacggtcttttacgagatacttctcgataagctgcattgttccagcataagtcatagtgaaatcacgctcatgcttaatataagaatcaagcaaagtaatttcttctgctgaccatttacttagaatttctttatcgtacttatttgcgttgacgcatcgggaaatgtggtcaataaatgcaggtggctcaaactgtccataaacacgcttacggatttcaaacatagctgcattagacgccacatattggtaatccggttcatcaatagaaatgctattcgccgctaccttaacgatagtcttttggatatctgcagtgctcatgccatcacgtagatgggatttaataatttcatataactcgtatgggtctactttggttccttcgcacgcccattcgaggactttaatgattttctgcatgtcaaattcttgactaacacctgagctcttaattacttgcataagtcctctaattcaaatgtatctttaaaaagtttattcactacaagagctattatatcaccatggcaagaaagcggtttgcaggtgcatcctaatctcattcctcttaaagtttctaagtgctctcgctttatttctccgttccgaatcttagcaataaaatcgtccttaaatgccgcaatagcatcaggacgattatcgcaatctttaccgacgtaatttccccacattgttccacgttggatatttacatcgaagtcggaatggtatttattaaccacccgacatatcttcatgttatatcaacttcaaaccagcagattaattgtgttttgccaatagaccattcatatgatttaatgacagataaaacgcgttgttcgatcccgtcaaaaactatcttgtcattaacttcaggcaaatcactagagaatgcatcacacatctcgcctaatattgtttgtcctttacgaacaaatcgaatattcatatagccattttccccttaattgttggatgggatttatatccttcaagaacaaagtcagatggtttcatcattcctgtaacccaagctaattgttcttctgttgctaattcatgaaattctttatcttttactggaggccaataattaatttcaagttcacacagctcttttggcctctcactgttcaatatggttcagataaatgtgagtgttaccaccagtgaataccaaatgcccaggtttaagattggtcattttagcaatgatatgaaccaatgctgcatatgacgcaatattgaaggggaggccaaggaatacatctacagaacgttgataccactggaggtccaaatatcctttacgaacgttgaactgataaagcagatggcacggtggtaatgccattttgtccaaatcaaccgggttccaagcggtcacaatctggcgacggtcagttggcaattgcttgatacggtcaatgaccaattttagttggtcaacgcccatgaaatcacgccactgctttccatacacgggtcctaactcaccaccagaataccccatgtcttttgcctggttttcataattgtcgtcccagacagttttaccttctagtaatgaaccatgctgaataagacgcaattcatgaacattagtagacccctgcaagaaccaaagaagctctgcaatacatgctttccatgcaagacgcttagtagttacagcaggaaaccctttttgtaaatcaaaacgtaactgagtaccaaacttcgcaatagtgccggtaccagttcggtcatccgtctcataaccgttttcaaaaatgtctttaattaattcttggtattcacgcattaaatttttcctgaagaggagtaaagaaaagctgatcaccacgcttttcaaatcgcccaataatagacactacatcatctttgaccatcacattgccatgtgacattccgatgaacatcttcttataatcacgttcaatttcaataggtatatttccatttcggttatatactgtagttgaaccgttataagtgctaagaccattataactgaaaactagaagatgaataccatgcttaaatggaaatcttttccacctcttttggactttgtcttctgatagctgagtgatatcatagtttgcgctcatagaccacctctgaaatgttagtcacttcatcaatatgataccagtgattttctttagtaatgaatcctgattctggccaagtaggagctgctacaaattcagcaggtagagtgacatcagaattcactctatgactttttctgatggttgtttggataaccctatctgcatatggatatgccttctggatgattccggcaccacctatgatagaataattaaggtctctattaaaagtgatagtactgttgtaagaagtatgagcggccataatgtcaccacccaagaaaccgataaattctaattcacttacataagcatctgcaaagaagccatttttagcagttgccaacgcacgactcatgtcttggacaacgattgtcttacgaccaggaagaggtttaggaaaactcataaaagtctttgctccgcaaatcaagatagtatctcgagtacgattagcaaagtttttcatgtcctgggaaatatgtttccatggaagaccatcgcctaaaccgaaagcattttcgtttttgccgtctacggtttttgtaggagcaaatgcataaactatttgaatcatttaaacctcagcaaaattcaactcgttcaacattaccatcttcccacttctgttgaagctcttggagacgtttgatagcgctatcgatattggacattgcacagatagttacccattcacggccatcccaccaaatcaaatcatcgtaatcatctactgcgaaattttccattaaccttgcctcattccacacttaaaacaccggccacctaattgccataggctaccgccgcagtacttacaatcccagtcagttaaaatccacatgacttgtacccactagctttaatcatgttctgaagagttttaaacccttctttaatggcttctgaaatttcctcaaatacttcctttttaagaatatacaacgaacccgcttgattgccagaaagagctgaaatcacaacttggtcattaattaaaaattcgccatatgctgaatcaattttacctgaaacctgattgcctcgggaatgagggtcaaatacgagctcaatatgagttactccaggaatttcatcaaattggcagcgaatgttaacacgcggatatcccgttacactaaatttagacatataaaaataatcctaatataatgccgctaataaaagcggcagtaacagaaattagcaaaactactaattcagcctcaatcatttcttggccttagcaagtttaaatgcttttttgaattcttcaacatcttcaacaggaatccaaaagcctgagccatacccatcttcatagcatgggcagttatcacagtaatcattccaatagacagtttcaccacccatagtgaatggagcttccatttggcacagtacttcttcaacacgctctaattcttctgggtttttatcgcaaatgcagaaattccatttaccacgatattcagaaccaagtttgatgctttgacgttgaagtttcatttttattctccagtagattatggagctatactatcacaagcatagctccttgtaaactactttttgaaaacttttttgatcaagtcaatcatttcttctgcattttctggggtaacgatcaagtccaagcgagtaggaccaggttggattgcactaccattttcatataccggttcgaagtatttgaattcataatcagagatttcaaagtatgcgtctccaaatccttcagcgtcagcagttgttccatctttaaattttacttctgtgatgaaactattatcttcgtcgagcattttagtaggaaagaacgaaccaccatgctcttcaatcatcaagcgcatccggcgatttccgctagatgaaaggtcccactcggcagcaagacttgggataatgcgatattctgtgttcagtttcataatttacccgctaaaagtcgttaatgtatcttcacggcattcatcatccatgccaggaaaatattcttgttcaagccataaccatagtgtaggagtatcaccttctaccgtgatttcgtttcctccccatggggcagatttgttactaacttcaatcaaaccgtatttttcaatggtttcaatgaagtgttcataatcatatatttctacagtaacctgtgccattatcatttcctcaaagtggggaccgaagtcccccaaaggtaattattcttgccagtcttccatcatccaatcgatatcgtcccattcgttggcttctaaccaagcacgaaccgcttctttagaaccacggaggtcaatatttggccaaccgccaccagggccttctttaataactaaatcaaaatcaataccatggtcagtgtcataaaaacgtgaaccatcttcaaaaatcaaatcagtacaaaatcctgatttattgatgtaaggttctgccacgatatcaatgtttaatttacccatgatgttttcctctactcgttttgtttcgatgtagatatagtatcactcatcaactggcttgtaaacaactttgtgaaaatatttttgtagggataaagaaaaagggacccgaaggtccctttatattagaggtcgttcaaaatatcattcagatcgtcatcgccaacactgtcaccagcatcgcccattatatcgtctgcggaacgagaagaggtcggtttggattcaaaatcagacaggtctttgtcaaaggaatccaggtcatcaccaattttatcggcttgagctgctgcttttgccgcggcaccaccaagagctgctgtacccataatctgtttaaatttggcttcgttaacttcaaacgatttaaactgagatggagcaacaatttcgctgaggtcagccatattttcggtcaggaatttctgagtttcttcatcattgatgtttgcaatctcggactgaccaaggaatttacattcatcatagttctggaaaccaccgactttcttaactttcatgacgaagtttgcaccttcatacacacaagttacatcaaccggagtttcacccatatcaacatcgacttcaaccatcgcgttgattttgtccataattttctgaccgaaacggaatttgaatactttaccttcgttttctgggttagccgggtctttaataaccaggatgttagaccagaaagaagttttacgtttcagaagcttatattcagctgggttgctgttataagaatcgtttttactcagatgagcacaaaccgggcaagaatcaaaatcgccgtgggtagaagtacaattttcaatgtaccatttaccgccgtgtttgaaaccgtgattgatcagttttacaaacggcagagagttttcatctttaccaggcaggaagcgaattactgcttgaccattaccagcattatcggtcttcagtttccattcgtttttatcttcattagagaaagaagaaccacctttcagaccggccagttgctgttgaagttgagcaggattttttcttttgaacatgatttattttaccttgattttatttagacagttatttgtgtgacgcgctattgcatttacagaaatacttttcccgcacactggacagttttttctgggcattgttttacctttcatgccgcaaggatgaggttgtgtttgatgtcgtttcttagcaccatcactccaagtttttagaacttgtttacctcttgtattatttattctatcaccattttcataatagcgatgcaatccatttgaaattaatttcttatgctcttctgtctttggaacatctgttaagagttctgatattcttttacaatgatgttcagaatttttctttccaaatctaggagcattttcaccagaaccaccaaatttaccggaagcagtagataaattataaaatagttctgatttagcaacatcataatgtttatgataaaattcttcttcgtcaagagcgttatcacatacatgtagtattttaacatcgggtttttgaagcgaaattgcgttcaaaaatctttcttgttcacatgacgaccaatactcaatatttctgttgtcaaaaataacaccattgacaaaggtgcaatcatgttttgacccaatataatagtaaggtggagttttattctttaccctatcagtaaaggtaaaccaatatacgatattcattggataattatatactaatttctttacaagatttgattatgctaataaagagtttcttagcttcagcaccgtcaacgtttaaaagttttttataagcttttaatttagtagagtaattactccaaactaagttatccgttgcagtatcatgtgtatttattatatctaaaaacgagtcaagcatgatgaatgtctcgaaagatataacgtttgactgcagaagtttgaacacataagatgttccgactttctcattatattcaaaaatatcatgaagcttatctacattaactttcttggcaaaatagtaaatgttctttacatcttccgagaacgttgttttaatctgcttcaacttacctatatattcacgataaaacacaagggcatcagcatcactgatatcgccaatccaagcatcttggttagctacgaggttactcatgaatatcagtgttaactcttttaatgtatatttctcagcgagtttctcaaagaaatatttgtctctacgcttttgataagctttatcagagacccgcataacccagttatacttaacaacgtcatatcgaccggcaaagtgttgtttgagcattaaatataaaagataaacgctcttaccgttaacgtatctgttattatttccaggcatgcggagacgaatcataataaaaagtccagactattcgttttgtgtgtttgactaaatgatggacgaagcatattttcttccaatgcttctgacataattttttctatgattgctggaggaatatatctattgaagtttccctcaggaatagaattttcttctaaccactgagttgttgcttcaagataccccattccaagttctgttaccatagactcaatagtaaatccgttagcttgcttatctaacagctgattaatggattcagagggggaggtatccccctcgtctttaagcgaaaatagagtcataagcttctaccacttcatctttttcagtttcaaaacgatcgcgtgtgcctttatggaacagagcaagcagttgattaaacagtttgccttctacgccaagttctttcttggcgcggtctttaatgtctttgttaagttcaagatagctttctgctttcaacttattacctgaggcttctttaatcatatctcgcagagcctgtccatgtaccgcttcatcaaatactacttgctctttttctttcttagccattatattcaccttaaaagttgttaatttctttcattaatttagacagaccggatttaacaaagtagctataaattttgccacgacccggtaattgatagttattataacaatctaaaatgttagcaacaatgtcttcgcggatgtaatcaaaatcgattaacacgcggttttccaagaaacgcttatactgttcttcagtaagcaaatctttaatgttttcgccagcatcaagacactcttcaacaaacgtcattttcgttgaaggagtacgctcaccatcaacatgagtgtaccaaaaatctgaacgaactttaatagaagcgacgttatctttcttgtcacctttaataattttaaccatacaatctaaagcaggagaaccggttttagattttaccagtttcttctgcattggtgaccattgcttaacattaggatacttatgcaattgagtaaagtcaccatccgaagaaacaatcatgactggatggccttcgagactgaactttttggttaataccgcaatgctgtcatcagcttcagctttatcaatatcaatgacataataaggcatatactgcttaaattcatcaattacagtacgaagaccttcaaagtatccatcccagtcccaattggattcttcacgggctttagcacggttctttttatagtaatatgctacgtcccgacgccaatacccattaactgcgttatcaacgcagatgacaattttagtgtatccatctttcttccacttaaaagcattaaattttaaagtagaaagaataagatgacgaaccataggagtggttagtttgtcaccttctttatacgtatgaagaattgtcgccattgcaatttgtgacaagtcaattaaaatgacgccctcttttacctggtcttcttcagcgaataagcaatttaaatcagacatttgaacctcgttcaattagttagtacagccattataaatacttctataatgaagcataaccccataggagactctatgagcgatttactgaaacaacatttccgtgcaacaaacggcttggacgcaggcggaaataaagttataaatgtggcactagctgaccgcaacgttaaaaccgacggcgtctccgtcgagtacgttattcaagaaaacactatccaaaaatatgacccgacacgtgggtatctcactgattttgctgtgacttatggacgtcgtatctggattgcaaataaagatattccaaagcctgctggagattttaaccaggcgaattggacttctttacgtgttgacccgaactggatttataccgtccgtaaaggagagtttgaaattcaatctggtcagttcatcaacgttgactctaacgctgcaggtaatgctacattactgcttccgttagcaccagatgaaggtgataccatcgtagttcgtgatattggcgggcgtcctggctataacggaatcttaattaaagcacaagatactggtgcgtctatcgtatttggtgaatcgcgtctgcgtgaggtaagacttacacgtccgtattcacaaattatgcttacgtttagtaatggtgcatggcgtgcaagtttaaccgattttggcgatactgccaagatggtagttccgaacgggattgttccgacgcaagttcaggcaggtgataacgtagttcgtcgttatacttccaactcagagattttcattactctgccgttgttcgctaattcaaacgatatcatcaattttactgaccttgacggtacatcgccaattaaccatatgactgtgcgtacgtttgacccaactatctcaattgggactcctggacaaacagaggttcaagtacgtacttcaggtaatgggtttttggtatatgactcgattgacaaaatctggcgtatttttgaaaatgatttacgcacccgagtaagaataattacttctgatgttactttaatgcctaatgagcatatttctgtatttggcgcagataacaatactgttaaaacaattaacgttactttgcctacagacgtagctgttggtgatactgtcacaatcgcaatgaattatatgcgtaaaggacagactgtagtaattaaagcttctgatggtgataccatcgctagtaatttgaatttactgcaatttccaaaacgctcagagtatccacctgatgcagcatgggtgcaatcaagctcaattacctttaacggaactacatcgtatgttcctgttcttgggcttgcatatattgaagataaagcatccggaaaaagctattggattgtaactgaatctgaccctaccgtagaacgagttgatgctaaagacaatacaactagagctcgattaggtgttattgctcttgctacgcaggctcaagctaatgcggagtcaaacccagaaaaagaattagcaattactccagaaaccttaaatggacgtcgttctactgaaacccaaactggtatagcaagaattgcaacttccagcgaagttaatcagtcaacaactgcttcttacttggataatgtaatcgttactcctaaaaagcttaacgaaaggtctgctactgaaacccgtagaggtttagcagagattgcgactaatgctaaaatggatgcaggaacagacgattttacaattgttactcctaagaagttgctttatcgtactacatcagattcacggttaggtgttattcaattagtaaaaactggtggtgctcctaacacaactgctgatcgttcttctgctggcaccggtatattcgatcattctgattacaaaaatgcagttactccaaaaactcttcgtgagtataaagctactgtaaatcagtcaggaatagtttggttagcaactgatagcgaagttagaaacggaactccggcttcttcaaatattcctacagtcgttacaccagaagctttgcataaaaaagttgctactgacggagcaattggattaatccaaatagctacacaaactgaagttaatgctggcggcgtgactaataaagcagttacacctaaaacattaaatgaccgtacagcaactaacgatcgtactggtattgctcgcttcgcgacacctggtgcccagggtgaatttgaagctggtacttcaagtacagtaatggtaaaccctaaattactgttcgataaatttgctaatactgatcgtatccaagttaatactagttctggcttaactattactgggaacctctgggaccattataccatcaacatacaggaagcaagtacttctcaaagaggtacaaccactcttgctactgctgctgaggttagaaccggcaccgacgccaagaaaatagttactgctgccacgctacatgctaaaacagcaactgaaggagctatcggtcttgctcagtatgctacacaggcacaagttgatgcaggcacattaagtgatagaattgttcctcctgcttacttgaaacagactattcaggtaacagagtcatggcaagctacagacagcgttagagggaccgtgaggctatctacaggcgatggaacgtggaaaggtaatgataccaatggctcaactcttccggataacgggtatgcctctaagggcgtcgcagtgtctccgtatgaattgaaccttacactgaaacattacttgcctcgtctcggtaaagcctatgacacaggaatgttaggtggtcaaaccccagacaaatatgctcgtcgcgatatcgcgcagactatttctggagcttggtcatttagtcaggacacttcatttagcaataatatttctgttcagaatattatatatgctaatggtggtgaagtgaagatttctccaacagctgatactggaaatgtgcatgttcgttttcaaaatagagacggaactgaacgcggtataatttatgctgagccacagactgcttcagctggaactttaaaaattcgtgtcaaaaacggaactggaactactgctacaagtcaaacttatgtatttggcggtaacggtacgttagaagttcctaatgaagtatcaactaaaactctgaggtcttctggaaatgcaatagttggcggaactgttatggttaaggacgttcagatgcttgctgtcgagggattgaattcaatattcggtgcccaatcacagtccgcatttattcgttcccgtgacgctgatacacaaatttttgcacaggattcaactggatcgtatccaattttaactaccaaaaactatgcaagactagctgatggccgttatgtcaagaaagctggtgatacaatgaccggcaatcttaacataagcggttctgctatcgtcattacaggttctgaatcatggtatgtgccaacgaatgaaaccgtaataagacaaggttcttggactgctgaaattaaagacgctactaagttaaaaggccttcgtggttatatggttccaatcagaacaccgattgacccgggtaacccaagcactttggtagtgaccggatatgaagaaaagactgctgctggcggtgttttaactcaggttggtgtaactacaaacaatacttatcagctttggacaccttatcctccgacaaccgaaactgctgataagcgtttcgcgcatactgtgtggatgaggatttataatccaaaccttaataagtttgatgattggatgcgagtgttcacgtctgctactcctccgactgcagctgatattggtgctccgagctcagtatcaactcaggttaaaacccttgaagtcctggaatggattaagcttggcccagttaaaatctggccagaccgtccaaaccaaactctcaaatttgaatgggtaggtgattaatggctgaaccaattttaatggcagcctttggcgaggatttcgtggaaacacgaatcctctctgaggcaaactctgtgaagtattggctaaaagcttatgctacgcattctaatgctgttcctaataagccagaattgaatattaatggtgcctttgatatgacctcctccttacggagggggattaatgttgttcaagttaatggtgacagttttattaactttaaaacatttgacgttaccactgatgataataacgctaataacaaagcgtttgtagaatatgcaaatggattaacgtcaggattgtatattataatgacacatgaacgatttcaatccagtccgttaatagacagatggtttaaaaacaagtggtctgcttcttggccaggttctgatttttccaaatcatttccaaactctgcctatgttggagtgctcggagcagcaaaaggacgcatattaattgagtcattttacggaaatgatggtgtagttaaagaagattccagagctaaagtagatactgtatatgataacgttggcgatgtaggatatacaggttgcccttatcgttccattgaagacactaatgagtactcggattctactggatatgaatataaacgttatccagtacaaaatgaatctataagcaaaatagctgattatggattatctcctggagattctgtatttttagtatgtgatatgtatgcatctaaaagccttcttgatgcgggttctacaactagagctagcttgcggtggttcaagggtacatctttattatcttcaaacgtatcattagaagttccaaaaaatggagctgatagatggttaagatttgaaagatttactgctgttcctacggacgctgatggatttactattgtggtatcacgatatccaaaaacgtctgtagttggtgattctaaaatcaaaaaccttgtatttgttcaaacctctcacagcgaaaaacttaacagtgttgttcaagagtttggtgtgaatggtataagaatgaataaaggcgttgaaggagaaaccacagtgattatggaacttccaaattcaaaagtcgatccgagcggtgttattccagttcaatcgttcagagaaacatcagactaaggaagccttcgggcttccttttttcgtataaatagaaaatatataagaggataaactatggccgatttaaaagcaggttcaacagttggtggaaatcctatttggcacgcgggtacttttcctcttgtgccggcaggaaactccctaacttatagaggtaaaaaggtttatactgagatagataaacctcaagcaaatgataacgattttgtatctaaagctaatggtggcacaggttctcaagggttccaaaaagaagttgaatttaaagctggcgttaagatttccgcaacgttttctggtggttcaaacttaaatggattgtattctggtaacggagatggagataccagagaaaaatctaacatggatttgcgttcatggtacggtatcggtatttggaactcatgtacaagtgatggggtccaggggcgtacaatctggttcagtgctaggcgtggtactatcggaacagttggtgatattgtttcaggttcccaagttattgctaatgcttctactccaacagccgctcagcatttaactcgtaaagattatgtcgatgggcgaataaatactgttagcaacgtagctaacgcagcagtcaagaaagctggtgatactatgaccggtgtacttagggctaacgctggcgtagttatagtaaataaagcaacatccggtgaatatgctcctagattagatcaggttatttcacgcggggtaacaatagattttggcacatactaagaggtagccatggccgatcaaaacttaaaacaaatacaatttaaaagaactagcacagagaataaagcaccaggtgcagatatcgtagcccgtggcgaaatagtgttgaatacacatgggcgtactctcgctatctacaccaaagatgaagccgataacgttgttcagcttgcaggtaaaggtgttcctttcttagatactgcaggtaatcttaatgttgatggaactactacgttaaaagacaacgttactatttctccgaataaagcgatcaattttgaagcttctgatttaagcggagcattagtacgtcatatcaccggtaagtgtgctaataatgatggctggtacattggagctggcggtgcatctgaccagggatttcttgaaatcggtacgtatgataacggaaatgaacctatctattttgttcaaagaaccggtggaacgactcaagctgaagttcgtcgtttagcattattagatgggtttggcgatacctctatacctggggaccttcgtttaactggtaaaacagtaaaaatttcaaacggcagcactcttactttggaaatgggtgtaggttctaatgacgcttatattaaaaaccaaagaggtactggcgttcttcaattaactaatgacagcaatttaacgttcagaaattcccaggtttattacgccatgaacggaagaggtcctggtaaatccggtactcttctgacgaatgtagaaaacaatcgtcaagcctggcaatacacaatttcagctgcaactgccacaaccccgcgctgggttaaagtagctacattgaaacacccaggaatggcttcttcacaactggatttaatgattacaggtggcattgattctggacacggaagacattatgttgattttatcacgttatcaggacgcaatttaacatcctggagcactagcaatttagataactgggttgaatggcgcaggatgggttctcctaataaaggaaacgttccagaatattacgttgttaaaaacgatgctgctacagattcagaggcttcatttgatttttacgctaaagttcctcgatacggcaatgggctttatgtcacagtgctgaacactgctggatacaacggccaggatagtggtaaagtaattatctatgaaaccaatcaggacactggtgatactggaccgtccggaagtattcttgtttcaatgaaacagatttttgatagtttagcaaaaccagatttcggtgataccacaggtactcttccggttaaccgtggtggtacaggtgctactaacgtaggagacgctcgaaataacctgggtcttagaactgcggctgttcgtgatgtcggtgaatccagtggaaacgtgatggaagttggtgccttcggtattggtggtcacggaaaatcacttgtagatattacttctgacgttgatttaatgactcgccttaaggctcttggcggtacaacgtttagagccaacgtagcgagtggttataccggggctccttattattcacatggcgcaggtttcttttctagaactggcgatacaatgtctgcgcttaatatagattacgcaactggtaatgtcagagtatttgctataaacgatagcggtttagcaagtggaagagtgaatgctaatatgctttacggtacagcaaacaaaccaactaaggctgacgtcggacttggtaatctgacaaacgatacccaggttaagaaagctggcgacaccatgaccggtgatttaactgctcctaacttgcatgcttctggatcaggaaccgcatcgctttatattaatgcgggaagcggaaatgctcatatatggtttagaacaaacaccaatgaacgtggtgtaatttgggcaactccaaatactgctgatttaggacaaattaatattcgtgcaaaaactactggtggtacttctgctggtgattttagcttccgttctgatggcagatttgatgttcctgtagcagttaaagttggtggagcagcaatgctaaccaaagacggaaacatcacctctggttcaatgtttggcggtaatcttaataactatttgaataccattaaaaacgacattgttgccggcgataataagcaagtaagtaagactggcgatactatgaccggtaacttgactattaacgctaacctaaaagtcgaaaatcctaatggaacatttgttgatttgggttcagagaactcagacaaatacagcagattgacccttgcacgtaaagttggtgatggcgcttccgtagcaatgcttaaaattactcctgaaggatacgtgcaatttggttatcaagatgcagttgctactccatctcctagcaagtacatccgagttaaatctgatggtcttgatgtagaaggggacttggtttttaatcagacatatcgtggtgctgaaaatgcagttgatatttctgataagactaatgaccttaacaacatggttattaaaggcagtgatttaggtactcgtctattatacaagtgtacttctaccggtggcgcttctaatatattgaacagacctacatctgatggtaactttgttcttgaagttctgtctttgcgtaaaatttctgatactgactggtcatgtaagcagacctttactacaaagaatggtaatgttgaaggcacatatgttcgatactgccaaaacggcacatggtccgcatggaaagaggttgtcgctggtgttcaaccgattaatttaggtggtactggagcaacttctgtagctgccgctcgtaataacctcggtgttggtgaatggcaatctgtggcatttggtgtattgaatgtcaacggcgttagtaatgcagacccggccatcacatttaaaaatggggctatggttcgtgaagcccaaggtggtagtctcggcgcgttaatcctgtcggcttctactgcatctccagacggcgcgaaatatattgcttttcgacccttcggtgattcgtctggtactgagattagagtaaaagccaacgggtcaagtgagtcactacttgaatggtcttatggcccaggtattcgttcaaattcatctggcgcttttgttatctacgcaaaaacaggtcaggcactccatttaagaccaaacggtgataattctaaccaagccacagttattgaccaaaatggtaaaatgactgtcggtggtgaatttgaggcccagaactcaaaaatcactggtaatttgaatgtatctgaagataatagaatgattgttcttggcaaaaactctgatattggtttagtcaagaaaagtggtatgccaggaaaaatggctatcggtaaatctaactcgtttactattatggtatcaacaaataccaacaaccaaattaatcctgctgatacgtttaatgacatattcaaagtagatgctgatggaaaccagactgtttacggaaatgcccaagtcaacagacagttaactgtttctagttcagctactgttaatggtattattaatgccaacggaggtattattgttcctactaccaagtatgtacaaattgccgatgctcctacgcagaataaccaagcaacaaataaacagtatgttgatgataaggttgcttctgctattagtaatgctggcgacacgtatcttccattagcgggtggtactgtaactggtaacttgattgttactggaagccagttaaaaagtacatcactctgggttaccggtgatgctgccgttaatggtgttttaactgttgacggaaaggctagatttaatcaagagttcagtgtatctacttcagttaacgtccagaacgatggtaatagccatgtgttcttccgtaaagcaaatggtacagaaaaaggacttctttgggctgacgaccctggtaacgttagtataagagcaggcggcgccattgggccggtgtggaatttctggagcagcggttcctgccaattcccaggagctatttctaactataacggaattagtaccactactaattatcctgcaggaaaacctaatggtacatataacaataccgcaggactagtaactagatttagtaatggtgcttatgcttcaatatacttccaagagtatgtaggaaactatcaccaggctattcttaatgttaacggatttggtcgagacgacaacttctttttccgatccggtggcgacttcttctgtactcgtaatggctcttttgataacgttgagattcgttctgaccgtagagccaaatcggatatcaaagttattgaaaatgctttggaaaaagtagaaaaactaaccggtaatacttatgagcttcacaacacatccggtggtactactcgttctgcgggtttaatcgcacaggaagttcaagaagttcttccggaagcagttactcaggatattgaagcagacgggggtttattgcgtctgaattacaactcagtaattgcacttctcgttgaatctgttaaagagctttctgctgaggttaaagagcttaaatctcaactgaaataatgtaaggggcttcggccccttttaggagaaataattatggcagtaacaggaccatgggtaggaagttcggcaaaggccgttactggtgaaacctggatggcccaggctggagcaaaattgagattggggacacccttttggatgtccaacatgattggaagaaacgtctggaatgctagaataactatttctggtaacaacccagctacaggacctaaggttcgtggcgcttggaaagataagaacagtgcttcatggaacgtgttactcgacgctcgtggggctttatcaggaatttgggaaactgggtttaatttggttgcctttggattatcagagccaagcaaaacgtttggttataatgacgcaattgttctagaaggcagtggaaactttaacgttaactggcgagttgatactgaagacggtaatcaattccattttaatagctcccgagattaccgaggaagacgctgttatagctgtacagacaacaatgctttttggaactggctttatgctaatgatggacgaacattccagctgtcgtttactgcatattaagcataagttagagcaataaatagctctgtaaggagagcaatatgtcaagcaaacaatcaataccattttttgatatgtttcttgggttgctcgagctattattcaaagatggagccacgggaagagttctcttttcccgtgtttttgttgtcatacttttagcattgttggcgtttgctggttataagtcagatagtcttattactgcttacgtcgatagtacatatgacaagtatgataaactggttcaaaaggatagggatacccgatttgataatacagcactcgaacaactccagatagtacatatctcaagtggtgcagatttttctgcggtctttacgttcagacctaaaaacttgaactacttcgtagacttaattgcttatgaggggactttacctagcacggtagattctaaaaacctaggaggatatccaatcgacaaaacgtctgctgaatacagtacgcatttatcgggtagatatttttggacggataaggaattcgttttcttaccgacaaaaagaaaaccacctgaaatatcgtacatgtttagctgtccgtatttcaatttagacaatgtttatgctggaactgttgaaatgtactggtacaattccaaacctgcattatctaacgaaagactaacatcgatatgtggtcaggcggttagagctcttggaagagctaagtgattacttattactatgcatagccatcgttcgatagatagactcaaatccctcgttgtattcttcaacgagaattctcttctcttcgtcagttaactcagaaaccattttacgaaagttgctctgatttaactgacgcccctgctcgttcttgattccaatttcattcaagaacgcaataaattcatctcgcttctccatgatatgttcagcattgaacttagtcagaatagaagcaacagtaacgatttcttggacaatttcaaacttagtcattatttttcctacaacataatggattatgtgattatagtatcatcttgataccgcgttgtaaaccagtttatgccaattcccaacgagaattcaaatcttccttggtagtgatatactcagcaccagaggacatccagagcccgtagcgaccatcttttactttagccgttaaataccattcctttccaattggacgaaccctacgattcatccagtgacatacgtcaattgcctcctgaaaagacaagtcaatcagacttccaagcgcgattttattcattaacgcttcgagatatctttgtgattcaacgacagattctaagttatgactcatgctaaaactacctctccacgattgtctaaaacacgttcaatgtattcaactgcatttataatgtcacctctatcctttgccttaatagtaataattccatacgtataaaagtcggctgacaaactgaatggcttagaagtgtcctggttaaacgtagacattactgcttgctctaagtgttttacttctaagtcattagcccaagagctaagaactttaagcctaacttgtaaagtgtattctactttaattgctgaaagcaattcaacacgtttatgatacgccttggcttcatcttctctgcgtaaagtttcagtattcatagataatctccaatatcataagcatcaacacatttctgaaattgttcaagaacttcttcaggttcaacgttagctataatagctacagtaaaggtaccattattccaatcatgtaccatccaatctccatatccaacattctgaaggtcttccattagttcagaatggatatctgctactaatccagaatggtcccctaatttcttgtggagagcttctaggtcatcacaaataatagttaaagtagtacatttggaattattcagaatgcgcattgtctttacctttgtgtttttgcttacgttttgattctttggcagcgcgctttttatctttatgcgcgcctcctttgttaaagtcattcttcgctactgggttgtacatgtgcaattacctcatttaagcagttgcgtgtaatatcaaaacgcttagcaataccacattcttggatatgtgcttttaaatctccggcatgcacataccccaattccaagataaaccgtttaatttgagccttttctgaacgatttaagctattgaagtaatctgccttggcgcttattgctctcacgctctatcttccttacattcaagttccttgatataatagtcaatatctttaatcatttcttctgtcattattttgtacatttcagcaagaaatggtttagcaccgccattaaatggatggctaaacgggcagatgtattccttatccatgagagttttcatgaatttgctatctgccattttaaacccggcttcattggtatatgtaccccaattatcgtccatcatttctaatgagcgctgaagcgatttacgttgaatttttaaaagcgtaatgttattctttaatgtactaatcattagtataaatcctctgagaataattcattggcgggtcccgatttaggacgaactgtattaacttggcctgcatgtgtagcgatgattaatgcttcttcacgcgtgaagtactcaccccattggtcaacaaatccttgattgtctccatggacatgatcagaaaccaatttatcgcgaaacatatctaaaacgttcgccatatcagcagaataatggcgagtgcctggaactacaattgttccaccagatttcaattcaaaacgatttgctgcacaaacgatacggcgttgaagtaatcgtccatcccaccaatcagctactttaaagcaaatttcaggaatactaacttcttctggttcattaattagagaaccgtgacgagaagcatcaacaaatttattcatttgttcggaaaacttgctcatttaaagaatcctttaattttctgccacaaacttttcttttcacgaataccgatttgccgaataacaggttcaccctgcattttctctaaccattccattgagttaacagcttccgccattggaacaaatttagcaagggccttttggtaattatctacatccatgatatgtttaccatctgcattgtagatagcatagcattttgtgaatttcttatcaatgtatccgataaagtgcccacggaaccatacatcccaacaatcagttgggatattagcattcaagttaactttttctacacaacgctgaagttcattcaatactttaaacttgttcattacagttccttaatagagcggatgatggtttcaatgttttcagcagtacgagcgatatctaagtaagtattgcctgttgcagctacacggcaagacattccgaggtcagtgaagtgtttctgatgctcttcagaaatcttgtaaccgaagatacggaaagtacctttgttgttaacttcaagactacgaataccgaatgtacgtttttccagaactgcgatatagttactacggtaaacagtaagttctttcagaggtaagatatcttccatctcaccgagaagtttcatcatcaggtctttgtgctcattcatgtcttcagtaagaggacgagctttacgagtattgcgtttcttcagaagttcaggcttgttctcttctgcatagataactgctgctttagagatgatgtcctgcgcttcaccagtgatgattaaaccgtcaccagatttctcgatgagacctttcttaatcagaacaccgatgtttgagtttacagaacttgcgttcatggtttcttcaaggatttcacgcagttcagaagaagtgatgaaatcctttttagctacctgaaccaggatagcagcagttttctcgttcagagcatcttcggaagctttgatgatgtaagttactttagacattgtgattctccatgatgttttattcaatttgtttggtatgatactataataacatctgctaaccagcttgtaaaccattttattctgctctctgaaaaattttcttcaaagagcagtaaaaatgctatacgttaaagatcaagaacttatcgccattctcaagtttaagcacccagaaatcatcatatacacaaagaacgacttggtactcttcaccgtcttcatagttacttgcttgaattacctgacgcataggatactcgcgattaacttcgaactcatcgagcaccacaatgttacctttgacatagtggctcagtcgagtgccatcagcttgagtagaaatataaagaatgtttttgatatcagattttaatgatgtaatcattttgtttactccgtgttgttttgatatggctataatacaacaaccgtgtaagcatgtaaacaactttatgaaaataatttagggcattctaaggagggattttggatggatatagatttatatggaaggacctggagatgacctccaggttccctagattaattgaggagcaataaaactagacctaatacggcaattacagaacctataactaaataaaattctatcatagttcttccaggtctttcagatactcagcttcaggagttgtcttttcccagtacttaacctcttgtgctaggcgttttgcttcctgagcaagtttcttggcttcatcatcagtgatgtgatagatgttcattgaaacgagtttttcagaatggtctttgaatagttcattctgttcaatttctttagtcaactgcttacgagttttaccttggataacgatgttacctgcaataacctctttaataaattgagcttttgcctgagcaagattaaacgcctgtttagtttcagctattttatgctcgattcgtttagcggtgaatgtcttacggacttctacaaaatgacgaatcagctcaccggaagttttgaacttgtcgttcagcttaccattctcatcgatgaccacaatgtattgactcattttctcaatgagtttaaaatccttcatgattttagcatgacgctgctcagggtcatcgctcaaagcatagtctttacggaatttcaccttaaagccaaacccggtcttagaacagtcatcatcatatgtgatgtatcctgcatcttccaacgggtcaagtactttttcaacgtaagaagctcgttcaaacttgtatggaatttcactgatatagattgagttccgtgaagtttctttatacacgccgtgcagctcaacagaaccgtcttcagtttgaacgatttttccgttaaatttagggaactgaacttcaggttccatcatttcgccacgaagtgctgctttagtgcattctaaaacagattcaaaactatgcggaagaatagaagttgaataacctgttgcaataccgcgaacaccattcagaagaacagttggaattaccggaagataataagcaggtggaacatgctctttatctttatgcaccggagcgatttctgtgtctttgtagattttacggaagttgtcagaaatccggcagaaaatataacgacttgccgcagcagattgaaccaaacgagaaccgaagttaccttgtccatctaatagaggatagttgttattccatgtgtttgccatcagtgcaccagcatcttgggcagacgtttcaccatgatgatatcctaaatcagctacaccaccggcgacagacgcaagtttgtggaatttttctttattaccacgagccaaatcaagggcacgagcaataacaaaacgctgtacaggtttaaacccatcaatcaagttcggaatagcgcggttttctacagtgtaaatcgcatactcttttgcttcattatcaatgatagatttcaaatcgcgatgacgaagatttgacgccttagccaaatcatcaatagaacctgcttgttttaatagagtgtcaaaaatatccattgtacctaccaaattagtgagccgatttgtactataacatcggaaatgaaaagcacaatataaatcattccgtaaatcattccatagtacaaaaccaaaagaatgatggaaataactgcggcagaaactaggagtttcttaatcatttgtaaactcctacaattttacaaatgcgctcaaacataataaatgctgcagtgaacgcaatgcttccaattactttagtggtaggcacaaggccataccacatgaatgttcctgagcaaatcattaaggccatcagaaacacatagcccatcacgaagaaggttctcattagtatttctgcaaagtaaagatgaagttatcattcagaatacgattcagctcagagtaggtctgcgcatcacttgaatgctgacgagtaaacgccaatgcaagctgacctttgccataaccagtggtgagtggtttcattttattagcaggaatccagaacacaccgtaagtcatgcaattcgagcgcagagtacgacccaactgagaacgtccagaacggatatgagaaagaacactttcaaatcctgcctttgaacgctgtttagctacaaagaaacgagcagatgcaccaatataccctgctttgccatcattgaacatcaaaaaataaaatccttcacgctcagtaatttcacgagatggagcacctgttgcccaatcaccgttacgaatagaaccgatcagttctgcgccagcgttatcgagatcagcaaaagtcataatattacgcatgttaatttcctcagttgattaaagtttattctccgataaggggccgaagccccttctactaccaaaaatatactactgccgttacaccaccaacccaaaacacaagaagacctaaagcaagcagacgatacacgatgtgtcgtttcatttttgaccttcccatacggtttctactaaggatttaaggccatcagtttgaataatatcaatcgcattaatggcaaaataaattccgaatccgaacacggtgacaatccccagtgctaccgcaacaataacagacagaacagctgttctcattaagttaaagcgacgatcaaaactattacgaaccattatattttcctcagataaatgcattaatccaaacgttaaccaaatcccatgcgaaaacaccaatgaaagtaacgataaggcagaatactacaaagatgttcttcagaatcgtaagtaactttttcattttgttctccagtttagctaacaagactatagtatcactggagaacaagaaagtaaactattaaatgcacaaattacgaattttttcttccagagctttgactttctctatgtgctcatcacgagcagcggcagctccattaggatacaacccgccatacgttgaatcaccgttatcacaagcaatgatagtataatgccaattcatagattcaagaatcttatactctttcaaaagctcagctttaatagaagcatttccgcgtttggctcgaagtgattttagctctaagtaactcatgttttactcccgttcagtttgtaaggccatagtatcatggccaatcccggaagtaaacaactttttaaaatttatgcatgatgtacccgccagcaccaactcgcgaaggttttacgacttccatgagctgttcgataccgccactgaacatcggtgtgtaccgtatgacattctgggacacttcttctgcaacgaatataattatacagtctgcgactttatgtttaaacatgggccctagatttattccacttccatctgggaatggaccgtctttaccagttgtaacattaatccatggcttatgatttgctcggtcatgaacaaagtgtgttttaacttcaactctaacaccttggtagtagggatgagctagtacgtcccaggcccattcatacggatcgttgttattatggtcaacaacttgatcgtttacgtatccatcaagaaaatccgctaccacatactctgccggtatagcaattctacatcttttaagaacatcaattctgtcttgagatggatcgatatctaaactatatcttgcagtatcaatgatttttacttttgcttcaccccttagcttattcaaatctagggtaaatgtccggagttggttcaatctctgcagggctttgttcatcaatgccataaattcctctgatatgtaattcaccaaaataaacacgatcgtcgtggttacaagtgtctggttccacaacaaaatcatcaccaagttctacaagttcatcacagtgcaaccaagcatagtgaacatcaccttcatgtttaactacatgatgacaaaacaccgtagcagcatgatgagtaccacgaagattaacaactttagaatgagatacgttaaatggattaatcatgtttcacccataataaaagaggagcccgaaggctccttataattagcgaagttctgaaccccaacgatcagttacatcttctaatactacataaccacatgtacgcattttagcgtcgttgtaatcaaccgggatagatactacatcacgcggatgaactttaactgaaacaatacggtcagaaccactaccgaagtgaccgatgtaagatttagagcagacatgcagacctgctgaacaagtacgctgatcgtcttcatctacctggttacgcggcattgtaacagttttaccgggagagttatcaaacgtgtttgaagcacagtccatataagtggaacgaactactttccaaccaatgaagtgaccatcatcagtgatgtcgatatcgtttgcattcaggaaatcaaacagacgataaactgcacgacgagatgggttcagcatcaggttttccaggaaaggcagataacgtttaaagtcttcgccatcttccatggctcgaacgatacgctcagtcagaccagatttcagctcgatatctttatagaataaagtaccatcttcaattcggacgttaccctgaacgaatttcttgatgccttgttccaggttaatgtggtcaatagcaccagcgatatcaccatctacaagtttctgcagtgcagatttaaacccaggatgttggctatcagcgttataagtagtacggccttcagtaattgaaatgaatttggaacttgctgcccatttaaattcacgctcaactggagcttctactttagcaggaacagctgccgcggcagctcgagcttcgcgttctttaaacacacgccgaatggtgtcacgggaaacaccataattctcggcgagctctttcttagtgtacagaccgtttttgaagtttttaacgattgcatctttttggatttcagacagacaggtaacagccatttattcacctttattttcagaattttgagtagaagctccatcaaggagctccatgatttttacgatatcatcgacgagtttgctgtcagtccgccaagtatccaagacacttgcgatgacaggataatcatctttaaactgttcaatctttttatagaagattgtctcagcatcaccagacagtttattataaattttattacataaagctaaatcatcgttttcatctttgattttactggtacggcaaaccttagcgattttgtttagttttgtcaggaacggatttttcattccagacgcagtaaacttactcgacaagaaattcaatttatcgtaatgcgcaatatttccacagatacggtttccagtagcatttgatggcatgtactggtcataatctaccttatcaatacacttgatgtattggtcgataataaatcggtcaaatgaaagcaatccatcagcttttgccgcggctttcatagcacccggacgaattgcatagaatttcttaattccacacgcttctgccagagaccgcatatctgtgatgctcatattccaccaccaaacattatctgggaaagtgtggatttcatcacgattgcgaccgattgcataaccttcaagctcagcaatttcagatgatactaaagtctgacggtcttcttcccagtacccgtctttatcaatccaatgcagagaaacattaggagattttggacgtttctcttttggaccagtatcataatcaggaagagcttttctctgggcttcaagttcagacacacggaatactacaacttcatcagtatccatgattttcttcagctcatcaatgacatgtaattcatcttcattgtctttgattacagtaatgtgtgcccagattggaactaacccagatttacacagagctcgaaccgtagcaatacgcttacccgctttatcgtcaataagaacgaacgctttagttctatcaaccccgcaaatatcagaaatgtttacttggttatgacgatgccaagaactgcttgacactttacgacgagcaggttcatcgcatgaaacataaactgatacttcgttgtctacataatatgaacgaattttatcgagattatacttcgcaactacttgtttaatatcgcggttcccaatggtaataccacggctctgaagaatagaacgttccttagaactcagcttattgaactcacgcaagaattcacggtcagattcatacgcttcaaacgctttaatatctgcggtaattacctcttcttcaagagcattcacacgcttctggatattagcaattgtttcttcgtcaagagaaagctcttcacgagatggagtaatgtctaattcgccaagagggaaatgaacataaaccttgccataacgattaagcagccaatctgccttaacatctacaccgctgatcggatatacgatttttccataaactgcatacagaccataactttcgtaagagctattaacgctgaaccagtcggtcttatctaccgggaaatattcaatttcacggcgaagagaatctacctttggaggtacagcaccaaaggtacgcaaaatatatgcgatttcataatgccaagtatcaatatcttctactttaaccggaacagtgatttcaagaccagtttcttcgtcttctttcatgtcatcaacgaacattggacgaatagtaggttcgccgcggtttttcatgacagtataacctgtagctttaccatcatgataagacactacgttaaatgtactcgtatagcttaatggtgatttagaaccaagaccaagagcaccgatgaaatcattactattattctttgtggattcaaagaacgttttgtacatcgtcatcatgtcattatgattaagacctggaccataatcacgaattacaaatcgtgggtcaagacgagtaggagccttgatataaaatggacgattttcattaccgttcagtttatgagcatcatcacagttagtagaaagttcacgaacaacagcacgaactttatacttatagagtttgtttgacaagatgtcaaaagctttacccgaggccttaatagtaaacgttgaatcatcagcgtcagaagaaccaatgattacttcatcatcacatttaattttcattttattcctatcaattatgtcgtttaatgatttctgctacttcaagtaactcttctgcagtagcggtattagttgtaaaaattttattatggatttctttgaagcgttctttgaattcctcagctgcttggatgtcaaagaaccgctggatgatacgatattcacgatatatagcatcgttgaataattcttctgatgggatgtaactacgtttcataatattttcctcagtgatttagggaaattatatcactataactttaagcaagaatcctagaatcatctccaagcacttcttgattaaagccatataaatccattcttataaagaaaaagggacccggaggtcccttagattaccacaccctactaactcgaccataaacctcatgtttagaaccatcaatgttttccacccagatagtaacccaggttccgggcagaggtttcttttcagcgaacagatatccatagtcgcctgagatcaaagtaatccaataacgttgcatgttaattccttctaagtaagggcaatagtacccttactatttattctttattcactcatccatgtcttacgtggtgcagcatcattacccataattaattcaaacagttctttccagttttcaggaagagtgactacatcataaaccgggtcttgaataacacgttcgtattcatcttcttcaagagagccaagacctttaatataacgaagtttccaacctttgaaatcatctttatggtcttcatattcaccaagagaatagaaccaacgttgttctttacctttggtgagaataataaccggagttttcacaaagcggattcgaccttgttcaaataattctggccaattactaaagaacgccaaaagacttgggaaaattgaaccaacaccatcaacgtctgcatcagtcatgatggcaatatttcgatagttagtattttcagcgggttcaccgatagtcaaaccagtgattgcacaaatgtcaaatacttccttgttcttcatagcatctgcagcagacattccccatgtattcatgaacttaccacgcaaaggatatccgccatgaagttcacggtcacgagttgtaagtagataaccgatcgcagaatcaccttcggttaagaataaagttgtgtcagcatctttaccatatttgttggctttgatgtgcttagctactttagctttctgcgctttcttggcagctttagtttctgcggctttctctgcagcaagtttacgagctaacatcgcctcaataatcggcatatgaatatcttcggatttcataatagcgttagcaagtttcttataatcaatatcaatatggctacgaatttctccccaaggagaagtcagacgctctttagtctgagaatcaaatcgcatgttagacatatcacgaataaacatgatgacagtcagacattctttaattcgcgctttattaacttctagtttgtacttacgctttaatgctggaataagttcattgctcagttcatcaagaactaggtcaacgtgagtaccaccgtttttggtgtgaatgttattaacatatgaaagttgacggaacccgtcatccgaacgaccgatggcaatagcacaagtatcagaatcctgcactacagcattttcgtcatacatgtgggcgtaagctttaaacttgccttgaacccgtttacccatgaatttaaattcaatatcaggataaactactgctaacgtcatcagacgatcgtgaatgattgattggtcaacatcagtcaatcctgtgctttcaaagtgactgaaatctggaatgaatgatactgcagtaccagtcttatctttgatgaattctttatcttttgctgggtgttcttcccaggagatattttctgagccgttagaacaacgaacgatgatttcatttttaccatcgcatgttgcaccagtaaaagatactgaaaagatgttggttaacgcagaaccgacaccgttcataccaccagttttacgctcagaatcatcaccaaagttaccacccgcacgaggacgagtccatgcggctactggtcctggaatagtttctccttcaggtgttactacaggagcctgcggaagaccacgaccgttatctgttacaataattttgttgcctttaatgtcaactgaaatcttattcgcgtgtttgaaattagtacgaatagcttcatcaacagagttatcaatgatttcatcaataagtttgataataccaggaacatactttactgattggaatttaccaaaaagaaaacggtcatgcgcttcaaacgcagaactaccaatgtacattccgctacgcttaatgatatgttctcggtcactcagaattttaatttcgttcttaatcattacatttcctcggttagtgaaggaattatatcaactattaattatagcaagtaattcttctttgatatacatcaatttaccaagaacctcatggcctcctttaaccgctttatactcgggatatcggggccgctgtcgttcaaacatagtccattgagcatcactaacgttagcgtatgcatatcgagttccgtagtactgttcaatccggtactcgttgttttcattaagtgaaatccactcttcacagacttcataatatttctgcatccaaatagtacgaccattcacgtcattaattggccaccaagcaaacctgtattttccaatagcccgctctactatttttaaatgtcgtttagcacgtctttgcgcagttgtcattccaataatcataatattctcctctggccaacaagactataataccaaaacatggtgtccatgtaaacaactaaatgacccgaaggtcatttattcataacgaattgtgctatttttgagaaaaagccctgagcacactgttccgttaacaggttttcctgttggcccaatagccgtaaagcctgtgtgctgaaaatcatcctctgagcaagaaaagaacttatatccggtgattttgatatcagtaaatcccgcgttatctaacacgcgagttgcgttatcagcgtcagtgcatccaatcatcatgaaggcaagcgctgtaattaaaatctttttcattttaatttaaccctataagttatattacctactttaataacccggatttctccgggtttcatggtaatgcgtgctttagttcccatcaataatcaccactctttaatccatcgtagtgaactgccggagcagaaaccacccgcttcatttgaccttcacacttagggttaaagcagttaacagtatagtcacgatgggaaattttacgcataatttctatcttttttccacagacttcacacttgtaatcatacgttggcattaacagcatccttccatttttgtgttttgactatgatttgctcattcagcgcacgagtaaccatcatggagatttcatcatctgatacatgagtatcatttttatgacgatttctgaaatgcagccaaagtgcatccactacacagttaataacatctgcgcactcgccttcaaattcttctttctgccgccatggacgattaatccaatcacacatttctccagtttctgaagaaagttgcagcatgacattcccaatgctacgattaggaataggataagacatttttgatgcttcaaaaataggagctaaatttaacattgatatgcactctgcagtgctgcaatagcagcgattgcttgaccacgattatgaatagaaagattcataaccaaatcggttggaattacattcgtggaagttccaacttcagtaaagtatttgaattcgctatcaaaaattacaaggtcttcaccgccgacttcatcgcattctgtgccattagcccacgtaattcctgatactctattattttggcggtcaactttagtaacagtaaaactcccgccattttcatagagttcatacacaaagtcttcattaacctcatagcgtgaagaaaattcttcttcagcttcatcattgacgaatttgtactgtacgccttctttaaaattcattacacaatctccatgtattctgggccatcaactgtgattacacgagcaaaggtacgaactgggacgatatcaccatggttcgcgaatacatacaaccaagtccagtgctcttctttaccgaaggttttctctttctgaacaacgattaagtccgggttgaacagaacatcttcaaaagcttcagcagtaatttttacggtattttcagttttcatgttattctcctcagtagttgataagataatagtaccacatccttgtggcaaagtaaacaactttttatactaaaccttgacgttgcgattctgtcggctctacatcggctttaggcagaactgcatagttgccttgaaacactacgtttactagggttttaccgtcttcttcccactcatcagtgacaagaacatttttatgcagcgacagattagtggctgaattagtagaactcaccgattgggtaataacattgtccagtgaattcacgtgtacccacttgcgcagatagctttcgttaaacatagaatcaagcaaatcacgcgattcgagagcaactacgaatttttgcagcgaatacactgctttgtcttcattttccagttgaagcaaatatgaagacattttgttagaacggttaaagattccaacaattacgccttctttaccgatatgcttaccaccaatcactttaacgttttcgcctacaatcaaatttttcatcgtgtttctctcagtttgttaatgtagagccattatataacggctctttcataaagtaaatagctatcggtgagaaatttcacatccaacatcgacgccgaacagatacccagcttcccaccctttagccatcatagccttggccaccagaaccatcgttggagagatttccgggaggatttcccggttgaaccactcttcgaagttttcatcgaactcaaactcttccattagccacgccccttaggtaaactcagtggatcggtatcttctggacttggtgcttcgcttaggcctagagcatagcgttgagcatatttaagcattagaatatctttggcacagtcatggatactatcatgcgcgataaatccgtcgagcgtaccctttggaagaggagtagttgtcaatccgcgtgtcagaagcagtgattcaatcgcggtacgaatatcacgctgattccagaacttacacggctcttctttaaatgtatcaatttcttcttcagaaatcccttgagctctctgcacatcgcgaagacaatctacaaaaatcggaaagtcaaaactctgtccacgacaccaaccaaaggaatcccatggatgaattccattatcaatcagatactgctgggcttctttaattccagcaattactgataaatcatctggcgttgaggcaaggttagcacgggcttcagctgactgcttcttccaccattcaagagtagacttaccaaacaatcggtgacctttctgagatttcaagtcaaacttaatacgatgaccacgcttgaccaattcatcgaagctttccagaacttcagggtcagaatcaaaggtgattagagcaaggtcaatcacagaagagcttgacacatttccgaatgtttcaaaatcaataataaagtctttagccattttgagcctctagcataaatttaatttcgcgtaactggcaaccaatatattcgctcagatacacctttgggtcatatcctgtgaaccaagtaatagcattagcattatctgctatatcacgaagctcattcagaactgtatcaattttaatgttaatagcacgcttaacattatccggtgcttcaaacttagattcttgtaagccaacaatcattgtttgaaggtcttctaatttcaattcaaacatattacc

SEQ ID NO: 28 - DNA, 171803 bp, synthetic construct
  source 1..171803: mol_type = other DNA
tcacacataaaacacatcatatcgaccacgggtagtaccaacatataataactgctgtgcgagagaagcatctgccatgtgaatgcatggagtataaatgaagcttctgtcaattgagatgccctgggccttatggaaagtcgaagccggtaatgctttcactttatgaaacttacgcttagcgtcccagaactcagaccaaggagctttacctcctttattccaattcttatatgtatctgcagtttttgccaagaagaattgaaatttattcatttcttcttcggatgagatgacacagattttctctctagcgtactcttcatcgtcgccataggtttcaatatctaatacccaatgacgaaccagatattcacctggaacacctctggcacccaaaaatgtggtggtttcaactgcatccaatatgcgaacaaactgaccattattgaaaagaatttcgctgaatttcttcccttcaaatttaagttccttggtaagaggttcttgcataacaacaatctcgcctactacgaatggtcgttcagtttcgtatattcttcgtctgattatttcattcaatttgtctacagatttattcgtgaatgcaagcattcggttttcaaataaatcttctggtgttttaactaaattaaaataatttagcataaaatctttaagggcagttcctttcgtaaacccacggacaccatgaccatcaactacacagtcacgaatccatccaccatttctgatttcagtagcaacttcaatgattggagcattacttcgcatcacctcggtcaaatgaagctgtaagaaatctttatgagtgaagaatggactcagtgcaggttcattacttccaggttctaccggacgtatctgagccttatcaccaatggcaatgacaatacaccaggcaggaatagttgccatcaaaatcttaaacagcttacggtcatacattgaagcttcatcgcaaatgagaactcgaatagatgccatatccggaactttcttttgttcaaacagaacgttttcttcatatgtcgtcgggttaattttcagaagactatgaatagtactggcctgcattccgctgagcttagataaaacctttttggccccatgtgtaggtgctgccaacgcaatgccagagataccctgagaaatcaaagcatcaatgataaatttggttaaagttgttttacctgtaccggcaggtccattaatcgtaatatgttgacctttagctccttgtttgaccatttcaatgactttattaaaaatcgctttttgactttcttttaattggtcaaacgtaatcatgccacttttaccctcactacatgtagatttttaatttttgcttcgagtttttcacgctcaacatcgctaagtggttcatacactagctcagttgttttccaccaaagcattcctttggttttgctttttccagtaaaattcccttttgctaatttgtctgttaaaaccgacattgtacgaatccgtgctttattagccgattcttcattagtgaagaccacacatcgttctccatcgtacatatcagttgtgactggatggtcaaatccgtctttatccttatacgctactacatatccatagtgttgcattacattttacctctcaaaagttggaagaaggacgcagtcaatggaagaccttttttcaattttaacttatctagcattgagcatttttctaaccgacgaagtgagctaacaattagccgtattgattgtacacggatttcagcatctgatggacgattcggaactgatgctaaaatagcagataacttacgctcaactttagctaattcagacttaccaccgctgatacgagttctcaatgcattaataagttctaaatctgccgaggttgcagttccattcttttctttttgcacaaattgagaaagatgattttcgcgattacgtaagttagttttaattgatgttatagttttttcatactcacgaatcttttccaaacgagaagcttctttatcacttgttggcttaacagaatcagaagagcgaactatgcgtgccgcaatttcattcgcttttcgttcaaggccttcaatcgtattatttccacgcaaagtattatacttttgcttgacaggaataacattccctactacatatcccaagtcattattccaacgctcgagcgtcatgctatcaggatgatttcctttaacagttccaaacttttcgcctgagtatgcgcaatgtgtctgctgcatgatgttaaacagatattctggggtgagattgaactccttgtgccgacgttgagcagaacctaaagttgtaattaaacgagtataaactttagcggtttcagcagtaaatttcatcatgttttcctcaaaaatgctttcgtcttacggacggtataatgggtctaggtccctagttctagataatcactagttgactaagctatagtaacactaaagtagtccataagtaaaccagatttttcaactttgttatgaccaaccactttgaacttagttcccatcggtagcatcctttcttgttctttatcaatcatctcgatgtcagcgcttctgcgctgagcaatgttatcaatcacatcatttggtcgcatgaattcagaatctggtgcagtaattaaaagcgatttcatgttggtatgataatcaaatgattgctgacaattattgacttcaatgactacaaaggtcgagtaatgccatttgcctgcaaactctcgggcgatcgtttcatctgttgtgaatgatgctacctttccaaagtcaaatttctctcctttaataagagcgtcataaaaggctttagcctcacgacacgatagacctctatagagaatttctctgttatcgatttgatgacgtctaacgatagagtcaagtttcttatgaaattcttcgccaatcttattgttcatgcactgccacagaattgactgttctttgcagtcaaaacgattggctaatgcttcccatacgcttaaatcatataaaggtaatcctttgctttctcgcgcgaagttaagaacatcaatggagcgaatgggttcttcgataggaataacctttgataattttactgaaatagatgggtttaatgaaatagccatgatattctccattttggttacgagaggtatcttatcatggctttttggaagagtaaactactttgtgaaattattttgcccagggagaccagggcggcgggtcagaccagattgaagctagttcatctagaagagcttctggggctttaataccatacttctgtataattatacggtattcgtctttgatgtccttagaaatcactggatgaacttgaacctcttcctgaggctcttccatcatttcaaacaaatccatcacatgaaccactcagtattgcgatacagacaactactgctgttatatccatcagctgctttttgcaacagcgggcttggagcaagtttgataaaatctgcgcccatatataaccaaactaacttagtaaattctattagagaatctgtgctatcaatgataatctttttgcctcttgaaattatgtcattttcgtattcatataagctagtttcatgacatacattggtgtatcctttcaagtggagagcatgcagtatagaaacaggacttcctggaactgtatctacgtcaaagacatgagcagtcttaataatgccataatcttcagaaggacaccaaccaaatgcctcgaatttattaattaaatctttgaaatctttgtcgaacgtactgtatagagcaacagtaaaaattctatcttggtctagacgcaaagctccttttgcatcatttcttgattgaactgcgcgctgtaagcttactttatagatttttgcgtttgccacacatagctccttcagtcatgttgttgtcttcaaaccacttatcatttgctttaattaaagcaggcgcagcttttagtaataacgctgcagctcttacacctctgtaccaacaatcaaaatgagacttctttaatggcgattgataccagggcttagtataacatatcattttcttctcctcagttagtaggaataatatactattcccagtatagcataaaaggactcccgaaggagtccttaattttatacttcgccatcagccggaacagcttcaaacattttcgcgttggtggttgcccaagtagcagcatcatcaactactgttgaataagcagctttttcagatgggaaaatctgatactgcgcattagcaatacgatgcgaatcagaatacaccttaaaagctacagatacttctgtgcctttaacttcaccatcagcagttgcatggtcaaaagttttgatgtttacgtaagccattttaatctcctatttagtttacagaagtatttatacagctgctgtaaacatctttaatatttctttatcaatttctcgagtgatttcttctcgaagggccaatactaaggccctttctttttgttttctgataatttttaaacgacgcttagatattcttttagccatcaataaccactgtcttgacgagcaaagttctctgcgtttttcagataatacagcttaaagatttcttcagaatccagaccaagcgccataaacatattcagaacaaagtgcaggatatcaatcatttcaaatttgatttcaagctggtctttatcagacaggtctttgatataagtttcctgcatcttgacgtggtcagctttccatggtttccatacggcagatgctgccttttcaccgttactcataccgccaagagacgtcagcaattcgcggaattcgtcatcaatgtaatctttttggttacgcagccactgcacgatatcaccggcttgggccaattcatcaggatgcatgttagtaccaggcttatcgtttgctagacgaacctgaagagatttttgcatatcaagcattacttgcagagggtcaccaccaactttgcgtacgatacctgcgtatcgagcttcagctttatctgcaccagcgatcagttgactacattcgttgaaatgtggcatattatttttcctttcaattaaattagataaatattatatcacttaacataaatagcaggaggattcatgtctgaagtgaaacgagaatgtaaagacaaaggaggatttggaagatatctttacgtcggaatcgccactgctgctttagctgcatggaattatgtggtagttccattagctagcacacacgggctagttcttcctccaatgccgttagaaaaagttgtgtcgtttattatgactggaggattgctttaatttaaggggctttggcccctatatcttcgcatatttgtcaagacgtaatttagccattaaaccttgcgatatattttgattaatataatccgttatttcagaagcagttgccccctctttcataatcatatcatttatatctttgcttttccaaggcgacttatcccagaaaactaccttttcaccagcatctactaaacgtttcatacgcttaattgtatcaggatgacgaggttcatggtccataatccatgctcggttatcatgacatggaacttgagctaaatctaaagacccgccagtgattgcaatagcattatcaatgaacaacgaatctattggtccttccatgacgaatacgagttttgactcatcaatggtgtcgagaccataaattttggttgcatgttcatgggctttgattgtgatgtatttttgtggagcattctttcgtagtgctcgtccttgaaacgactcaatctctcctttcttgttgaagataggaataaccaaacgtggttcgttcgtctcattcttataggttcctggattaacagagttaacaagagaaggccattggttagtaaaccataaccttttccaagaagtgcttggaatacatctggcagtcacatatttaactatcggatgttccttcggaagtctatctaatcgctcgcagaaattaagtttttctattacggggagttttgcattaattttctcagacggttctacagcctttggcttatcaaagacttgttcctttcttttctcaagaagatactctcgatagaggtcaggctcattatctttaagatactgtgatagccacttgttatactcacagttgaagcaatggcagcgtaatccttgacctgcatcaaaaatccagaatcgggctttattgatatctttctgtgagtcaccacaaattgggcaacgacagtttaacttgaatgttgaagatgtagtaacgtgtctaaatttaggtaggtgagatattgcgcgaattgcatactcgttatcaacccaagacataatatttcctctggccttaaactaataaggccattttatcactttttcttggcagcgtctttatccgcttttcgtttctttggaagagtttcgggtcctttattgacgatgtccccggaagttgtacctgatgcaatattctgtggattgccgcccgcatcacctgcgaccatctcagtaacaaactctttgtatgttttcatagagcctcctactatttattcatgcgtaatacgtaagcatttatatgtaggatacagcgtcggagacattgattttggattgtctttgataagcataaactgcttgcctgtatcttcacacttttgcttaatcattgcttcatctttaccagtgaatgccatcttttcagtagacattccgcctgaacctgtagatagcgccattattaaaacgtatgtaatcatcctaaaatccacttaacaatgttgaagttatcaaactgggcatcacagtaaagaacataattcaacttaagtgctgcgccgtcgtctttaagttctgcttgcacttctgtttgtttgctcgggtctacgttttccacaatatgaccaacatctgcacgaatctgctgagctacttcagactcatcagcagtcattgaccactcgcataagtctttgtcatagttggccatggcaggaactgcagagcaacttgatactgcgaacactaaagcaagtacaatctttttcattttggtttcctcaagcagcttgtacgttaagagcagaaatcaggcgataatcaccgtttgcgtatactaacattgacacattgccatcagtgtttttgaatggctcaacaactactaaaactgtatcgccttcatctaatgcttttcgtactacgccatcacaacgcagattagcatgtggagatttaactactttgcttccaactaccataccacaatgcggtacggtttccgctgattcatctttactcttaaagactacgtctaatgctttttcaattgtccacatgatgttttcctctactcgttttgtttcagtaaggccatagtatcatggcctttggagaaagtaaactaccttttgaacaattttttcaacaaaatgtcagaggtcagattcttggtaggtaggtatgtagcagagttaacccagatgccatcgctgtcatacaccttgacctctccatagtcgcatacagataggtctgctttgttatatgcctcgatgcctcggtgaatggtatctgtggctgttacgacaaaagagtgacctgattggtcacggaccgcgctaaacacaaaaatcataaaatttacctagaattttaactcttctgccagagcatcaagcttagaacgtgatactcgttcttgacgattagattcggctacacggttctgtgcaccggcaccttctcggacggtattgcttggattaggcttagttgggtcgttttgctgctcaatttctacccagcgttgattagccttatgcacacccataaagaacttattgttgatgttcttatcgccataacgtgatttaatctgcttaattaactgttgcttcatctgagcaagttcaggagtttcaatcacagctaacataaagtctgccgtagcaggtagacccgcagattctgcaatatcactcatgtccatatcagaagcatcccaagctgaacgaccgacctgagccgcggtccaaagaacagtttcagattctacagccaatgcacgaagttcttctgcaatagctttaactaatgtgtaactgttttcagtatattgacgaatacggcaagaagcacaaataccaagatagtcaatgatgataacagtcggtttaaagttcttcttgagtttcaactcattcagaagagctcggaatgtattagcgttagcaccgccagtcggatactgtttaatgattaaacgaccaagagtactagaactacgccatttttccattttgcctttatattcggcgtatgatacacaaccatcatcaatatcgtcaagtgatacatcaagcaaattagcatcaatacgtttagcacaaacttcttctgccatttccatactgatgtaaagaacgttatgccccatctgaagatagtctgcagccaatgaacacaatcctaacgatttaccaacgttgacgcctgccatcaatacgttcagtgtaccagtctcggcaccacctttagtaattttgttcagaatgctaagtttaaacggaactttacgagctttattctggtatgataaccaacgagcttcataatcttccatccaatcatgaccaatatagctatcaaacgatactgataacgcttcacgcatgatatcaggaatagcccccatatcaggaagacgcttatctcgcttatttggctcaagctgggcattagcctgaatttcaataattcgagacgtagcgttatacatagccttttcttgaacgtacttttcagtttccttaactaaccaattcaaatcttcgggagcatcagataacttatcaataagtttctttgcgccttcatgttccgtttcagttatagacgaattatccagtgctacacacaacgcagtctttgaaggaattgctgtatattcattaacgtgtttcttaattatgttaaacaccgtctgagcaggtccttgctcgaagtactctttgtccatatatggccaaaccttcgtaaagaaagcctggttgtaaatcagattagctaagattgtttctaccactttaacctcttaaaagattttccataatgattttttcttggtctttaatgcactctggatttgttgtttaacacaagcttccacatgaggataaagttcatccttatgagcttcagatggagtactaaactcaatagttacttcccccgaaggagaaatatttaatttatgaacataaaccaagtgtgattgaccatttaattttatcacaatttcttggataacagtcttcatagcttcttggattatttcatggcttttcttgaacactcgttcttgacgctcgaagtctccctcttccgagggagattcttgttcaaatttctcgagttcagattctaaatcaaactcagtcttcattcatgaagttctctaattcatcttcaacttcagcagctgatactgaaccactctcagggagtttaacaccatcaaccttagttgaaacttttgagttaatcatttctgctaccgcttcatcaaccgcagcgtttgaatcaatagcacccaactgatagcgagctttgatagcgtcacggaatggctcatgcttaaacagaggaccccaaaattccgtactgctcgtatcttttgcccgccaggatttttcttcacgaatcatctcaccggtttcaacgtccaggaattctcgtgcgtaccatccatttttcggtttaacaacaaatccgatatccagagccatatcaagcagaccactgtacggatctataccaccatcgaatttaacatcgatgaagaacttacttttctctttgacagtacgtgatttctcggcgttcaggacaaactgatatccctcaagctcagtaccatctttaatttggcgtttaccgatgatgaacacagtatccgcagaatacataggacctgtaccaccggtcattaccgtcttactgaacatctcgatggtctcgattgtgtggttaaccgcgacacaaggaatgttcttaatagagaagtaaggagttacgatacggaagagagacttcagacttttcgcacgagtcatatctgcgacagatttctcgttcagtgcatcttcggtttcctttttagacgccatgttaccaatagagtcgataaacacgatgactttttcaccacgctcaatagcttcaagctggttaaccatatcgatttttaattgttcaaccgactgaaccggtgtatgaattacacggtcagggtcaacacccatagatttcagataagctggagtgataccaaattctgaatcatagaacaagcagactgcatcaggatacttattaagataagcactaaccattgtcagagacatgttagatttgaagtgtttagatggacctgcgaagatagtcaacccggactgcataccaccatccaacgctccgctgatcgcaatattgagcatcggaattttagttctaactacatctttctcgttaaagaattttgatttagtcagttctgctgtcattttagaagtggatgctttaatcaggcgagattttaagtcagacattcattatattccataagtctccattatatttttctcacaggttaaaggatagggtaattatattaccttgttcttgaagctattaacagaagttccatttcttcttggtgttataaaccactgtttccgtatctatttcataatgcattttacatccaacacacatgccatgccaccagcaatgcattccatctgagccagtagttccttcatgaacaaactcatcagatttacatacgaagcatctgaattcttcagccttgaatatgttaccagctacatcagatttattatagatgttcataagaggtcctttgagggctttcgccctcacagatatggttctaccttaccaaactcgtggaaggcctgagatttcactcgagtgttaatacacatacgaattgatttcagaggttcgttatcaccgaataacccacgtctttcgccgtctttagatttccaacgggcttgatttgggaaagcagcatgtagttgttcaagggctctattctgtcgagcagtatcacgctgtgtagaacaaccaccaggagactgcaccttaccagatttaacgaggtacttaaacagagccaggtgaggatgacccatgttaattaattttagaaaagcataagcatcttcgttaaggtcaataattccgtaaccaatatcttctgctgtaagtttagtcaaatcatagaaagtattggtgaacccaaaactattctcgcgataatgaccccagcttgatgtaattttgaaaatcggcaagcgagcatggccatgataataaccacaatccatagcagtctctacgtatttgaccatatcatcaaatacctcttgactcattgcctcgccgacaccaagtggaacacggcgatcgtcgcgttcacgaatttcagtcagatgaatggtagtatcatcatcaagcatccaaattcgctgccctgcatacatttcagtaatcagacggcgagtaccagcgattccatcaacatcatcggggacagtaacgattttagcagcatgaccgtgccaagtttcgtatgcttctttttctgattcacgcactacaagatgcggaacataaccttcaggaaacatagtcagggcagtaactgccccggcacgcttataacttggaattacaaactgaatcatttccactcacctttatagtctttctttgcaatatgagtttcaccagtataagcatagttatctacaagatagaaatgacgctcatacacgtgcaaagacccgacgttccaaataatgtcgccaactgaataatttttacctgatgcattcagaagtttggttaactgttccagaacatagagctgccatgcatagtcattacgatatccaaatactacatcatttgaacgcatgtttacaacagcatgaactttattatcacgaatcagatactgaacattgttagtacacatgaaatcactcatgccatcgcgctcaaaatcatactgcatttgaggccgtgtataaatcataattccgcggcgagaatcaggattactgataagttcttttgcacagttagcaaactgcgaatagttttgtgatgaccaaactgcccagccatagttagaattaatctcaccatgtttggatgcaattgctttccaaatagctggggtttcacctggaatatctttaacgaataaactttgagatttataccactcaagttcccgagcaatatatccatcattaactgcgccaaaaattaggttttcatctgcaataaatgatgcacctacgatttcaatagtcttcacacccgtcttatcaatcacaaattctttgttgagcaaagcatcagcgaattcttgacggatatcttgtactgtcattggagttacaatcatgagacctcttatttaacttgctggataataattgtattctgctgtgcgttagaagcagaccaaatcagcgcaattaaccaaccgataatggaccaaccgaatactagatttgtgataaagattccaccccgtgatttatgcttacgactgcaagctacaaaggtcggcaaaaaatagatgaagaaaagaatgattaaaccaaatactgcttccatgttaatctcctcagttagacatgcatttgttgtagatgtgattttggagagattttaactgctccatacgttgtttatgctcattataactcaatccgccgttagcaaaatcagttaaacgaatctggtcattcactgctgccgcttgagcagtacatgtacgttctttttgagttttacgcagacgcttaatttcttccagctcatgcttattctgctcaatcatgtctagttccatcgcagatagctgacgattaggattagctttttctttcgccaaccgacgctcaaccgcgagcgattcagcagagacctggttgctagcacgatagtatcctacagtaccgccaattgctcgcacctgtccaacagaagaagccgggacgatatcaccttgtggcatttgacaaccagtcagcgtgagagcaacgataacagcaagtaacgatttcattgtaatctcctcagtatgttatttcgaaaaccatggtaccacatccttgtggcaaagtaaacaacttttttaaaaatcgaacatgtcaagaagagacgatttctcttcatagtctaaccctgctgcttcagacatacccgtcagaggtttaacgaacgatttttggaacagaacactgtggtcaagccacactagaacttcctgtcggatttcttgtggcagctcagtgcccgatggccatgccatgcatttctcaccgtacgggttaccttcacgcagcgggatgaccatcaccttctcgccttccatgattggtgttataccttcaaagcccgcggtagctcggttatacgctaaagcacctttgacgtgatacggagtacctttatctggatatcccgcaccatcatcatacttaccgatgttgttggcggtcttaacttctgctattactttatagtcaagttcacgatactcagactcaaactgcttataatattgctgtaaagattcttcaccttcctgcagcatacgccgaatagattcttccaacgcattctgaacagcagttggtgtagaactttgctgagtttccatacccatgattttcaggtgcggttctgcataacgagtaccttccatatcatacacgttcagagcatatcgtttcttcgctttccaaaatccaccaatgccgtttgaacctaacggaggacaagaaatagcttcacggtccatgaacattaaatgttctttgttgttcatgtattcacacatctcacgatatgattggtcaatccaaggttccattttcttcttaccgaattggttcaggaattctaccaaatcgttagtttctttgaaacgctcaagacctactttctcaataaccttatcaacacaaacgtaaattgagtcagtatcaccggctactacaaacgaatgtccttcagtaccgcataccttgttgagatattcattaactttacgttcaatccattggattgccatttgaccaaacaaggtgattgctgatgcgttacgtaaatcataataacggaagtaaatgttacccaatgcaccataaagggagttgatcagaatcttacggtttaactggttagtgttacccaagatttcagcgtgtttacattcaaacatcagtttgtcaagacactcttcggtatatgtcagcagttctgctttcatgtcatcagagaaatcttcatagacattaacttctgcgaatttatcgatagttccaaacttcttatcattcagaacctttttaatcagttcttgatttcgtttggcacccatcattttatttttccactctttacgctgataaaataccttcgcgatttcaactggaatgacaccatctacatctttacgatacatccaaccattgggtgaacatgaatattcatcagacggacgaggagcagtcttgttaatgtactcacccagcggatgaagtttaaattgtccaacgatagtttctggtgaaatattaacttgtcggattattgacggatacagagatgtcaagtcaaacgacatgatataacgatatgcagcaggaactggttccttaacatacgcaccaggatatgactgtttaacgtgagaacgactttgcggaataactttgtcttgctctttcagactgttaaagatgattgcgtcccaggttttaatcgggctcattacaccttgatatggcatcttcgcataataagacattgagattgccaggtcaataaatccacgaacagcatcaattgcttgtaccgattcaacgtcgatgatgttatatgaaatatatcgttggtgattagtttcacgcaatttattgatcggaccatcatatgctaatttacctttcttggtttcataataagcaatgaaatccaacttatatgtcggttggttcgtgaaactaaatttcttatacaaatccatgtaatcaagaatagtcacacccatgatagaataaatttctttatcaccatacatgtttgtgataatcttagatgaaaccttgttcagaggagagaaccgtttcatcgtacgctcaccaagaatctgtttcacacgattcatgatgtacggaatatcaaatccttcaatgttccagccagtaaaaattgctgggcatttctgttcccaaagattgatgtactcaagcatcatttctttttctgaattgaacggcatatatactacgcggtcaagaatatgttgtggaacttcatcaccgccttcggaatctaaacgagcagcgagtttcttgtcccactcggaaacggagccataaagcgaatgcagtaaatcaaacacatagaacttatcatcaaccgaatcataatgagtgatagcatcaatttcatattctgctttcatcgggtctgggaattgagatgcagtaacctcaatgtcacagtttgcgattcggatgaattttttattatagacgatttctgaaccgtaagtatcactgatatacgcgagtttgaaatcatccatacccattgcttccattcccatatcttccatacgacgcatccaatcgcgtgcatctttcatggttgggaatgtattcttcttgcaatacttgccatagatgtctttgtactttgtttcttccatgcaatgactaaacataacaggagaatacggaacacgacgcatgcgttcctcaccagtagaatcgatataacgttctacaatgtcattgcctagagtttcaacgctgatataaaattctttcatgggtttcctttgtttatagaccgagttattagtctttagatgggacaattatactccaatttttataaagtaaaaggcccgaaggccttttcttatgcaccaatcgtatatttagattttaaggtccattcatgtttctgcttgaacgtaatgacccggaagttattctgcatctgagcaagagtttgaccacgattaatactcagtagaccccagtcagcaagtagttgtgcgattgagtctcgacgaatttcatcttccaaatcaatagtaacagggcgaccatcaagcttcagcatttctttaaaatgaacaatatagtaacgaccttgtttctgaagaatgtggcagctttgatatagtaccttatctttgttattagcaattcccatacgggttagagtttctttaactttcaggaagtcttcaggctgtttcagtgtaatttcaatcatctttaccattccaatgctgttttcttaagagttttctgttctttcacgtttttcgtgattgtcttgaccaattcatcagtcacaagacctttcattttcttgagagcaggtttaagcttgtttttagcttccagggtctctctatacatcctagcatcaatcgcattgaccttgtaatatgtcattataacttgaagaatcaatgcatcctggatgttttctgttaacttagcccatttaccataccgacgacctctaggaacagaggccatcatatagttatagtgtgcttggtcagataacccttgaccaacaaggttcataacataaaccgaaggcatacagtcagggtgttgagaaagagcgttttcaaccatgaattttgaataatccatcgtcgagatattcaaatgctcttgcttttcgttaatagacccgataattgtgaagaattgattttctgctttttctttatatgaatcagataattcctggactttcgtccagtctttacctaaccacgctatttgatgctcgttatactgatcatcatcttcaaataaactcatcatttccactgcatctctacaacaagttgaataagcatataaaccaagtgtaattcaatcgaagctgctatgccatgatactggttattttcaccgatgatttcatacattcggataatgcttgggccagtaaccattgtatacagctcagaagaaagtttatctacaaaccaagtatagtctgctgcatatttcggagcaagagcacggagttctttgatgttcttagttttaatagcttcaatgacatcttcaattgaaccacggtcattcagaacgatagacaagatacctgcatcaatcacacccttagaagaataatgatcaagcatgttaatggtcttacggaattctgggaaattctttttgaccaaagcagctacaactttcttatcttcaactaccacgccttcattttcacaaattgcgagacaacgcttgagcatctcgatttgcattggcttaacatcagatggagatggtttaccaaaattaattacacggcaacgagactgaagaggtttaatgatgccatcaaggttgtttgcagtaatgataatagtacagtttgtgctatacgcttccatgaatgaacgcagatgtcgttgagattctgcaagacctgcacgatcaaattcgtcaatcacgataattttctgcttgcctgcaatagaagcagaacttgcaaatgcagttaacggtccacgaacgaaatcaattttacagtcagaaccattcacgaacatcatttcagcattaatgtcattacacaatgctttagctactgtggtcttaccggtgccaggagaagtgctatggagaattaaatgaggaatttttcctttagctactaaagctgaaaaaatttctttatcttcagcaggcaatacacactcagaaatagtacctggacgatatttctgttcccacatgaagtctgcttcgtttactgtcaatttcatttatatttcctcattcagattaaagatggggccgaagccccgaaattattactcaaaatcaaaggtactgtctgcttccattgctactacataagaggctgatgcaccttcaaatttcgctgcagtctgtttcttggagccattcatttttgcccacagcatcagtttataatcgccgatagtcattttcatattgctcatgttgatgataaagttgaagttaccgtcaccttcataatcaccgagtgtcagggaatacttcggacgggtcagtgcagcgtcttctactttattataaccgcgcagaacaattttaccatcaacattggtgatagcaattgtgtcaatctgcatgccacgagatactcgcatcagctgttgcaggtcttcacctttaaaatcgataattacgtttgccaccgggaatgggattggtttagtcgggaacacgattgtgctcgggtcagctgctggccagaagatagttgagcgagcatctttaattgccagattaccatcttcctgcatgataatatctgcatcatcaccaaccagagacagaatgctcagaaaactgttcaggtcataaattgctacatcagtatcgatggtatcagaaattgttgcttcagcataagtcgtaccattaacagcacgagtcatgataaaattgccaggtttcagcatgataccggagttgatggtggagaagtttttcagaatgttcagagtttctttagagaatttcatttcaataccttttaattaagttcaggataattatatcaagctgcgaatgtagcagttaattcttctgcaacaatctgacctgccgcaacgagttgctcatcagcatctacgcagtaatcattttctagacgttcgccaccatgacggtcagtaacaattttagcaccagccttgattgattcgttgtaatgcttacgcatcagttcaatccatttttctgcgacttcatcatcgatagatttatagaaagcaaagcgagcttcggaatctttaatcttatctttgatagcctgtttagtttcttcggtcagagccagaacccaagacttacgaatacgattttggttattcgggttggaatctgcacgtacgtttttaacctggatatctttcacatcaacaaaattaatcattatatttaccttaatcgtaataatcttcaaccatccaaccgggattcctgctggacatgactctattatattcatttcctgtaaaagcgtttcgtaacatttcttcagttacgagatgttgctcattagaaaacaaattaattaacacatagcgctttaattcaggaaaggccaacagatgttggcccgtagtaaactcattcattccatcaccgtgaatcgtccgaccttcttcatttgaaggtgttggccatatgcctgcgggtcgtggtcacggtgagaaataataaacacattagcatctaccatcttattcagaatagcagttattgccttaacaccttctgcgtcggtagccgagtcatagacttcgtcaaggaacaaacagtttattttaacaccagaaaccttttcagcaatatcacgccacgtgaatagtaatgctatatcaattcgagctttttcaccttgactaaacgaggcataactaaattcttctcgtccacgtgatttaatcgtttcagagaactcttcgttcagtgtgaacgaataatcagcttccataatttttaggtagctgttaatttgcttattgaacatcgggatgtacttcttgatgatagctcctttaataccggagtctttcagcatttcagttaaaataccacgacgatatttttccataaccaaattagttttgacgaggataattttatctaattcttcttgtagcagtttaatcttgtctgagttatcaataaactcctgagatgctttatcaatagctgctttaatgcgacgtgccttttccacagcagtgatagtcatttgctttaaactagacatttgagttttgatatctctggcacgtgaccggacagtgttatactcgcgagctagttcatccagttcactctggcgcgtctttaactcaccaagaatggtattacattcttcaacatgatgattaatcttagtgattagagtgtcattagaatgcaaatcctgcaagcacgttgggcaatgaccacctttatcatacagtccaagaacctttgaatatgattcaattttagaccgaattttaaatgttttaccttgaacttcttggattgactctgctgggtcgtctccaattactaactcaagcagttctctctggagagtttctaattctgctttatatcctcgtgcctctttcacctgctcatcatacatcgcctgcaggcgagctacgttatcaccagaaagtttcttctgcttttctgcatactcatgatgagttttaatttcattagtcaatgcttcacgctgaacatcattaacctggatttgctgattgatttctcttatctgtgtcttgttcagtttgtccatatcagctaaaagagacacttcaagcaaatcttcaacgagctttcgtctattagcagttgataaccccatgaacggagtatatcctgccgttcctaatacgacaatctgcttaaacgatgtgtatgacatgccgatgagactttcaaagtaagattgaaaatcctttgaacttgcggcttcatcaagcttattgccatctcgtaaaatctcaaagacattcggtttttgtccacgtttaatgtagaaactatgaccgtcatactccatccacagttctactacagagtccttcttattgaaggagttaattaattgacctttcttaatatcacggaacggtttaccaaataaggcaaaagtaatagcttcgagcatagtacttttgccaccaccattcttacctgtgattaaggtcttttggcatttatcaagttgaatgtcaatggccgcttggccaactgacattatattcttatacttgacacgatttagtttaaaagtcttcactgattttgtgcctcaatgtataactgtttagacataacctttaaggctttgatatcatctgcggacaggtcttcaagtgcttggatatattcttccattaaatccaataagcttttaacttctacttcttcgccatcttcagactcaaccgagttgtcaactttagaaacagttcttaattcatgtactaccttttcaagttctgattcaaacttaggaaggtcttcatcgaccgcagtgataataatgcgtactgcgagattacgaaactcttcaaagtcaatttttccagtaacaggataaatcagttttctatgccaagtgatttcattagggacgaaatcaaaggttgataattcagtgtcttgaacccagaagccacgtgggtcgttctcgtcacccgctgtaagcgtccaaggcgttccgatgtacttaacgtttgctgcgcttgatatggtgtggaagtgcccagaccatacttgtttgtactttttgaggaaatctggttccagcccatgagacttcattcctttataaaaataaaagccattaagctcccagtgaccaatacagtattcagcagacgattctttgatatgcttcatgatttctgacgtgttctcttcacacatccatggacacaagtcaatcaaagtcccatcaaaatccatagtcacgggcttttcaataacagtaatatgcttatacttaccaagaacttctgttgatgcattaggcgtcaacgtattcttgtagtgcatatcatgatttccgacgatcgtaattaagttaattccttctttctcaagagactccgcaatttcacgagcgaattccattgtcttatgagtgatagctttacgaacgtcaaaaatatcaccgtattgaatgatagttttaattccatgctttttggcataatcaatatgctgcttaattccgtgtcgttgtacatcctgtacccacgggtcatctgcgcggacacctaaatgccaatcgcctgagtgaataattttcatataacctctctagtagagtttaattttatattattccatgaatagcaaaaagggcccgaaggcccattacttattttgtcattaactcaaattgttctttaaagcaatgctcagaatcttggtgttctaccaggaattcaaatgctttatttcgctctttatcatagagcttctggtcagatgacagatgtttcattcgttcaaagacttcatttttattttcatcattcaaccacagaatgccagaatcatgagaagtcaacggctttccatcaacccggaatttcaaagcatcaccagtagctttatggaacacaggaatagttccacaagcgcctagttctaaatgcgtgtattccagcgaacgctcaaggaatttatctggaagacgtgacagctgataaccaaatccagactgagacatacgctcaagcatttcagagttaacatatcggtcaagaacttgaggattcagacctggtccagttttaacctgatgataatgacggcaataatcaatttcatagcgttctttgatgttaataaatgcaggactgcgttctaacccttccaagatagtcgttttgcctgcggggcgcagatgactttcatgaaagtcaaacatcaagaaatagcctttccacgtagtagtacgaccaatccaacgatgaatatcaaaatcaatagcagagaagtctttccaatacttatcacgaattgctttgatgttcatagcaggttgaaagttataaaccggaggagctgagtcagaatcatcaaagaaactcaacccgccgcttggaaaatattcttccattagcacggtattaaaatcgccgtttgagctatgactaaacagtacatcagcacgcttaacggtttcttcaagaccagcatttctacgaagtgacaatgctctatggtcatgttgatatacgactaccctaacttcaggtttaatgttctctatgagcttcttatagttatcaatcgctgcttctggagcattgatagcaggtactgagttaatgataagaatgtcacatgcgttaagcagagataaagtcttatcatagtcatctgcaagagacacaggaatagttacatctttatagctatgtgctctattacgagtaaacgctttatctttagcgtaaatgatatttacttcatggccatgttttactaaccactcacggtgctcgagactgaacttggttacgccgcatccctcaagtccgcgagccattaaaatattaatcttcatatgttgacctttgttgttaattttgaatattttaccattcccgtaataaagcaaaagggccgaagccctttaaattttcttgtatacaacataacccgctgcttcacatatacgcttagcttcttcaaagcgtctaagcatatctaccttagcattatgaatcgcttcataatcgggagcaggtgcttctctccgagcagtatcacatttataacagaagtaactacgctttggtcctgtataacgttctgaacaattactgcaccggcatgtataatttccttccggccaatcatgtccaggattagaacccatcaaattcgtcatacatcccaattctcttcactagtaataaaatcagggtgttcatctaaatcaatgaatccccagttctcttcatttaccattcataccaccgtttaacttggaaggtgtcaacccagacaagagagttcttatctattagcttacatccttcggtagagcctaacacgcgatattgattatctgctacctttactgccatcgtaccagtcgcagtgtttaaagtaaatcctgcgtctttacgaacacgtttaaattttacttgtaccagcatttagaatgtcccaaacagatttacgagaggtattccaacaagtcagaataatctcatcattaaaaggttgttttaaaatagtacgcagtttttcaatagcatacttgtaagcagggaaattattgtctaataccgcgtctccagcatgagctcgtaatcgctcaagttcacgacggtttttacgaacaactttgttggctcgagcaatagcttgttcttctgccgcttccattagtttctgttgcagctcgtcgcgctcttcctgggtaatattgttcatgttattcctttggatggtaatttatttcaaatgtgaattcagtatcagtccaattataactgtgttcaattatagcagaatctgacctgaaatcagcgtcatgtggatttttcgggtcaatgtgaatatcaagatcaagcacctcccttaaatacatctttagcaaataagggatagcgtctaggtcttgcacatcttctaaaaacccgtcgaggttaatcttcagcctcatataaaaattccagattaggtccatcgcttgtaggttcgctctttttagcagaccctggcgccttataagcggtggattcatactgcgtcattttatcgtagatgtcctgaataaaggtttcatctgctaacgcaaccatatcatcgtcccgtgaatcatacacgttgtggacaaaatagctgtatttctttgccatttctttgcgttcttttttgatacgctgaacgaatgcattgaaacaagcttgggttatatacgcatgcgggttatcatacttagtttcatcgaagttgattaagcctttaattgcggcttcaatcccgtctgaaatcatttcttgcttccaggattgggtgtatcctgaaaagttgaaacgcttactcagaccttctgcgatcagcataatagcaaggccgatcgtatcgttctgttttactactcgaggaccgccagcagcttcagactcccgacacttctctttccatgcacagattgatttatacagttccttgttatttacataattactcatattgcctcttcgcttcaattaataatatctattataacaaatttgggaagcgagaggattaaagcattacttaatcaattcagcgcatgcaattaatttcatcatgatacgataaaaatcgttatacgtgaaatctaatggaacatcaatgacggcttcaaaatcttcaaatacacgctccattccataaccagcgatatcatctgattcagcataccagtacgttccatcttgtgcaaaagttatttggctattttcaagacagaacacacctttaatattttcatgtgtaagagtcaattgaattttcatagttcacccttcataatacgatagcattggaacagctgttccatgatacgtttgaactcaaccaaactaagttcaaaccaatcagattcatctacttcatgcatcatttccatgaatgaagagtataaactttcataatgggtttcatttaacatagaggcatgcgtttcccaatacatgccctcttcattgtcaaaccaaacacccatataagaatctatagtaaatccgccaatgccttctactacaatcataatttggtttactttagccatgctttcaccgagtcaatagcatcttcaaatttagagaaagcatccacggatgtgtattcattctcaccagagcgttcataaatccaaaacgcgtcaaaatcttcttcaatgatgaattctccgttaggagtttcaatcgtgtttctgccatcaggcgttttagatataaaccatccaagaaaaccaacttctacaatttgttcttcagtcatttagaatttccaccaattgattatagtttaatgcctttccagaagaaatcataacattacaaaatctgtataatgcttcttttgatactttatacacataatcagaagttgttataatgtatgaaatacgtacaaatgttggggatttttctgccaattcatacgccagttttctagctctgccaatatcatcggcaaacttggtatcagcaagcaaaatactatcaaatacccaacggttagtaaaaatttctgtgtatagaataaccttacgcatcaagatactctcgcagttcctgctcgtttaacccttcttgccacatctctgacggagatggaagttggctgtctagagtggatgaatcaattggaaatactctgataattacgctagtatcttcatcccattgatttgcgagtatccgtttagcttgactaatgtcaggctcagaatgagcccggatatacttaatccttctatgccatacaccggtaggaatagatgcgcacacgatatatgaaatcatttagccgccttaaccgctttaacatcgcggaagcctttcttacgttgattcttcatcttacgaatagtgctttcagaaatttcaccgatacccggagtgattggttctacaccgaaggctttgatgccaaattcagacagaagataagcaaccactaattcacggatgcgggctttaccaattttttggccttcttctttcatcgtaccgtgaagctcaacttcccactgatcaagcaaagacggagttacacaacgtccttcttccagcattgcagatactttatcataagcaaaagagttcagtacgtttttgattgcttgggacatattaatttcctcagtaacgattgttttgacagaggagattttaaatcaaatctcctgtagcaaatcaatctttgagagattttaactcttcgagcatatcgtagtattctttactagcaaccggagctacagtacagtggtagctattgaattcatggtatttcacgaagcgttcaagttgccactcaatcaggttgttaattcggtgaagcagaaccccctctgaaccgacgtagacaactacttcaaattgaagcccatcccaaattctggtacggacgatatcacctacattaaatgttttcatgcgatgtaccaatgttcgttttgccaagactcacccttgtaccagcgagtcatatcatatccattttcatcacagatgaccttgttcttcatcaagaagtattcgtcatcagtaaaatgcacatgctttactttacagcctttactcatagcttctagagcttcttgccaatttaaccagttcatattttcctctcgagttaaacggtatgctgttatccgttgatagagctatagtatcactcatcaactagcttgtaaacaactttgtgaaaggagtttaaaaataaaagagaggtcccataggaacctctaaatgaagggtatagaaatatacagaaggtggtcaagatgaccttagaaaggaactggttaatcttctatgatatctgggtcatgcccagcagcaataagattggttttgaatgttggaatgtcatactgcttaacgttatccataaaaatgacaggataccgaatagcaagcgatggatagcacccgatgcgtttagcaagtgactcaatcaacggacggtcataaaccggttgaccgtcaacctcgttgattacgttataaaactcatacggaagttgtagcttatcgagcaagtcacgaactgctttacatccagggcatctccaaacttcttccgggatgccatagatttctatcatagttcagccttaatctcagaaatcaatctttcaattaattcaagtttatccgctgtagtcataggataaattttgtcaacagtggcttcttcgagatagcaacggtcagcatcattgagtatacaccactgatcaaaatcatcagcatctatgctaacaccgttgaaggtcttaactcgttcaacagacccgtcctgtgtcagagctgttaccaaaaatggcttaaatttaagcatgttgtagaattcaacatcctttgacgatgcgttatttagccatttatcaacagagtcttctttaaacttgtaccacttatcgcaacaaaataattctatcatttcatgacctgttgaagtttagcagtcagagtattaacacgcttctgaaattcttcattagacagtttttcatctttcttagtaggattaatccagtcagaaataatgatgagaacaataaatggaatagctacgaaagcacctgcggttaatgcaaccagtgcaataacattagaaataaatttacgaatagcattaatgaatttcataattttccttaaatagttaagatgaatgctgtcatagccagaaattctggtccaaacagttcagtagccatgtggttcagagtaaacataattttgtaagtcagcatataaatttcctcaatcatgtgtccaggtagaaccgtttcttacccagagtctttggttgtcagaaccacgccagtttttagtagttggcagtgatttctcatatttcccatcaattataacatcgatgtgttgtagcaaatctaaatctttgatatcttcaaacttatatcctgtccacatccagatatctttctccggaaatcttgctttaacccaagaaactaaatttgaaatctcttctcggttctgtggataaagtgggtcaccgccagttaaggtaagaccttggatatacgatttgcttaagtgagatgcaatttctttaacggtattcatagtgaatagctgtccgttacgagcattccaagtagatttattataacacccttcacatttatgcaaacaccctgtgacaaaaagaacgaccctgcatccagggccgttcacaaagcaacatggatatattctatcatagttcatttatatatttccaattatagccttcaacacttttgcgttctccatttaaacattttaaaatatttcctttactagaaatgttaaaatatttcgcagcatccggtatatagttaaatgtttttaaaagaacaccgtttttatatgcaccaaatacattgagagtatatttttctcgaagacgctggtgctttcttttcataatttcaggattttcatacgccagctttaatgaatttttgtgccgctcttttacttcaggcttttgcattgctagcttagttaatctagaaattttgcttctaactttatcgtctttcattgtatttgataaatttaataaagttttatttctaacttcaggattttgcattgctagcttagttagttctgcatgtctttttctaaaatcatcattcttccacatggtcttagacaattttgacatagaatgatgaagcagttctctttcttttgaatataatttaagaatttcatccaattcgtcagtattaaatctattaacgtttgagtttatcattctatgaaaggcataacacattttaccgtttccagtttttgccaaataatagtgagctaacgcatggtcatagtatgataagttaacgatattccatttatctgatttatgctcaggaaatatagatttaggaagcacatggtgtgcttccgtctttccttttattttagaattattgtaatttctttgtattaaagctgtatacgatagtaaatcgttgtcatcttcgaatattgaagatagcttatcattcacaaaatcagaagggtagattctgtcgaaattcattgaaccttacctcattacgtgcttctacttctgcatcatatttccagggctcatcagtttgaatagccccagccgataatccactttcggggtcacgggttatagcaattccaagcgggtgcagaacctctttgttgattttccaaatcaatccccattcgctaagttggttccaatcaacttgcttcattggtttctctaacatgttttaccctatgcataatttctttgttcttaccaagattgaacccacgctcagaaggattaccaagatagccacaggttctgcggatggtattcattttctttggatcagtttcaccgcaaatcgagcaagtgaatccattttcagtaggtgtcatctcatgagtagaaccacaagaaagacatttatctactggcatattaacaccaaaataatccaacttctcgatagcatagtcccataccgcttcaagaccttcaaggttgcgcttcatgtcaggaagttcaacataagaaatatgaccacctttagcaatagaatgatatggtgcttcgcggtcaattttttcaaaaggcgacaggttttcttctactgacacatgaaaactattagtgtaccagcctttatcagttacgcccttaacatcaccaaacttggcttggtcaatcttacagaaacgatagcacagactttcagccggagttgagtacagactaaaggcatagccggtttcttccgtccacttgtttagcttagtgttgatgtacttcaggacgagtttaccgcttcctttaaaagtaagcatatcaaattcgtggatgccaatatatcctaatgaaattgaactacgtccatttttgaatagctcaagaatttcatcatcaggtttcatacgcacaccaaaagcaccttcctggtaaagaataggagcaactgacgcagtaacaccttcaagtgatttaattctagttaaaagagcttctttacaaatatcaaggcgttcatccagtagtttaaacagtttattactgtcatctgaacttttataatttgcatccagagctatcctagggaggttcagtgttactacccctaggttattacggccatcaagaacgggtttgccagaagagtctctccaagcaccaaggaaacttctacagcccattggagatacaggagtttctgaacctgtaattgctctattatttcgagcactgatgatatcaggatacatacgtttagctgcgcattctaatgcaagctgcttaatatcatagttcgggtcttctttacgtagattaatgccttcttctacaaacatcacaagctttggaaagattggagtaattccatcgcgacctaatccacgaatacgattatcaagaatagctcgttgaattaatttttcttcccatgacgttcccataccaaatgtgatagtcacaaacggagtttggccatttgagctgaacaaagtattcacttcatattcatatgcctggaaagcatcaaatacatctttctcggttttagaaatagcgtaatcttttactagagctacttgatatttgcgtgcatcacgtacatgtttagcgaatgtcttctccacataaggagccaatactaaatcgacgttagcaaacgtagttccaccatactggtgagatgctacttgtgcagtgatttgcgccatgatagcagtagctactccaatactcttaggagtttcaatttgagcgttaccaagtttaaagccattctgcaacatacctttcaaatctactaagcagcagttagtgaaaggcaaagctggactatagtccatatcatgaaaatggataacaccttctttgtgtgcttccattacagagaaaggaatgacctgattggcgatatgtttagatacgataccggccatcaggtcacgttgggtaggaaaaacacgagaatctttgttggcattctcgtttaaaaggtccttgttggttttattaataagtccctggatttctaattcgatattcattttaaactcttacgaagctgcttcttgtattttgaagcaagttgtgattttccatcactttcctcgtatgtaaacccatgcaattccatttcagcaatcatctcaggcttaccaagacgtgaaaagcgtttagccatatcggcaacatattgcgggtgaatattactgtctttacgattctggcggagatagaccagcaaattctctaaccattcgaggtagtcaatatcttgaccttttaaaccagagcggttgaacttatgcttcatttggccttctgccgcattacacaggttacagagcaagcctctgacctttcctgcattgtcaccttctaacgcatggtcatggtcgaggtgattcttttgaatatcctcatctaaaggacgtttgcagcaaggacataatccgttctgtgcctgatatagtttttctttttcttctttatataacttaccggttaataacatactcttacctcagcgattagataagagtatttatagttaaattaacgagtaactactatagatgttatgattagactcttttatgcagaaagaagtacagaaagcatagatgccttcataatcatccgcattgaactcaatatatgaattagtttcttcatgaagaagactcattttagtccaagccattccattgatgtcatcgtcgtaatagcctccactaaattctactacatcgccaacttcataccaatgactgcgtaaaatttctcttgtaacacgatgaatatcagcgaaatcgagaatttttactgtaatagttttagtaatgcacgatttagacatggcgaactccaagacgggtttccaatgcgacgatgtaatccgcggctttttgcattaaagcatactcttctgaatcacaattttcctgtccagcaaatgcgtaaagagctctggtaattggaacgattgcgccttggaaatggttaagtttaatttcagaaatcagaggaacatcttcaccttgaccgatttctttaatttggtgcatcgtatcttcactgtagaagcaccagaaccaagattctccgtgtggagttgggtcgttaatagtaatgattttgtttgtcagcaaatcaattacggcagtaattccacacatttcaaggtcatcttcattaactacagaaatgacttggaacttaaatcccggaataaacacaggaaattgctctgttaattcgtcatcattaataatgacttcaaactgcttaccaataagtcccattcactttgtcctcataatcaagtaattcatttatagtgggttcagaagtattataatcttcttcaggaatagcatcttcctctggctcgacagtttcccagcgagccgcataccagggttttagacctttgctactttgcatggtgttggttcagaatcattagcagaatcatgttcaatacgccattcaacttcagtgcgagtaaccactttttcatgacgtgtaacgatatctacttcaggaggactataataccaatcagtatgatatgagcctgaacgagattctgataccatgaaatgaacgccacgcgctggataataccaaatttgagtgcggtcttgatacttgtgctcttgcgtccaatctccatcttctactaaaacaaagatttcttctgcatcatcgtctggtgcattaggcggatattcgaaatcgtagttgtcgtcccaaccgccagtgacgccagcgatatgtttgatttcttttactaattcagcgttagtcattttaacctcgcagcttctgtaaatcttcatcatcaatccagctttctaaaccggatggaagcgcacattcaatttcccacagcaattcttcaattgcttgcaagcgttcaagctcttctgctgaaatagttaccatgcgtggagcttttaaatcgccaatatcataactcatagttcttcctcatgttaatcataatttcaccatacactcgccgtatttccatttagacataaccttaactccattagagtaagttacctctacctttgctcgatgatttttgatttgtttaatctcaccggtttctaatccgccatagccataataaagggctacaatatcaccctcccgaaggagggttccacgataatcatgcattgaacttgaatttacggagttcatcaaaaccgccgatatgtgtaccgtcaggagcaaaaatctgaggcatagttaatccaacctgtgattcacgacctaaacggcgaagcaaatcactgataaccacttcatcaaatacacctttttctggcattacattgatgaatgcatattcttgcttcttaacgtcgagcagacgttttgcgttatcgcaaaatacacacttatgaatgctgctgtcgtaaccaaaaaccgtgaacatcttcttctatttccttaaatacttgagcttgaactgttttccaatctgggtggcgtactgctttaacgtaatttgtcataccaagacgcttcattacttcgccatcaatagctgcttgagcaaaatttcttccgcgggtcatagctcctttgagtttagaactatcaactatttgaccagtctcattataataaaccgaatacatgagtagcattactcgttcggcttcttccatatatcgtttacgagccattttcagccttagtagttataactaatgttttaccatctaacgcatcgagaatatctttgatgcaattatctggcattggttgaacgctagctaattgcttggcaatatcatcaggaattcccatacgtggtatatttaatttgctaaaatcaattttatccattagcagttaccgggaagtgttctgccaatttagcagcaatggcagcgttaatttgatcagcgaaatttttattcattgcattaacaatgatttcttgaattcggagattagctctttcaatagacatcttaatacgaccttcagcttgcttaacagcgtcatcaatagtttgacgaaccatatcatcaatagcatttttagcgcatgattgggcagcgttacgcatcatctgcgacatttcttctgtagcagacatatcattccaaccgcgagtatggaacatctgctgaacttgcttcttaacttctgctcggacatctggaatagtcacagcagcaatattaacttcagattgtactgcttgcttcagcttattctgtgaatcttttaacaccatttctttaacgatgttattgattactgactgttgcagttgagcacgggctgctgtaccttctgggaataactggcgtactgcataagtatcaagtttaatatcaatcattttacctttttcactccaggaatattagagatagtttcaaatacttcgtcaaagttatctttatcaacagtgactaccatagtgcgagcggtctgtttctttttccaacgtttaaagaaagttgcaagactcaaatcatgggaagtgaagaaatcatcggttttgtaaacatatccgctttcaatttttactacagcatcaggtgaagggtcttcatattcttctacttcaacatcatcaaagagaattaaagtatcatcatgataatagccttcccagaaggcttcatcgttataaaattctttccaaagcgcgccagttgttttcatttaatcaccttcttccaagcttcgtgagcagcgcatgctaatacttcatcatcagtcaaattaaacttgccttcattacgacgagcaatcatttcattgaattcagtatcagttctaagcatcatgttaagaactgtaaaatccattgtcgctcgaagatattctttaagctgcatagggtcgatgccactttcgtatgcgtcaagaatcatatctgcaatgatgttatcaaagtttttgtcttttatgaggttattagcatactcgacaaaaaacttagtattagcaccagtaatagttttagtaatcattttaattttctctcaaatttatgcttacaagtccggcatttcattttcagaatatcggttgtccaatcgacaagctgtacttgaatactaccacatttttcgcaaggcacaacttgtttagctgcagcttctcgacggtctaccatttcaagacaggcatcccagtcaattttaaattcaggtacaggcggatactcaaactcaatttcaaggtcgttatcatcaacgaccatgtcttcttttaattgatttttcacagtaagctccgggcatactcgagagattcataacgctctttgtattcgttaagcgatttaaccaaatctgccatcatcaattcatgtttagccaattcagcttctttagtatcaatgaaccgcttaacagattccatttcaattgcaatagaattcttagcaatttcaatatgatttactgctgtcatctgtaaaggcttaacttgagctaggtacatatgagctacatcggtatcaatgacatgttttgtcattggaggaaaaatcttaaatgggtccaaatgcacttcaagagtagatgaactttcaagaagcattttgcattggacttcttttactatatccatatgatttaatgcattacgaacctgagccaaaagagcacgtgatggataatttccactagtccaatggctattaatatgaatacgtactgttacgttgtcaagttcttctgcgcgaatactgtgaatccctcttggatttttcggattagtagatacttggtatttcacacgatcagtatctttaagcaaagaaattgagcgattaagaatacggcgcagattgctattgaactcagtacagaaaatccgcgaagcagaatgaccaaattcttcatcagttttaaatgatttagacgcaaaattataacgataagatggaattttagtgtctccaacaatgaattgcttcagttgttcagcagcagacattgcacctaaccaacgagagcgacgaatattttctacaaagaaactaactacattggattcgctagtcgccatattatctagagttcgtttggcaaccttacccgcaattgctacatcataagcccttggatttaaatcatgtaaagctgataacaccttaacatgtttctcacgcttcgtgagagttttatctttcaacttattaaattcagcttctacaaacatctttaattcattcttattcattatcttttcctctattttggactgggctcaaagagtatctcaaaatctccctgaacccattatacaacaactattcatcaagcataataactttgcttggacgcttatagaaagcatgagttttatcatctttcgctaattcaaatgtagcagtaaactgtactttgcctctgtattcaaacggaatactttttggaagggagccgtaaaccgtagctccattctcaagcacaaccatcatcttacattgtacgccgtaatagtcttcataaacttttactgacgttactgtaccagagacggtcactcgtccttccggtgcatcccctttattcttattcagctcattgaatatattatcaaagacctcttttgaatgttcctggatagcctctaagatgctcttatgagctctaacttctgccataacaacatctgtgccatcttgcaatttccactctttatatggaatgcgtacttcaagaggataaccatactcccgaagttctttgtactcttcttgagttaagcggattttccaccaaccgtggtcaccggtatactcaggcttatccagtgaatccaattctgtaacatacggcaagtaactgcctgcgtgataagcttcaacttcacctaattcattttcccaaagataaccatcaaagggagcatgaggacgatcatctttgccccaagtaggagctaccactttatcaaagtattcacgaccgaagcgggtcttcgcccatccagcattcaactcctcggcgcgtttttcaactttcgctcggtgtgcttggcgggctacacgattttcttcaacaagtgcagagataatctcggttaaagttttcattttattctccagtttggttgacgagaccatcttatcaacagcctcgccgaaagtaaactactttgtgaaaaattttctccaaagcagaactgcgtctctacgagatacttctactgctcctagagcaactgcttgcttgcgacgaacatcacacaaatcatagtgtggaactcgcttatcctggaaccaagaacgtttcattccgatggcttctgccatagcatgcaactcatcaagattgtcgctaaacatgtggcagttctttacttgatgacctctcattttccaaccatgattcatcaagacatctacgtatactgtcatttatgattctctatgtaagtttcaatgatgaactgtgctaaacacagaagattatcttctgaaggagaatctactaaattctcaaccatttcagaaatagttccaaaagcttcttcagtattgaacatttcttgaagttcgttccaagtaggtgctttcatttcaatctcctcattagttaacggaagctatcttatcatggcttttctaagatgtaaacaacaaaagggcccgaaggcccttaaaaagatcggaaatcactgttaaaccatggcgactggtgttgtcgccgtttaagcaatttcagttggtgtttcctattgtcttctataatcatcttagaggcttttagctcttcagccaatgagacctgtttacggtccatcaagatgaggttctgggtcttctgggcaaatgtctgaatatctttaaggcattccacagattcctccattcctcgcttatacttggttcgggcagcatttaactgcccttcgtaatacgcatgtatagacactatagtattaaacatgggttaccctttagcataattgacgatttgttcacgatcagcgggccaatttaaatcagaacgtttcttgtttgaccaagcaatattttcttcagcccaatgaagtttagccgatacgctcttttgtacgtctctgatggcttcttcaagataaatgcctaaatctctcgggttagttccttgagttttaaatgcattgagcaaaatatttcttacgacttctttaaattgattttcaacttccgggtgaataaattcacgataaccgttgcacggatatccaaaagcatctaccatacgagtagtactaaattctttgttcataatccgagcgcctcgcgttcatcaggatttaatttagccaaagcggattctttaattttttccaaccgtttacgcttagcttcaggtgtttcttcctgaacactaatagcagcgcttttaggaaaagtccacgattcaccattttcatcggtgaatgtaattagttccgttggcttacgattaactgtaccatctgagccccaccaagactgccccttaactgcttcttcggcaacgcaatatgaaccataataaccaaacaactcactacgacgatcgtctggtgaaacatacgctgcataggcttcactttccgtcattacccagtttttcattttagcacctcataacgaataagttcaatacgatttttaagctcttggtatgatttacgccaaggcttataataggcatttaaatcttggtgttgtttatgcatttcgtctaaatgctttactgcatcctgcacatttgcaaggaaagtatcaaatactttattagcgtattctttcctgagctcaatgaatggaggagcacgaaatacgtttaccattacacgtaattcatgataagaagaatggacttcagctaatacatttttcttatcgccaaaattaaacttataaagtttttcacagattgcttcacaagctttctctgctttacccttaggtttacctgcaaagatgtgtcccggtggatatactttaatatcgtttaaccaacattcaatatctttaatagctgctaaactcattgtacccacgctccgttttcatcaatgtaattaatccactcgttaatagtccaggaagaggtattacctttaggagtatcaacgatatacattccgcctttaaacaaaacacgttttacatcattagaaattaaagtagccattatattttcctcagttagggaggagaaatcctcccgtttaaattatttcagcattgttacttcagcaatttcacgccagtttttacggtcagtcgcgacgaaatcaccgatataaagagcagtacggagagatacgttacgcagacgatttacgttatctttcataaattccaaaacttcaataacttcagaatttcttaacccacggttctgtaacatagaagtggtcattattacatcttgaacacgaaccataatctcttcattagtgtgaacaccaaggtcaagataaaccgaacgtgataccagagcttgaagatgcggagcaagtttagaaccacgctctaattcacggtcaatatcaacgttagtgataaagaccacagtaccttcaaactcaaactcattaggaattcctttatcttccaagaaagaagatgcagtgctccagcatactttacgtttctcccctgaatccaaagcagctttcagaaggttaagaatgtccatatcagagaatacatccacatcatcaatgagcagaactgaatttgcttcacgtgattcccaaagacggcagtataaaccaattcctgagattttaccgttcactgatttgtaatcaatagcgttagtatcatgagcatgttgtaatgctttatccaaagagtaagtcttaccgatacctgctgctccggagataatcagagaacgaatattcccatgaattaaaccgttagtcattaatcccatgacgttaaagcgtttcttgatacgctctttcatttcatcaacggattcaacaacttcaatcttagcagctactccgtcaattacgatatcatctttgaatacccaaacaccgcgctttttaccattcagttcaacaaagactttaccatcaccctgacgagagtcttcagcacttaagctatccgggaaccactcaccgagtaactcataagtacctgaaatctctttgccgaagtaaatccctttcttgatggtgatagttgacattttattctccgttactctgttttgttttgatggagctatagtatcattctacagctccaaagtaaactactttttaattatttttctaaaatttcattgatgtagtaaggacggacctttgaaccaagatagaagtcatctacaaaatcaatcaagttgtcagtttcaccacggatgatagcaagcttagagaacacttctcccaccatcattggttcaaattctacaccgtgagcttcagcagctttaaaggctttatcaatgttgtttacgacgatttctaaagttttcattttattctccattgtatctgtttgggtggtacaggtctatagtatcactagctcgcgagcttgtatactactttatgcattcttttgaaacaaaaagaggagcccgaaggctcctcagttatgcgtgcttgttgatagcgttttctgcgatacgctttggaagtttacctgcccagcggaagaacatgataatcgctccggcaataaacgcagggaaccaaaagatgagataaaaccaatactctcctgctttctcgatggttccatttttgattagatgcttacagacagaccaacccacgataaagtaaattattgcaacaacgattggcactactacgctccaaagtaaaatcatatttcagcccagtaaagtgagaaccggagctcttctccggcccatgacataaattggtggatttgttttcgagttggtcgagcagagaatttagcattttctctacgaccagtctctctgcaaactgcttccaaataccaccgtctacctttatgaggtcttccataattcaagaagaccttcattgtatcatttgtagtaagaattgtggttttcaagataaaccttctcgacgaaatcgtcccagaacttcatgtctactttcttaggcattccattcttttcggcttgatgagctagaatttctacttcatctactacagactcgagaagctcctgtacttctttgaacggtaactcacctgctttgaccatcttgaccattttagcatgggtcagagggaattgaaggtcaccagtcatatagatttcctgaagctgcagacctgcacgaagagcatgactcagtgctttccaatctacaccttcgttagcttctgccttacgagcacgttcaccatattcagcatcaagcttctcaagggagtacttcatctctttgatagtgatagtcgtctggaatttacgacccagaacgttataaaacttctgctcgcctgatttgtggtcaacgaaggtggtccattcgaggaattcaccgagaggaagtttctctgcgatatcctgtactttccaacgctcattgatacccttctgctgaggacgatcgtcatatttccattcaggaacatctctgataacatccaggactttatgcaggtcagctaaacgagaacccttaacaccatacttacctgcttgcttacggacatatccaagataagccttcatgtcagtagtataaaaacgagctcggttgtcttgaatgaatttccatacttcaggaaggtcagatgcaactaccaattccggtggagtatgcagcatatccaacgcgacagtttcaccgtcagcagcgagcttgaagaaatactttaagctgaacagctcatggtcgacgtcgtctttcgtatttttggttgcgctgttattagtattacgattagtatgattcatcgcttgacacaacagaacatcacgcggatgaggtacaaagatttctttaaaatccacatctgactcgggagttgaagtaccatacagatgtgaaccaaaataagattttacgattgttttcataagtaaatatgattccctttagcgaatttaatcaaatcatttgaagatttagcacaggcttcaacatgttctttatcagtactcttcttagaattgcgatgaacattcccgattttctgcatagtatggtagtatactacgtcatggaaatgatattcttgaccgtctggatgcggttcgcggcgggcggttttaataacatgtgtatcatacataggaactaatgcccaatcattcccggtattaatgattgctacttggatatccattttgttccatttaaaggcattaacatatccaagaacacgatgaactcggtcaaacattgcgaatttgatttcagaagagcttgccattttcatctgcttaagcaagctcatagagagtttctttttggttgttacgatttcaatttccataacccaccctcataatatatgtctaaatcaatgttatctttgccgctgtacttgccagtcaaaggaataaatttaaccgtaatcttttcgccgtcatcaaaagtaaattcagcaataggatatgtagaaattataccacgttcggttttagcacgaaagacggcccgaaggccgttcacgatataaacttgatcattcttcactagttttaccttctacataatcaatcattgggcagactttccgcttacgggcttttaaatactggacaaataccgatggttcggcttctgcaggaagacccgcttttactcgagcaagttttttggtatactgtttcttattgcgatagcgtttaaatttttctaaaccaaaaataaatccaaacgctatagctgcaaataaaagcacaaatgctgctataaccactgcgccaactggtactgctacaacatttagccaaaaggcggataaactaacacctatccaagcgagaattcctgtctctgccacaatcggccaaccgaacatccatgcaatagaaccaatgaatatagcaattgctgaagagaacagaatatgaagtactgtggtccaaaagtatccacatagagtttttggcattttccatatattgccagatttaaaccataggttcattttgaaatgccaagaatttttattgatattcattataagttatcctgtttcatagttggaatcattgcggtaagatatttgaccagttcaatagcgtcgcttttatcaatagctacacaatctccgtcacgttcaatttcgatgatagtattatgttcatacgtgtgaaataccgtaagatacaaatcaataatatgcgggctttcatcttcaattactgcatcgcctttacgggattttccgtcccatactaatttactcgccatcttttgcctctatcaagaattgaattaatgaatcaatttgtttagtgtcaagatgaattatatcattgccttgttttagcacgatacgactcaactttttagtgaaatacgaattcacaacctttacatgcacatcgctgtacggattatctaaattggtactatcaagaatactttccataattacctcaattgtgaatcttttgaaccgcggcgattataggcagaagtcattactgtatcccactttccttgacattctacacaccgttgacagcctttaaccaacagacgacgagctactgggatttcctcatcacaatcaacacaaaactcttcggattcccgctgttcttggagttgtttctgaagacgggcccattcaatcccgtctgctattgtagcttcacgagttgcaaatccgtcatctgatgggccccatccattcatttcaaactctccagaatcatttgcaccaaattatatgtaaacatcggatactggtattgtaccacaatgtagatgataagtaaaacgtttctcattcttcgccatcatcaaagtcgtagtaatcataatcacaactgtcaagataagaatccataaattcttgttgacggcggaaatcttcagaaggggtcagtctgtctgcatatgcttgatcatctggatcgctgaacttatcttcttgcaattctttaatgaactgttcagcttcttcacgtgtccaaaacccacgattaagattatgaacagaacgcttttcacctggcttgaatacacccatatcatgggcagaccgttcagttgaataactttcagtttggccagcatagttttcatattcacaaatcacttggaagaaaggagatttacgtgaatatacaccacgaagaccaagttctacatcatatgtgcctgaagcaacaatgtaacgcgttatttcgccggttttagtttctgtgcgattaacaccacacacgtgataaaagatttttcctggttgaagctcggtagttaacttaatcataatgtttttctcgtttggttgttgatatgtctatagtatcatgtaatgaagggaagtaaacaactttttgaaaagaaaatgcctcccgaaggaggcggagggtattactgcaatgataacaaatacttagtcttgtagcatagacctgtaatgtcatccagaacactttggagggcggcaggaactgacttgtagataccatcggccttagctagaatgaggtctagcatttcaatggtgtcctttggcagctctttctgcgatggtaaagccggtgtataactcttacctgagaatcctaaccactgctcaccaaaagcatctatcaaatctggaatctcgttaaagaaaacttcatacgctttatgtctggcatacgatttggtatcaaaatgcgctgaatgaaaatacgcctgagacgccataagtaaaccgatgaattcatcttgtggagtaagtttaccgtcctttacaaaatcattgaatttcattatcgagttgtatcctcatgcggttagcatattcttcacctgctgaacgtcctaaagaatcgcaatctttagaacaagactcactcttccatttactttgtataaaagaatagaactgttcagactcttgcttactaggctccttaaatttagcataaacttgtagagctccctcaacatacgagttataatccgaaatgtcgttgtgtgatgcagctgggagtgaaatcccgcagcccaacaccagggctaagcaaatgtgattaaaggccatacggcctcctattatttttgtccagtattacgtttgtgctgaagtacagccttaacttctttgaggtatttgtccagcttacgtttacgggtataatctgcttttgaactgtgctgacgaatttcttcctgaaggtgcgaaataccatgcccaatctcacgacgaagttcgtccagttgttctacagtaagattacgaagttgcttttcacttaaatgctgcatatacacctcatcagttagtaatagtatttatataagtatgtgttacttaatcccaaagccattcgcagatgccttgctcaatagttctagcacctgcttcgtcccagttatattcttcgtcatacttcaatgcgcgtttaatttcggctttatgaaatagacgtgggatcggcatagcataacgggtccaacgtaaagttttccagaatccatcgcgctttgatttagcaattaatttcttggcctctagcggtctttcccgattttcagaaatacgcagttcaacatatttctgttgggtttctttatctttctgagttttaacgtattcgttatagcttttaatataagcaaattcgttattattctgatcgttccatttggaagattttactacatgccagcctttgcggcgaattgttctagacattattacctcgttaagttaaattacctcaacgatagtaaaatcctgatttgaaaaatttaatattcatgaatagatgaccttgcatttacattttggacattcaggttctttggttttaagacgcttggtagcagtctttggagcagtgttgttaatcatatacatgaagacaacgatagcacatcacatattttttcatattaaaccaataacgaaagcaatattacgtatagtaagaatccaactacgaatcctagtactataccaccgactataacaaataagctactcatgtttaatataacacccatttgtattagcaataaagtctttaccttgagctaatactttgcattcggaatcaagacgattttgaagttcttctcgtctatcgctttgaatagatgctgctacacccatccaaatgaatagcatacttaaaactagcatcaggatagtgttatacgttcttggcttcattataaacacctaccagttcgcaccagtgtttacgacaaagagaaacgtatttgtcttcaccaccaagttctactacttcaccatcggtaatagcatttccgttttcgtcaatacgagctaccattgtagccttacgtccacagtggcaaacgcccttgagctcaacaagtttatcggctacagaaagaagagctttagaaccttcgaataactcgccgcgaaaatcagtgcgaagcccatatgccattactggaacatcatacaagtcaacgattttacatagctgaagaacatgttcagcagtcaagaattgtgcttcatctacaaatacacaatgaatatcacgttgtgtttgtgcccacttgaaaaactcaaggatatcaatagattcgtctactgtattagcttcatgacgaagaccaatacgtgatgttacctcggtggcagaatctcgagtatcaatagcaggtttaagaatgagagttcccattcctcgttctttgtagttatgcgccgcggtaagaagattagctgatttgcctgcattcatgctcgcgtagttgaaataaagctgtgccattaaagggtctccataaaatcagaaatagcattcttagaacgaatgagttcatcgtattcttcgggtagaccatttccgtaaatggcactaatagctactacttgctcggcacctgcataatcgtcaatcaactgccacagtttatttttttgctctttagtaatcatctatttacctctaacaagatggatttagcttttagcctcttcatattctaccactgtaatgtcaatatcaggggttgctaaattaataagtttctcaattagttcccaatcaccgccagcaataccagcaccaatctttggaatgtatagaggacgattataaacaatacgaccagaatttagttcatggaatgcattaaaaattgcgccgtaatcaacatttggacctggagcatactgagtatacaaattatagcaatatgcagtgccattcttgtgaatggctcgagtatgagttccaagcttggctaaattattgtcataataacggtcttcatcgatgtcaatatcgagaattggaggatatgctttagcaagctgtcctgctacaccggcacccattgtagtaaagcaattacacccatgagcgatatcgcattcatgcttcatgaataactctacaatattgcccttaatatatccagtaatcatttattcacctatggaattttataagttgcgtattcattaagattattgtatactcttaaaaatatagcattgttacaattaaggatagggtttagcactccttgttctttaggatgcattactccatcaacagaaacaccgtcactctgcattccacatccgcgagcattatattcgacgtgtggaactattacctggtcatctttatctagataattataaaatgacattagcaattttctactgctaggaacaaatgctatttcaatattgttcttgaatggaccgttgctttctattttagtcccctgtgctgcaagtatagtttcaggatagcctgggagcttttcccaggcattaactgaaaatgcgcagcataataaaatagctgcttttttcattttgatgatagtcctgacatataacgagccattaattggtcacgatacattaaacatatattttcgttaggagcattgacacacaaatctttcatgctcttagccttacgatttattagtgttgtccactgggccgggctacgtgaatcttttactccatcgctgaatgctgaatctaattcaagcgctaatatatcaacgcattcagagttcgtattgcaaaatgttttagcgatacgaagtgaatctgtcattgaattttcagcattagcagagaatgccaatactaatccaagaagcgcggcgtactttaccattattccacctttatatgtagcattttatgtttctttaagaaatgagctttctctaggacatctgacgcataagagtttcctcttttgacattccatcctgcattataactagcaagagcttttcgcatattgccgttatgtatatttaaccaatatgaaagctcaatatatgcccactccgcagaattacgtctggatttaagcatttttcttatttcagaatcactaaggtttttaccttccagtttagctctggccttaacggtgggtaagtaattttgaaaaaccccataagaatgatggcctttacctgcctttaaattggctcctgccgaagactctttccatgatatagcagccattatatatcctaagccattattatcatatcggttttgtggaggtttttcctttccggatttttgatattgttcaccaaaattatatgcgtaatgcaagttgtcaagttggacattactgaaagttggctcagacccaaaggccgttgaacacaaggccattagaccgacaagcgcttttttcatgtttacctcaattaatgtgtataacttttgtgctgattttacctttcaaacgtttatcattaacgaatgccatacgacactttatactaggtccttttcccggtcttggaatatccatagtaaaccctagccacagatttccatccgtaatttctaaccgcatgggtttatactcgatattttcatcaatgtcttttgggtcaattggaagccaaggcattgctaaaaattcattaatttctttaaggtgattaggaattttggaaagaacagagaatacatactcttcatcaatttcacgttggatagcacggtccaacaaatgatcagagtacttagtgaagaaaggctctttaccctcggctttcgcccgggcacgaacagataaattcaaagagcgaaatgcttcctcaaacttacgacgcagtttagttctgcgaatgaatacttctgggttagttgacatagttcattctcctttgtttatagggccatagtatcatggcccgcaaggaaagtaaactactttttaatatttttcttctggttgaaacactgaacgacacgcccacattgaggcttccttcaggtgctgaatagcattgcgaatttgagtaatacgctcatgtgctaaatcaaattctttgtcgctcattgtgctaacatctaaattcatgtatttttcaacatgctcttcttctaatgctttaaaaattaatccaagacgaatttccgcgtctttgatagcatttactttaccaatcttttcatcggtatgtggcttatatcctttgatatcttcaattgccattatagtgcctctgtgaaagtacgagcgataacgtcgcgctgctgttccggagtcagggagttgaagcgtaccgcatagccggaaacacgaatggtcagctgcggatatttttccggatgctcaaccgcgtccagcagagtttcacgacgcagcacgttcacgttcaggtgctgaccgccttcaatttttaccgctggctggtattcaatttctacttcacgtgccttgtagccataaaaagtttcagcatccgtaatagtatcttctttaagaacttttgaaacgattactcgtgcgtcatcaccatcttcgatgtaaatggtgcctttaagttcaccttcaagaatttgatatgctttcatatttcctcttaattagattctttattccaaccacgcatgtatgcggtaattacactcattttattccattcgtctgaatgaaactttgcagctgcttctagataagttattttatcttcatgataagtaacttcttcatcagtttctttatcgtattccacaatttcaataggctcgttaactccatatccgcgagtgcctatatacgttgtagcttcttcccactgtttggttgtttcattccaagttccattctgatgggcttcatagaaatgctgctcgccagaattactgaaccaagcacagaagctttcaactaaatgtggaggacaccttataacaatttcagccattgcattgttttctcttgaatgcgttggtcatatgtgattaaacttgaactaatcacgcctttgagcttaccggatataaactcaattctaaaattaggatagcgattcatccacttcgtgttgggagcattagaaatgaattctgcgcctttgaatgggccagacagaaacttgtagcgcttgtactcaagcaggttgccagccgtaaccattgttattaattgcttcatatcggcaaatcctgtattttccatcactgtaatcatatcaacaatttctgtctgtgtcatcattgcattcctatcacgaaaaataaaggtaaggtatcattaggcatagaccatctgatagcttcctggtacatatcatagaacttcatcatatcgggaactttcattggttcttcaatgataattaatgctcttccaaactttcttcctctgaacttataagaggaatcattggatagaaattccctgattgtcatcggaacaattgatttagctatctcgttagccggtaatttattaattaaatgcgatgaattatattctcgtagaataccttccatcagttcagatgattgtgtgtatcgagtagataagattataaccgaaccatcttcaagcaaccaatcggtagcgaattggcataaggctgcggtctttccggtttgtcttccaccatctagacgaagggtaccgtactctcgcataaggcaagacggttcataaaaactgtagttgggattatttaatcgtctgtctgcagcgtctttgaaagcatgcatcagggtcaaataaattggtgttaagtatttcataagctctcttttaatggggccattccttggcgcatggagtgagtccattccgataccttatgtaactggcattgccacacttgggctcgaccttattacaggtaggcgggaatccctcatagaatcatgaggtccaggttattccaatgttgtttaaatgtaaatatgaatatactatcacaattctaggagaaagtaaactgttatttacctttaattactttagctgcttcgatagccgcttgctgaaggtcatccatagacataccgaatttagaagcaaagttatcaattttcttttcgacagcattcaaaggcttggcctgtttaccttcattagcgccaggaagagcgagaatacgctctttgtcaatataaaggcttacaagtttcttacggtctttatctgacaaatcatgaaatgaatgggcctttttatttatagcggcttctaatttacctgcactcactcgcgcttcagtgataaattctttataagttttcatttttaaatccagaaaggtaaaagttttaaattaaatggggccattccttggcacatgtttaatccatcgacacactatgtaaaccccttaccgcacttgcgctcgaccttattacaggtaggaaaagctacttcactcagaggactcgacgttcatgaggagaggtcgtgttcggctttattaggaaattgcttacttaattgatttagcgtaacgaatagcgccgcgatcgtttacgaatgcaattttaccattacgcatgtacatggtaaccgtacgctggtaaccgttagaagttttaccagactgataacctactaatgcaaagttatcttcaccaggtttgttctgcttagacttaatacgcatatgtccatgggccattaaagagcgtgcatcgccagatgctactgctttgcgagaagattcatcttcaaccgaagagacaaaatcatcgaatgaatcaaacttagcatggctcttattatataacttgccgtctactacgtagttatatccaacaacgtccatttcaatttctgtgccatcttctagtgtggcggtcatcttctggccttttttaaatttcagaagattacttccaacagattcagtcattacgccaactgttgctaaacgggattcatttaaaaattcttgataggttttcatttattttccttgataagcagaccaagttccggtccgcattgtttcaattacacgacgagcacgattaggtgtctgacgataccaacgtgaatttgcaagttccttggcagcagcatcccattttttagtgagtaataacttcattgaagctgggaacccggctacaccagacacacccatttggaataccatgttaatcagagcagctctacgaacatcatctaatacattatataccgggtttaatgtagcattagcaacaatacctttaattgccttctcaacatctttggcaaaaattacttctgcctcagcctgagtaatttgaccaccagtagaacgacctaccagtttgtccagattagaaatagccaaagattttgacgggtctttagtcagtaagtgaccaataccgatagtccaatacccttcgctatctttataaattttgctgtcgtatccttcatcaatacgcagcatgccaaaaatatccataaggacctcctattaattataggagtatttatttggccctgcacttggctatgaataactcaaggctgcacttctcgtatggtgtccatttatctttccaccacacataatctcttctatcgtcctctggaatttcattaaatccgggatacagcttttctgctatgtaatatgttgattttgtatactcgccgtcaccgaagacgtatcgtgatttcaatagtatacgcgacattttatctctaggatgaaatatgctaacccattttccatcgtgaataaatcgtagctcatgcttataaatgtgtggaatgcctaattcaacggcttcttccataataacctcactgagctgtgctatacatttgtgtcatgattttatacaaacttggtcccatcacatatttccactggcttggtttaattaaagcaaatgcatcgatttcaggaaaattaattccattttcatctttatggtaagctgtacaacggcaatttctgaacatttctgggctcacagggagcatatatccaaacagatggatatccttgttgcttgcataatcatgtcgtccaaggtcatataagaggtcttggtcaaactcggtaaatccagtctcttccttgcattcgcgaatagcagcctcttttggtgtttcaccaggctcaacatgtccttttggaatatcccatctagagcctctgccctggatatatgtatttgtcatacgacccatgaaaagccgtttgtcatcggtaaagaataaaattcctgcactgagctctttcattggcattcgttccagctttcttcaagaatatcttccatggcagtatagaccatagactctaatacaccatcacagttatatgaaccctctaccgagaaatcacagataggtccattaataccaagcagttcttctttaagtgaaatctcgataccgctcagtgattcattatcgctgtaacacagaaggcgagtatcaccattttcaaattttacatgcactgcaacagccattatttcatctccttaatccaggataaagtttcattgcgagagtcatctttagatttttctttctttactttgggcttatcaaatacaccccgctgtcgttgggaaacgaattgcaaccaacgagcaagcattgcaaaccaagttccaacacctgacatccaacctagatagtacaatgtatcaccaaatactggtgaaaagaagtagaatccccagaatatcccaacaccaacaaatgttgagaaggaaaacaggataagcagaaataggaagaaatacaagaaatcatcgtctttaatcattccacgataacaagttttaatcattttctgcagctcctaatccaggtgttgaaatcttctttttctttccacttcttgtatttcatacggtaagctaaaaatgtgcagcaattaatcaacgcgataattagcatccacatgaggctgaatacgaaaacacctaaaaataaaagcataatcataaactctgagacgttcaatccaaagaatgtccctccaacaattacaaaagcacaatataaaatccatgtcacgattccaaaagctggcgccagcccatcttggttccaaaacccgtcaggtttacattcattcattttcttctcacctctttaataaactcaaacgactttttgcggttccattcaagagttaaattcttgcactgttctttccattcagcctttcgttcacagttatgcttaacatactttacccaacgaaatagctcaattaatcctagaccaagtaaacctattaatccccatgtaagtaatagtacattcactaatgatgtactgctaatttcagccaaattcattacgtcgattatgataagcgttatcatagttccagcagcacagaccatccccggaattagaacataatcagtttggtcaaatttatagacataattataaacgggaggttcacttggcagatataaattactcatttctgcaccctctcgcggcagtatttgataaattcatcaatgattaattgtttgcctaccatgttgttagagtcaaacatacccatgacttttggtggtaattcattaacgcagtaatttaaataattgctataatcatcctgagatgtcacgtatttaaccagattaataccgagacgataactagttttattatagataatctcgataactactgtatatgttgtggagctagaagtaaaatattcatcggcattagtacgggctgattttaaatttgatggagaatcgttgaaagaataaattccgtaccgaagtgcaaaaatatccacaagcttaactccgtcggaaatagacgaaatactggaaattaagtttttcagcttgtagtagtctttaagaacgatagcccgcggcaaaactgtggtgttatacccgttatagcgagttttccaattttcaggccgagtatcaggatgagcaaatttttcgagaacatcagtgatttctgttgggaatcctgctgcaattaattctttaatttgaggtgttgccattggaatatctccagcgcattcatataacattttattatccaagttaggggcccgaaggccccggtaaaattacttcagactttccagatattcctggacatcagcagtggtggtttcaataccaggctgagtaccgctgaaggtttcaactttcatcatgatgtcttgtacatctactttagcgagttccgcgatttcaatcacgtcatcagcagaggtaatacccagagcagaagcattacgggtctcacggatgtattcgagtttcactgccaaatcaagacgctggtcatcaagcttaactacagtttcttcaatttgggcccgcatttctttatattcggcagctttatcacgtaaagccttagcagtacgacgatacagaagacccagtttagcatgggtttctacattcataccttctgccatcaagcgacgaatttcacgctctttggaagcacctgcctggtctttttcgtcagcaagtttcagcagacgcttttcttcatttaccgatttaacatgcgtggtacgcagtttagtgatttcatcaataatacgatttgctgcagtggtgtactggtcttcaacagaagtgttctgtgcaacaaaggtaccgaatttagaacggatgaattcaacaagttttttcagaatagacattttatttcctttcaatagttatggtggttttattcgtacggattaatccaatcataaacatatggtttaatgattagaccctgttcatttttgctgcgctcgaatatctcgatataatcagtaacgtatgattctaatccgagaataagtacagactctttgccttcttctactgttgctttaattaaacgctcgatggctattttagcttcaagacgaatatcagcaagagtttttggaacttcatttgtatgcattaatgagttcctccattttgtccaaaactgcgatatcaacaagacgattaacctccgggtcatcggcaaattcattgtaagttgaaatcaccaggttctcgatagttttcagtgcagccattcgttcttcaccggatggaaaatttggagtttcaccaaacagcctagcaaaagatttaaaataagtttgcgctactaatttcaacttatcttgatacataccaatttcctcagtaggtggggagttcattataactccccaaaattattagcagttaattaccgcttcaattcgtttaaccaaagcaggaacagttttagcaaacttgatagccatttgaaccgtagcagcttcttcatggtaaactcgaacatagtactcttcaacagcaggccaatctttgcgaacgtgtttaatcaaatctttcagttcacgggtttctgctacgctgaacactgcattctcatgttcgcctttaatccaaaccgcgcgataacgatcaggagtaccgtattgattataaccacgttcaatttggataaagttgaatttagacattttattctccgttactctgttttgttttgatggagctatagtaaccgagttaactggcgttgtaaacaactttgtgcacaaattttcaaataattttagggaatctggaaggactttctggagagtagaatggatttatacagcttgggatatagaaatgccctagatgatttctagggcaataggatttcattatacggtataggataacccagtttggcgacttagttcaacaagatgatgacgcagctgagacagcagaacttttacttcgccaatgtgttgtgtctcatgggcagatggcttagatccttgtgacgcgcgatatttgtatagattatcgagataaacctcaattgatttgtagagggctccattgtcacgtactagcggaatcatctggtcgattgcgctgaacagttcgccagaaccaataatgctaccatattttccacgaacttttagacctggaacatctttcggagcttctttaacaactggcttaacaggttctgctttaggtgcttgtggcgcaggagttgcttttgtggttggcgcagatttttgcccagtcagagatttgaatgcattctgtactttatagtagtcaccaggattgttagtgctgatgccataaagcttttctacggacgcagcaaatttcataaaatctccacgctcaccttttggtaccatgtccatagctgactgccatttaccctttgtcatccgtacggatgcttcgtttaaaaattctttaaaattcattataaattcctaagtattagtgttgatttactatatactatttatactaaaaagccccgtccgaagacagggctctgagaatcgacagcatcacctactggcagatgacctgcgaaattcatttctttggactcggaggcatcagtctcatccaaagaagtatagcgtcaggaggttatgcttgcgacagggaacaaccggctagcggtaatggacgaaccattctcttctatctgacgactcaacgagggcatacgcaagtttcccttcgaattacattacatcgtattcttcaactagatactgataataggaatcgtttgcttcaagttcttccgcatatgatgttgcttcggatttagtgtgaaaaatcttaagaggcaaagaatattcttcatagccatattcacagttccagttattttttactacagcatatactttcatattttcctcattaatttttggtatgggtaggaatcgaacctacaagccattcagcaccagggcctcacgctctacctatttgagctatcacataccagaatttggtgccgattgcaggagtcgaacccgcggcatcttcattacaagtgaagcgctctaccaactgagctaaatcggcgtggtatccccacctggactcgaaccagggactagggtttagaagacccttgttatatcctcttaactatagggacatttggtgcgtcgaacgagactcgaactcgtacgggtttaatcccgggagattttaagtctcctttgtctaccaattccaacatcgacgcaaatatttgttcaggcaggactcgaacctgcacgactgattccgtcggcgatttaccaccatcgccagcatatgatgcaatatgcgagctcaaaaggtgtccgtcaccatgtctaccgatttcaacactgaacaagataattatattactgattatttatagcatttctcaaacgataaagttgattacagaattcgcgttcagtcaaaatcgtttcagaaattttatttttacccatactgtgagtgagcgtagcattccgggtagcagccaaagcttttctgaatccttcatttttactaagtgcatcatatgctcctgttagtaaattctgatatgcttctgaagctcgatgaataggaacacctttccaataaagcgtttgtgttggccaccaacgtttcttcttacctttaaacttagcggactttccgactagtgtacatacatgtgcttgcatttcaggcgaagaaaatttgagggactgcaagaatccctccattgatgcgcattctacgccatcatagataaatttatgaggagcgaaattactcaaagcacatgatggatatgaactacctgaaccgatatccattacttttccttcacgtatttcaaccaatcaacttttaatgggctttctttctgcttatacgtaattccaacatggaatgcaatcggtgcgtcaggaatacgaatttcttcttcaatgttgaagatttctactttctcaaatactcgcatgaaatcatagtcatattcaattggattacccagccaagcctgaatagcatacataacttcatttgagcaagaataatggttatctaaataagcatcaaactcttcatctgtgcaatcatatgcaggaacatcaacaccaaagaatttcttggaaaattcaggagttacatacttctgttcagtatgaagcttttcaagaattgcttcatggttgtaatcattatttccaaggcattcaccacgccgaccattagaagagaaccattcaagaacatgaattacttgattaatctcttccttttctaagccataaaccatttgggtagaataccggtcagcatcattttcccaagtggtaattgccattgctaagcctttaggaataacttgtccaaatttaatatgcatttcaatttccttagttgataatttggtgaccctggcaaagactcgaacatgcaaccaatcccttatgaggggaacgctctaccaattgagctacagggcctttatagaaatcttatgacttttataaaagccctccgaagagggcgccttgtcgggcttatccacctgctaggcagaattactcacacataaaatcagctacttcccagaagtcatttttaactgctactttaaccaccggataaatttcagatgttttaatagaaacaattacatcacctgcgacagtttctaccagaccaacgattttctcgctgcgagcaacaaatttactcaccggatgaaatttaccggtagcagcgaacatagcttcttggtcaacaatcagtgcgatacgtttcattctttttccttgtttgttttgatgtagtaataataacaggttattcttgtagcattaaatctcgaaaatcgttccgttttcccacattgttgtgaacataggagaaaccttaacgaatgatttgcttcgcattgcaacgtagtcgttatctactttagccaatcctgaagcaatatcagtaatgcggccacacttcatagaaccgcgaccacctttattgtatgtgcgttctccgtagaaaacgatatcaccaacttgtacttctcggcctttagaatctttcatcatattttgcctgctgaattcgtttaaaatcgttaacaagttcttttgggtccaacgcattgttaaatggaagaacttgacgtagtttacttactttacaaccagagtgataagcaataacctcttgaatatcacgctcactgaagtattcatatttaatcagtgaatcatatcggcatttaatccatacccacatacctttgcgttcatcaaatgcatatgcaaagtcagcgttaatcattaaatcccgtttagcaaaagatgaaagccctaatgctaaattaaccggtccatccaaagacagcttcaccgtaatagcatttactttatttgcaacaccaataaaaatattcattctatttccttcgcttgttttggccttcttgtcgtgcacgagaacgtcctgctttatgcagtgattcgtaatatgctcggcgtctatcaatgttttctgtacgatatgctttcccgaaatgggatgttttgaagccgtaatatttcataatataattctcaatggcaagtgattggacggtatgcccggcctcgaaccgagtcacatggactttgcagaatccgtgtgtttaatatatcacccatactcgatagcatatctgaacgagactgcaatcccgctactcagcttacaccatcttgtattgtgtcataccgataatttggtctccatagaatgactcgaacattcgacctctccatcccaaatggagcgctctaccagactgagctatacggagtaattttgatttaaaattcttcttgcttgagtgtgacttacaccaatatgtttagcatatttagataattcgcctcgtttagaaaaatcatataatttagaaatttccattctgtaagctctttcatctgtactaactctagctaagtttaattcggatatctttttcttgaattcagccgaatggtgttttcctgcaaatccgcttggcttaccagccatattatctttccatgtaggtaaatccaaggatttcactgattttgaaatctttttcttatgctcatctgataaaggtttattagcacaagattttccaacttttgacatattagttcttcgttgttcggacaagatttcattattacatatgtggtcccatccgccttcaccaccaagctttaagttatatgtatcaggccttttaataaattcttcatttactaggtgtctttccgcatcatacatatctttagcattatcaaaagtttcgagaatttctttttcaaaattttctttgccgtactttttaatagcacgctttaaattcttaccagaacccatgtatccatcttccaacttagaagtagaatgaactccaatataaaacttttgatttattttatttgtaattttataaagatagtaatgcatatcagttcctattaaaagaaccgagcgtctctcgacgagtcacaatttggagcatccaaagggaatcgaacccttatcaagtgagtggaagtcacctataatagccgttatacgatggatgcaaatttggcaggccctgaaggaatcgaaccctcatcactgggtttggagcccagcataatagccgttatactaagaacctgttatttggtgggagtaactggactcgaaccagtcaccgctcgattatcggtcgagagctctaccaaatgagctatactcccatggaaagctaatcatctaattgttgatgtaccactgctatgggcagcgtttaactttcataaatttggcggagagtaaaggagttgaaccctcaccgtttccgatggcccggatttcaagtccggtttgctaccactagcgctactctccaatatttggtgaaggaagtgccatatagacacaattcgcttagcgacaacccagcatgactgtgggtcgtgtatttttccaccattccttcattgttggggtgaccggcggaatttgaatccgcgactacgagaatcacaatctcgagttctaccaactgaactacggccacatcaatattcactccatccatcatgaggacttcatacgaaattaagagaagaatgatcagttcaacccctgtagacgcgttgaatgaatattaatttggctggactatctggattcgaaccagagataccggagtcaaaggccggtgacttaaccgcttgtctatagtccaattatttggaggcggaggcaggactcgaacctgcgcgtgtcgggatatgagcccaacattctaccaactgaagttactccgcatttatccgggttcttgaagtactaacaagtagcttgatgtagaacacgctaaagatataatcttacgaatatagagcttattccgtgggaacaaacagcttcgtcctcggcattatctcacaggactcaaactcatcttcaagaactgccacgttcttatttggcggacctaacggaattcgaatccgtgactctcgcgtgacaggcgagtattttaaccgctgaaactataggtccataattcgctttcagagatactctggcacgatgccgaagcaaaggggaacaggactctcatcaccttggtaccagatgaatcttgtttagcactctgttctaagatgtatccctgaaagcgaactttcaacgccgtaagaaattataacatgaacaagcattaagcaggatgaaatcatactccttaatacaaacgccatgccagggatttctgtgccgacgattttatcagaacgtcttctgacttcttcatttggcgggccgtgcaggtatcgaacctgcctagtcatttctgacacggattaacagtccgtcgcttaccctctcagccaacgacccgaatttggtgggacaccgaagactcgaacttcggacacccggattaaaagtccggtgctctaaccaactgagctagtatccctaaatttggtggggagtaatggagtcgaaccactcgagccttttgagcaacagatttacagtctgtcccgctacccctacggtctaactccccaatgggtaattttatttatactgctctaaaattaatcagagcagttgatagattaataataacaaagaaaacctaaagcatattacacaatcggtgagctctttgatttaaccaggaatacccgatgtggtgaatccatatgagagagcaatacccggtgctcaggaattggacttgtatggaaaggaaccacacgataacctttaggagtaaatcctagcaaaataccaacgcttgctgcagaaagtgacccaccacagtagtatgataccaaatcaccaggctggatttcattgtcaagagaatcggttttgacatgcttaggcgtaactaaatcactaggaattggaacgccttgtgcatcatagtattcatgggcaagaagcttataattctcttgatagaaagtattaaacgcagctctgatattcatcacaatttcctcacaattaatctttgtatgcttcagttgaacctttagcaacggtctcaaatcgggaattcagtatctcaaaatagtcttgatacgttccctggagggcttcatagcattcttctaccgtagaatagacacctctgatttggtcagagccaggagcaggataataattagaccaagttaaaagtgcatacattacttacgtttccagctataatgagccaaaataagaagcactgcaatagcaagtagtgatgaatgcagtgctgccagtagtgcacctagtcctacgcccaaagtaacataatcatacttagttacttcttcacggtgtaaatcatagtttttgatgaaccactgcttaatctttttcatgtgctattttatccattatgaaagaaatgatacccattagaaatgcaacacttaacactgatactgtttcaggaagagacataaaggctgcaccgataatgccaaaacctaacgctcccatgcagatagttgatgcaacatttctaattaattcacaacgtttcattttattctcctcaagttgatagggttatagtatcactactacaacccgttgtaaacaactttattcagcgccagcggcttttaaaagctttttaagattagcagaacctcgggcagaaaaagttaccttaccatctttttcaccgatgctgccggtcaatttagaaagtttatcgctaggaacttttttaaaatcggctaatgtcccgtcaacggtttttgtaacaatcggcagttcatcatcctgtcttttagcttctgtaataaattcttggtacgttttcatgttgcttccgtttggttagtttgttttgatggagctatagtatcaccactaggaccggttgtaaacaactttgtgaaataaattcctatttcaaatcttctgaccagtccagttttagtggctcttggtactctctatcaagcactacaggtacttgaacttcaccctcgaagtgagctggacctacattgtagctgagagtaatgtgcggtgagtaatctgggaaatcatgagttgctcccaaagctcttgcatattggtgacggaattttaagtattctgaatctagcttaagaactagcgtacgtccgtcttgtgtgtcccatacttcaagtttacctgatgtagcaacttcaaaacttcctgaagcacaaacgtatggaacatgaactcttgaatagcatatcgtcgtatgaattttatgacgaggaactggattagggaccttcaactcacgctgaaggtcctcaatagcatcaagagttttctcagagaatttagcagctacatatagaccagtgctaaaatcactgaagttcattaggcatcagcttcttcagtggtttcttctgcgaactgtgcttcgatttttgcaacgaggtcatcaagtttaacctgaccgtcttcgctgatttcaacgccggatacagcaatcagcttctgcagtacttcttcatactgtgcacgcagagcagaaaggccttggatagtttcagacaggtcaaatacacgaactttcagagtatcgacttgggcttgcagttgttcagtagtcatttttgaattcctaatatagtgttgatttttgaataaagttcttctagagaaccgtcgttagttattacgatatcgccttcgcgaatcggaagtccacgctctgtgacgtgagtatcttttttagaaccttcttgctcaggacgaactacatgaataactgtagcacccatcgccctggctacatcaagttcatggtcttggcgggtatctgggacaatgaaataatcataatcaccaaaagtatcagccataaccaaagtgaatcgttttacccaatacatgcgatcgagcttatcacagacaatgtcagtcccaagggtctgcatgagacgacgaattgaccatggctcaacaggtttatttattacaactttacggatgacttccatcgtatcaccgtcaagtattttacgtttgttatcataaaccacaccaggtaaaggcaaatcatgatgaacatattcaatcgcgttcgccatgatacgaatcacgtctttagtagacagatttaaatcttgttcacgatcgtaatcaataccttcaatcatcgaccgagtaatgcgaggaaactgacgtgatgtatcgcgataccactcagtaagcattgcatcagccaacgcatctttaattggacctgctaactgatgctttgttgcgttatagttatccataatgtagtcagcagttgtatctttgccactacgttttttaccaatcaaaaataaaagcttcaaattattacctcatagaaggatgcattcccataactttctgttgatactgggattcgcgagtatcattgacagaaggtctaccagtaattattataccatctttttcaacttcgatgtatttgtactgcaaagttgctacacataccattgctgggtcggattcttcggttaaagaatactcaatttcagataaatcactcacccaacctccgatgtagcggacagttaatactatatcatgtttatcgttatcaagaacatgcattaaaactgcgccaggaaatccttcaccgccgttattccatccagacttgtctcggtcaatgtagttttgacagcttaacatccatttgtacatttgtacccatgaatcaagattttcatctactaaaaatctaacaggaacagcgtcaaactcaaaagtagacccaggcaatttagcacgatgcatgccttgaggcgagcctacagtatcagtagcaggaatatgaattccaggaactacagctgtttgaagattagctttaaacgcttgggtgaggcccccatcagggacctctaatataaagttagttgtgttagtttgattaaacagtccagtagacattatgatttccatacagaagtagcagagtagcgtttgcctttcgacatgaactgctgcagtggtaacatgactacattcgcccaatcagccggttttatctcaattaaagcaccctttatattaccaggaatatatgctttaatcattttgtcagcgccagcaaatcctttaacttggctccagtttatctttaatctggtcttattagatatcactggcgtattagcatactgtttaagaagttcttctaaaaactgctgacgagcctttggcggaatgtagtgaaggtttaacccatacatcaatgtggttgtaccttgctttccaagaccaagataaactatcaaaggaaatttatcccagaatggaagagtgtctttgtgcttagcgtcatacatgtaagcatatagctttccaggttgaggcttggttacagaatgaccacgtatatttttctttatagtttctgcaaaccatttagcagatttattgtttactgctgcgccttcattacgaattttatctttgatagagcttcgaaatgaatttaccatcacaagagcacgctcctgtttggtcattttgttagcaggttttttctcaatttctgctactttaattgccgttttaattcttgatgcatgacgagccattgctttactgaacgtagcaggatttattcctttgctttcagcgaatgatttagacgtcatgccttttttacgagcagcagagtattcaactcctaatgctacccattgattttcactacgggatttagctttaggcgattctgcagcttcagtgataaattcaaatatagccatcagcctttccatcctaattttttaagtgaatcttcggtaattaacctaaattctatacccattttactggcagtagcttgagctgctttccacttatcaacgtttacagaccatgtgtaaatttcatcaatgtaccgtttcttcgctgatgtcgtcaactttgtgggtttgaccggaggtctagtttctttcttcggcttaacttcaaaaaagaactgttgaccattagaaaacttagcccagaaatccatgaaataacggcgtttctttccatcagcattgctgaagtatggaattaccacgcattctgagttccaactaactacatctgggtggttatctaaccaccgcatcatgaaattgctcccaagtagatcggtatgtgatcttacgagggtcccccttatatttgcttaagttttttggtaaaaattttccgctatacgccattaggcttctccttacatttgtcaaagtgccaacacttcattccacgaggttttcctgatttgccacagtgaggacatgttactacaggttgagattctgaaacagccctaagctttgctcgagtttcttccgatctcttctttccggtgttagctaaatttaatttattttggtgctctttagttctatttttagctgcagtagacatgttttgtttcattgtatcgctttttgaaacacctgtcatagaaatactgcgcttttcatttgattctaatgtctgagactttccagtaagagctgcagacagtttagctgaccattcctttgacctttgacttcgcttctttcctgttaatatcacagaattagcaatagaaactcttttgcgaatccattcatatgatttgttatttcttcctgctaatttagaagacatgatatgaactgcgtatgataacttgtgattatctggataaatcttagctaaaagctgatgcgcaacataatgttcagctgcagtcaaatctacgaggttatcttcatcatcagtaccacccatacatcttggtacaatatgatgtcgttctttatatccttccaagctgcgagatttgcctctctcaataagctgatcataaattttacgataattcatattattctcctcagtagttgatagggtaataataccataaaccactcgtcatgtatactacaactttataaatactgttattaatatttataagaggataaactatgctcttctcattttttagtccgatagattattctgcaaagaccgtaaaaggtgctaaggcaaaagctatcccaaccgctgacatatttcgtaattatcgcaaatattttgacactgtggcagaaaactatcttttacaaacatattacataagtggagctcctagaccagaagaattagcatatattctttatggaaatagtcagctgtactggattcttttaatgtgtaataatgtatatgacccgtttagagattggattaaaacccaggatgcatgctatcaatttgcacaacaaaaatatgcagatgtaggtggagaccaaatactctatcacgtggatgcaaacggcaatcgttattataacctcgagcaatatcctgaaaattcaggcatttggtatgataaaggggactttaatcaccagtaccctcaatatactggggctttagctggtgttgacatttatgaagactctattatagaaaatgaaaaactgcgccaaataaacattatcaatcctagtgatattgaggcatttctttctgatattatacgagaaatggaaaaagcacctgacagcgaatacgaatcaggccggtacaaatcccagactacaatcggagaagttttatgattgaaatgaatgattcattaaaatggtttaccggtgttgttgaagacagacaagacccgttgaaacaaggaagagtgcgagtacgtgtttatgggcttcatccatttgaaaaggtgcaaggagctataaccggtcttcctaccgaagaccttccttggatgtcagtgattcagcctactaactcagctggaatttccggagttggctcgtctataactggaatggtggaaggaacatcggtatttggcttatggcttgatgaattcaaaacagcaggattagtaataggaacatattctgcgcacagaaaaactaagccaaactacacggaaggtttttctgaccccacaggtcaatatcctagacaggttgggtcagataccaacccactagttcaaggcgatgaaactgggtatagtgctataccaaacatcatccaagatagaaacttggatattggcattaatcctgacgatgctgacctaagcgatattcctgaagacccaaatcctgcaattacaataacagatatgcttaatagggatgaaggtcttagattgaaagtctattgggatacagaaggatatcctactgtaggtattggacaccttatcatggcacaaaaagtacgtgatatgtctgtcattaataaaactttatctaatcaggttggtcgtactgttacaggaaatcccggtatcattacaatggacgaagcagttgcactatttaagaaagatcgtgataaaatgctttctgatattaaaacgaattcacgggtaggacctgtatatgctaaagtcaacaaatcaaggcaaatggctttagaaaatatgagttttcaaatgggcgtaggtggattagcaaaatttggtaaaatgcttgatgccatgctcattggtgattggaaaaccgcttatacagaagcaagaaactctgtttggtttaatcagacaaaaggtcgtgcttctcgtgtttccatgattattctaacgggtaatatggaatcatatggagttcctgctccaaagccagaaggaaaaaacctgtctgcggcttatgtagaaccgaagtctggtggtaatcctgaagacccatggaccccagaggattcaagaattctttttaaagagcccgaatcttcatataatggtcaatatccatatgtacatacgatggaaacagaatcaggccatatccaagaatttgatgatacgcctggctatgaacgctatcgtattgttcatccaaccggttcatatgaagaggttgctcctgatggacgtcgtaccagaaaaactgtagccgatttatatgacatgactcagggcgatggaaatattttaatctctggggataagaaggttaacgttggagggaacgagacctattataacatgtataatcgtcgacagcaaattgatggcgataacacgctttatgtacgtggaaatgaaactaaaacgattgaaggtgatggtactatttttgtcaagggtaacattaagatagtcgttgaaggaaatgctgatatccaagtcaatggtgatgccactactaaagtagatggcaaccacgacgtgaccgtcggtggtaatttaacttggcaggtagcaggtactgtgaattggaatgttggtggggcttggactgaaacaatggcttctatgagctcaatcgcccaaggccaatacactgttgatggttcacgaattgatgtaggttaatcatggctgatatacttcctattaataccacgttacgcgaagtaatagaaggtgaatacgttgagcagtactttactgctcaattatctaccaacgaaacattaaaatcaataaatattatcgactatcaaccagtatctgatatctctgtgtctgaaacctattataaaggtaattataactcagtttttacttttggaaacgatgtgcttaaataccgtgaaggtgatgagctaaagtccgcttcagcgtgggaggatttacctaatcccaaaactgctgatttgtatctatggaaagcccccagaacactagagaagacatttacctatacagttgagataatatatacagtgacagaagaatcgtctggaggttcatccggaggttctagcgctccaatcataacagaacataaaaagcaaaagatttactctcaaaccgttaaaggcaactggagtagatggggcgaccaacttcgtgcttacgtatatgcggggaattaaatggctggtctttcatatgataaatgcataactgccgggcatagtgcgtatcctccgacagaagtaaatgctacacaaagtaaagtattcactggtggaatagcggtattagttgatggcgactcaattaccccacacaccaagacggttgaccctcatgatacgcatggaggagttgttcaacctcgcacatccaaggtatttgtaacaggcaaaaaagctgttcaaatggccgatccaatttcttgtggcgacactgtcgcgcaatcaagctcaaaggtattcatacactaatggctattaaagaacctttaaattatcagttaacgcgtactgcaaacgctatcccagacgcatttactggagcaacattcgatgaaattaaaaatcagcttattaactggcttagcggtcaaaaagagtttcaggactttgattttgctggttcgcgtttaaacgtgctattagacttattagcatataacacgctttacatacagcaatttagtaatactgctttatacgaaagctttatcggaacagctaacttgagaagttccgttgttcaagcagctcagcaaaacgggtatttgccaagttccaaatcagcggctactgcgtctattatgcttgaggtaactcatccaaatccagagccagcaataaaaatacctcgtggaaccaagtttttagcatatgcacgagattcatcagtagacccatacaactttgttgttactgaaaatgttattgcgctaagagatacttcagcaccagaaggggttaatagatatcttcctattgtcaatttggcgcagggacgtattattcgtactcagttgtcatatgacccgaagaaacctattgttattcgcgatcagtcaattgaccgcaagcaggttaagctgtgggtggatggcgctgaatggactaactggacagaccggtcaatggttcatgcttcgtctatttcaacgatttattatatgcgtgaaactgtcgatggaaataccgaattcttctttggtgaaggcgtggcagaagcctctgtagcaggaggagttcttgaaagtaatttcattggtggattaaaacctactaagggtgcgcaagtcgttattgaatatattcgtactgatggtgaagctgcgaatggtgcgactgatttcagctatgctgataccctgcaatatatcgtagtaaacaaaatcattgaaaactggtcagattctcctgattatgttggtgctgatggtggtggggaacctgaagacatcgagcgtattcgtgagctcgcccagattaagcgcgaatctcaaatgcgttgcgtgtctaaaactgactatgaatcattcgttagttcacgctttggttctatcgtacaagcagtgcaatgctttactgatcaggacaaacccggatatgcatttatcgcaattaaaccaaaatctgggttgcagttaactgcggttcaacgagaagacattcaggattatctaaaacctttctgtcttgctccgattactccttcggtaatgagtccagactacttgttcatccgtcacaatattaaagcttcttatgcattgaataagttgcaagaatcagagcagtggttacagtcaaaaattatagactcgattaatagatattatgttgatgaagttgaaatgttcaacaaaaatttcagtaaatctaagttgttgacttacattgatgacactgaccactcaatcatcggttcttctgtggatattcagatggttcgtgaaattgtcaactatttcactcttcctagcgcaggtattaaatactataatactattactccgcggacgttacgttctggtgatttggtctttactgttaccccaactgctgaaccgtattcagttaatatcgttggaactgacccagataaaaatggcaaaggaaatatggttattggaccatttaaaccaggtgacattaaagagaatactcatatccagccatatactgaaaacgattttgatagaactaccgtcggcgaaagaactcgttggtacaaaatcggtgaagtagattattatggtgataatatttactggagccttggagctattggagccgatcctcttcagtttgaagaccagagtattgagctttattctactcctacccaggatatcgtcttcgcccgcgatggaacacttatcgtatttgagaatgaccttcgtcctcaatacacaactattaaattggagcctattacagcttaatgaagtataatgaaatttatgatagtttaattaaaagaggcctcgaaagaggccttaataaaaagaagcttgattatcatacagaaaaacatcacattattcctaagtgtatgggaggagttaataataattctaactatgtattgctaactcccagagaacattttgtagctcatcaattgttagtaaaaatatataaagatactaagtatttctataagttagttagagctctcaacgcgatgtcaatgtttaatgataaatattctagacccaacgctaaagaatatgaatgggtacgaactttatgttataacgcgaataaattgactaatgtgggaagaaagcataaacctgaaactctacgtctgttctcggagcaacgtagaggtgctaataacccaatgtatggaagaaagggtgaattgtctccatcatttggtaaaaagaggagtaaagaatctaatgataagatatggttaaatcgaagcagaaatattagtcagaaagcaaaatataatatttcaaaggggaaacgaacatctcctatatggaaagaacctatgtataatgaattgtttaatttatacataagtaatccggtaggaggatgcgcgtttagaactaaagccgtgtctttaggatatcctaatacttcataccacagactagtacaagaatttaaggaaattactcaatgacaattgcaccgttcgtcaccagcttacgaattcataagctatctgcgaatcaggtcaatattcgttgggatgacgttggtgcaaacttctactattttgtagaactggccgaaactcgaaacagagcgggggaagttatccccgctgataacttgagttggtcttcactgggttataccgcggataatgattggttcgaacaaaatcgtattgaaccgcttacttattataaaatgcgtgttcaaactacgtcagcagggtttgagccgtctgaatgggttgaaacagaagagttccaaacttttgaagaaaacgcatacacatttgagcatatgcaagaattcagtttagtgaaagaattcattaaacagaagttttctttaaacaacatgtcgtatgttaacttcaacacatctgccatgatggcatctttgatgactgagtcttttcagtttagtcctgaatattctcatttatcagctattgaaaacttcgttgtaggtgaatctggatatcatgaaattcagggacctattgaagcagtgtgtgttgataaaaatagaactatgctgggagaaatagacggaattttgtatctgtttgaaagattccaacatatggttaaagtatcaaacgataaaggacagaactggcaatacgttcagttatttaatgaccgtgtaggaaatcctgtttcacgagtagtaatttatcaatcaagtaccacatcatatgttttaggctatgataaaatcttttacggaagaaaatcatctgacgtacgctggtcatcaaatgaggttaaatttagcgataacgaagtcacgttcgctaaattgggagaccagttaaaactgggatttgaagtagagttatttggtacatatgcatcactacctgctgatgttaccaaatatgcagaagcctttacatgcaatgatgaccacttatatgtagttgcaaaggatacagtacgcagagttaaattaaaagatgctccaatagacactgaccctttaagccctacatttggtgaaaaagtgtttgaaaaggaagtatctcatataacaggcaatcctaaatctgtatgctttaaaatggattccgttggaggcaaaatctttgcccttattaccggggaagttaaaaccttaggattagacccaacagacccaaggaacgttgtggattctgcaactaaaggcgtctatgtttaccaggaaggcacaaatacttggaagcgtgtatttggtaataccgatgaagaaaaacgtcgtatagagcatttatggacttctatgtcaactgacggaaaggaaatattcttttcatcagctaattttaagacaacagagtacgctcaggatattgagcttgagacgaaatatccagaactaatttctactgcagttaaaaatgttaatccaattcagtatcactctgataagcattatcacatgatgagtttcagagcagatgaattttcaggatgggaaacatttgttcctggacctatgaggttttatgctgaaccttggtttgtctggatggctcgtgaaggcaacagatgctggataagtacagctgaccatgcagttgtcatttataatgatattctttatcaaaaaagagtagatgcagcggcgcagggaactaccgagcgtattctatcggaagtgtgggataaaggtgacgcaacgttttattgccctccagtttcatttaatggatttttgcagtatgcttctggcatcatgtttcacgaaccagacggaaaactgataggctattacgcatttgactaccgtgttcgtgaccaggtaacgcttaactggaaaccaactgatgtaatgtttaaggcgtttctgcagaaccaaacacgggaagaagactggacacctgaacatactccaggcttacgtgacccagatttgcgtccgtatcttactaaaatgatgccggatagttacttgctacaagatagtaattttgagcacttttgtaagtactatctccaattcctttcagatggaaatggaacacattacaacagtctcgttaatcttgttaagaacaaatatcctcgcgaagaaaatgcatgggaatatctgtggtcagaagtttataaacgcaacatttatctgagtaaagacgctcgtgacgctgtcgtccgtttctttgaagcacgcaagaatgatttctatgctactaaaggaattgaagactcatataagttcctgtttaaacttctttataacgaagacgtcgaaatcgatattgagtcaaagaacactaccgaatatgacattattgttgaaagtacaaatatttctgacgatttagttggtcgtacgatttatactgcttccggtcgtagtaatgtgacttatatcgagagagaataccgggatggtcgtctgttatggcgtattactattcataacttatcaggacggttcattgaaggccaggaaattaaatcagagcgtacggactttgagggtattatagttcaaggtgtccgtggaaaggatatgctgagtaataacattgattatataaaccgcagccgttcttactatgttatgaaaattaagtctcagcttcctacttctcgtttccgcgacgatgtattaaggtttgttcatccggtaggtttcggtttcattggtataacattgctgacaatgtttatcaatagtggcttaaatatgaagcatgttgagactatcataaataaactcaagaactataaatgggatgcaggactgccatcagtttatcctgatagagttgctattatcgcctcagatgatacaatagaaagggatccaataactaatgagcctagatattcttctcgtgctcaagctggcgaacctttcccattacctgctaactataatcaagaaaataataatagtgttatcgctggacaaaacccaggacaaagacgtaaacctctgagtcctacatttgaccaatcagcagtaacgtttgccaattatcgtgatttagttaaccaacgtcttaaagacgatgcaggtaatcctcgcgatcctgaaaatccgacacaggtaaaaattgatgagtaattcaacaagagcaagttcaacgcgtagcacgatttatcgtgctatcattacatctaagtttagaactgaaaagatgtacacattttataaatcgattggtccgggaacggaccaaaacacactgtatgtttcatttggcaaaagcactccgtggtcagataacgaatctgaacccggatttgcacctccatatcccgctgataatggagatggggtagttgatgtttggacaaatatgatgggcgcggtcaaaattgaatcatcaatgcttgattgcgttgttccaagaagagactggggtgatactagatatcctaacccgcgtacatttttgattggtgatattgttgttgctaactctgcgccatataacagaactgacgctggatttggatggatggtatatagatgtattgatgttccaaaagacggaatgtgttcaattggaaatcttacaagcaaagatgaatgtattaagcttggaggtaaatggacaccatcagctatttcaggttcagctcctcgtggtcgtggtgatgcaaatggtactgtcgatttaggtgatggatatctttgggaatatctatatgaaatcccagctgatgtatcaatcaacagatgcacaaatgaatatattgtagttccttggccagaagagattcaagaatctccggctcgttggggatttcaaaacaacttaacatggcagcaaaatgactttaatttaatttatcgcatgaagtgcaatacgattagatttaaagcatatcttgacgcaatttatttcccagaatttagtcttccaggaaatactgggtttagacagctgtcaattataactaatccgcttgaagttaagccaatgccaaattcacctaatgttaaggctgaaaaaggctggtatagtgcttctggtcttgaaagacagtcaggtgaaatgatttacatggaaaatcggcaacctattatacgttcaatggaccaaacagaagagttaaatttaattttcgagttttaattatggggagcctttggctccccatttttatataaataagactatactttgatatgaggttaacctatgtatacagataagggtaaaaaaataattgacgtcggtgagattggtaatgcttctaccggcgacattctgtatgatggcggtgtgaaaattaatgataacttcgacgccatttacaacgccttcgccgaccaacgattatttgcagctggcggcggagcattgaaccaaaaaattcatgcaacaagctattaccaaaagataaaatttggagatgctaactctgcagggacagttccaatggggtcatgcatagatgctgattgttcagaaggcgcagttcaaatacgtctttcaaaaggtaaagcgggagaagctgtattcgttgtaaatagtaatggctcagcatcaaaagctagatccataaaaataacaacaaacggcgaaggcgtagcagatgcatttaaagacggatcgcgagagttgattatcaacacgccaagatgcagaattgagctatggtgtgttgaggtaaaagctaacggtgctgctgtttgggattattcaatttcaagtatgtttggcagcacatattcgccattagaagctacatataatttaacaagttctcctattaatatccgcattggatataatgatgattactccaccgttaaattgttattaagcttcagtgcaaatccgggtggtcaaaccatcaaaaggcaatcatctgaagtcatgcttatgattgacccgactattacttcatcagcgccaaacggaagagtatttgacactgaatatgcagtgttaagaagtggtgaatcatctgaaaatgaaaagatgtattctatttcatactctattaacgcgcagaaagatttaatatgcacagcttcaacatcttatggaaacgcacgtttggcagttaaagttattgctacacagaccgtaggggtatctcaataatgaaacaaaatttgatagtaggccaatcagtagatgatgggtctggtgattacctccgtaaaggtggtcttaaaattaataacaactttgatgatttatattcagagttaggtgatggttcagttccattcgcagcaggtgcatggaaaacttttaaagctagccctactggaactactttaaatgctaagtttggtcaggcctttgctattaatacccaggcagcaagagttaacgttcagcttccaaagggtacagccaacgactataacaaagttattaaacttcgtgatgtttggtcaacctggcgattaagcccaatcacagttattcctgctcaaggcgatacattaaaaggttcagcttctcctaaaattttcaatactaacttccaagatttggaattagtttattgcgcccctggccgctgggaatatattgaaaataaaacggtagataagctaactaacggtaacttaagtactgtagcgaaaaaatcaattattgctactgcgggtcagactgactttcttaacatttttgatggcgtagaatataacgaagactcgcttaatgtatatcgtcgtggtaatattttatattacggtgaaaccagtgttatggataaagccaatgctgattacggttctcctggaacagtagcaggtcaattggtagaattaaacggtaaagacattcgtttaaaagttccatgcgttgaaggggaagtaataacatttgaaaccttcctagatggaattggtgtttatcggtcttcatacaacaagttggctatccagatacgagattcagcccagactacatcccagacgattcctgggtcaatgatagtagataaccttgctactctccgcagaatcactctggatgacatgggtgtacttccaggcgtaggggtaaatcctaactcgcttgaaatttcattgaacggaaaggaattactcgaagctggaactgctggtcttcctttattttattgtgaaggcgcagaaggtggatacgcagaagactgtataaacaatggtggtcaatgggtaaattctaaccaagattatagactggaatttgactcaactggtactaacgtcgaagctattatttttggtgaggcgtttgaagataaagaccttcttaccgtccgttggttcaataataacatcggtactactatggatatcaatgatatcatggcagaaaccgaccaagtgtatatgaatgctgagcaattagtaactctaaaaaatcgcattgaatacacaaattatgatgaacctaatcagaaaaatatgcgtccggttgctgacgatattatgattaaagtcaataatattgcagcattttttgacgtaatttatccgattggcacgatttatgaaaacgctcacaaccacgcaaaccctgctgactatatgggatttggggtgtggaagctttattcacaaggccgtgttactgctggttggaataatgattcatctgatccttatttttcgcgtaacaacaataacttaaacgaaaatggtcagccatcattaacagcaggtggaacggttggagatttgacatttacgttaggaaaagaacacattcctgaactaatgtcaagagataaagttctaatttcagaccctgaacatggaagcgtagttatcggtggatgtcaattagacccagacgcgcagggaccaggttattctaaataccgtgaagacactgttgcggtaaacaacggtgtagttccaaatgacatcactaaaattcagccaacaatcaccgtttatcgttggattagggtaggttaaaatgacgattgaaactaaaactcgtgaaggagctaaagttaattcaagattagctgctttttcagaatatcgcgttgacccgcaaaatattgcggtaggaaatacggctcctatagggagcctaacctttgaacaaatggatttaggggtttggtatccaaatactgaagctgctattaatgatttgatgtcattgcagtcagcagaaattggaactattatttgcaatgacactggaatatctccacagcccgcacagcaaattacgcgtgctactttttcaggtgtcgttgcgttagagccaaaagaagacggctctgtcggtgacccagtaataattcatattcttggcttaccaattagaattgcaaacggtgatgactttgcagcagtagcaacacgttggtatgataaagtaaaagaattagaagctgttggaaaggttgttcaacaggttactcaatcgccggcaacaccccagtatgttgatattattcatttagattatcagaaccataattttgaaacatataaaaagtatggtttaactgttgaatttactattacttcaccagctaaagcaggttatgggcaatgggatgctatcggcaacgaatctaaaacattcggcgcgaacacatttactttccactattttagaaggatgggataatggcccagaataactataatcactacagtgatttggccaaatatacgatatttgacccaacaaatacacaatggcctgttgctataaaagacgtccaatcagcgttagagctgattggtagctgggcaagaactgataccggattacctgtagcatctcctacagtagccggtgtaattcgcacagcaacacaggctgaagttgatgctggaactattggtaatgctgcggtaactcctgctacattaaaatccacagttacccgtcctgaagcaactacagcagttcttggcttaacacgatatgctactaatactgaagccgcagcattaaccgcaggaaatagaactattaccgcggcggctctcggtcatgtgtttaaaaccgtaaaagcccaagaaaacgtagatggaactgttaggttaactactgcggctcaagcgcaagcaggaactgacgaaactaccgcagtaactcctaagcgtgttgtagaaatgattggaaagttcagcgttagtcctcctagttatacctctgcgacagaaagcaacttgggattagttcgtgtcgcaacccaagcccaggtagcagcaggcgctgttcacgatggatacgcagtaactccaaaaaccttcatggaatcaaaagcgtctgacagtgtatttggtatagtaaaatttgctaaagactcagatgtggcttcagctacttctaacaatttggctgttactccaaaaagtcttcaagcgctaaaatccaccaaggataaatatggattaaccagattatcaggttctccaactactgatgcttcattggcagcggctgcaacagatgcagtctttaaaacccgtagaataaacggaaaaactcttgacaatgacataacgattactaacaatgatattaattgttatacaagacaagaatctgacgggcgttacatgccagctggaaccagagtaggtaatgttacttgggttgaaggtcaatcttggattagtcgaggtgcaacgtttacatgtaatgcaccatgggaagcttctagtagattagctctaaatgttaatgtaaaatttgagcgtaacaacgacggatatgacaatcgtattttcagatttgttgtaatagttaacggttcccaatggggcggtgaacttactcttaacatcgaaaatactaaaggcggacgaaatggtcattcatggagatttgaagcttacgcatctagcaactttttcttcaataacattcctccaaatgccactgttcaaataagaccaacagaagacagtcgtattatattttatgactgcatgcttacattctgtacaaatagaccgtaaggaacaatatgaccaaactagtagattcgcttccgttcgtagacggaattccagacgattttcaacagagaattaactggataaaaaatacagagcctcttaatggggcttcaacccgctatggaaatgatggagaactgaatagagcttctgttcaaatccagaaaaacgttgttcaggtacataacgatttgaacaacgttggaactgctgtagaaaatattcaagtagatgtagaccaaatcaaaaaatcgttagaaattacaggttcttctgacgccattgagcaggtttatatcaataaaaagaatattgaaaagcatgatggacaaattcttaaattagaagaagacaccgaaaaacttcgaactgaccttgattttctcgaagaggatgtaggtgtttatgattctagtaaagatgactattacagaacagttcgtgataatatagtttgggttaaacgtgaaattggtgcgtatcctgggcaagatattaacggacagccgaagcaagactctccgggttctggtatgaaataccgaatcatcaataatgcgtcagctatagtaaaacatgacgagcgtattcaggcgctagaggatgcatacaatgattcagacgtaggttctctgactattgaagtaaacgacctgcgtaaagaagttggtcctaaatccggagctacgtcagcttcaatttatgcaaggcttgtgaataacgctgatgctatttccgcagctaataatgaaatctttgctattaaccaagccattgattttaccaatccagtaaaaattggagctcgtactactagattagaaaacgattatcgtatagttgacgcaacacttaactctgcacaaaccgggttagttcctcgtgtcaataatattgatgctcgtttagggtcttctgataagcctgatactattgaaggaaaaattagttctctttcaactgaccaagggtacatttctgatgttgtaggacgtgatacttcatcagggcttcagggtcaagtagcatggataaaccaacaggttggtattgttcctagcgagcagccgattcctcctgggtcaattttagcgagaatgaccaatgttgaaggtatgcaaaactctcaacagtctgctattcaggacattcaagtagaacttggcaataacaatgaagggttaaagggttctgtatttacattacagactcaaatgaatggtgacttttcgtcagaaaacccagttcaacgtgatggtgtatacgctactgtagtagaattgcaagataaattcgtgactgcagttactgacgtagaacaagctggagcatacctccgtaaacagggcgaatggtttaaaaaaccttcatcaataggtgaattcagtaaagaagatttcactgttgatttaagttctgatgcattggtaaatcctaactcattggtcgctgctccattcaatgctggcattcgtattgtcgatgacattgttgttgatgacgatggcgtattttgcgtagaaactgatacggttatcgaagcttctgattcagataaaggcgtgaaaattgttattctcgttaataacattgaggtgttttcctacggacttggtgttaaagcagtaacgggcgagcagttgattaaaaccaagaaactcattgagttttcatctggtgatgcaatcaaaatcgtgtatagagctgcttcagaagaatcgcaggttcttgttaaaattaaatctttggatattactattcatccagctgtataacaaaaggggaccttcgggtccctttttcgtataaataggaatataaagaggagttcatatgtcatacaacacgtacaacccaaaaacgcttaaagacgctatacttcgacgtctaggagcgccggtaattaatgtagaagtaactgaagaccaaatttatgattgtattcaacgagcattagagttgtatggtgaataccactttaacggattgaataaaggttatcaggttttttatattggaaaagacgaagctgacaacgcaagatttttaaacggcgtgtttgatttgcgcggtcgtaatgtatttgctgtcacccaaattgttagaacaaatgtaggttcattaacttcaatggatggtaatgcgacatatccatggtttactgactttctaatgggaatggcaggaattaatggcggaatggggtcaagctgtaataaaagctatgggccaaacgctttcggtgctgaccttggctattttacacaattgatgacttactggtcaatgatgcaagatttacttgctcctctcccagattattggtataactctgataatgaaatgcttaaagtaatgggcaacttcatgaagggtgacatcattgtctgtgaatgctggaccaaatcatttatgaatacagatgtgatggtaggcaatacagcaggatatggattcgccggagcccaaactgctgaccactggggtttaggagatagataccagaatcctgaccttcgcaataacggccaatatgctggtgaaggcaatacaaatagagaaggtgcatataataatcgttgggtaaaagattatgctacagcattaactaaaaagctgtggggtgaaattctttttaaacatcagggtctgcaattggcaggtggagttacagttgatggtcaaacacttaaggtagaggcccaagaagaaatcgagaggctccgagaggaacttgatttacttgacccgggttgtcctattctgttggggtaaaagatgtctacatttgattctaggctcttcgctaaactcgaagattatcgaggatataataaaactaatgagactgaaattctcaatccttatgtgaatttttacaatcataaaaatagccaaacgttagcagatgctttatcggctgaggctattcaaatgagaggaattgagttttatttccttcctcgtgaatataacaatcctgatttgctttttggagaagacccatcaagtaaattcaccaaagcttggaaatttgctgcttatttagattcatttgaaggatattctggcgataacacattctttagtaaatttggtatgatggttaatgatgaagtcaatctgactattaatcctaatttattcaagcatcaaactaataattctgaaccaaaagccggtgatctaatttattttcctatggataactcattattcgaaattaactgggttcagccatacgatccattttatcagttaggtcaaaatgttcaacgcaagattactgcacaaaaatacatttattctggtgagcagcttcagccagaattgcaacgtaatgaaggcattaatattcctgaattttctgagcttgatttagaaccaatcaaaaatatagatgctcttgctgatatttctgatgtgcaatacgcagaaagtgacgcaatcaataaagaagccgctgaatatgttcatccgtattatgttaataacggaagaggacttgaatctcctcctaaagcagattcatttgatgacggatttttcgaataaataaaataaagatgggacctttgggtcccttaggagaaatcatgtttggacattggtataattcgtccttacgccgatacattgtattgcttggagatttattttctcatgtacaaattgctcgttggcgtgaagacactggactaaaatatattaaagtacctatcacttatgcttcaaaggaaaagttcctttctcagcttggaaaatggactgctattcagtctaccgagaataaagcaaaaatagaaactgttttgccaagaatgaatttgcacttggttgatatgcaatacaacgcgatgtataaaacatcacagctgaatagaacaaaatcatataaaactccttcaaaaattacatctcaatataatcctactcctattaagatgatttttgaattaggaatttatacacgcaatcaagatgatatgtatcaaatcatcgagcaaatcgttccttattttcagcctcacttcaatacgaccataactgagctttacgacaaagacacaagttttaatcgtgatgttagaattgtattacagtcattttctccggatgaagctgttgatggagacaatatcactcgtcgtagattagaatggtcattaatgtttgaagtcaatggttggctgtatccgcctgtagctgaaattgatggcgaaattagaaccatttatttagatttcttcgctaacagcaaagagttaactccagaaggaaactttgaatcagtagatagcgaagttactccacgagatgttcagcatgaagattggaatggttctagtaaacaaacgtattctcatgatattcctattccggtaaatccggaggctcctggaccgagaggtgaaaaatgagtgaattacaattagatatggctaaattattagacatcgaaggaattcctggaatagaaggacaagaaattccggtttatgaaaaactcgaattagttgaggttaaatctaacccaaatgaccgtaagcctgacctcgaagatgactattcggtcgttcgtaagaacatgcactttcaacagcaaatgttaatggacgcagctaaaatatttttggaaactgctaagaatgctgactctcctagacatatggaagtatttgcaactcttatgggtcagatgactacaaccaacaaagaaattcttaagcttcataaagaaatgaaagacattacttctgagcaggttggcaccggaaagggagctaatcctcagcaaggaatgaatattcaaaatgcaacagtctttgtagggtctaccgctgatatgatggatgaattcggtgatgcctatgaagcacaagaagctcgagagaaaatagtaaatggaacagactcaaccgtttaacgttctgagcgatgcccatcctttaaatgacgggaaactgacggttattcgtcacccgtctgaaatggaaacgaaaattgaaaacggagttcgtttctttaaatcgcaatgggatgataagtggtatcctgagaagtttgaagactatcttaagttgcatgggatagttaaaattcgtttgcaaggtgaagacccagctcatttccaaacgtttaaggacaaaaacaataagcgcacccgctatatgggattaccaaaccttaaacgagcaaatattaaaatgcagttgacgcgtgaaatagttgcagaatggaagaaatgccgagatgatattgtgtacttcgcagagacctactgtgcaattactcacattgactatggtaccattaaagtccagcttcgtgattaccagagggacatgctggaaatcatggcagccaaacgtatgacttgttgtaacctcagtcgtcagctcggtaaaactactgtagtagcaatctttcttgcgcacttcgtgtgttttaataaggataaagcagtaggtattcttgcgcataaaggctcaatgtctgcggaagttctcgaccgtactaagcaagcaattgaattacttcctgactttcttcagcctggtattgttgaatggaacaaaggctcaatcgaattagataatggctcatctattggggcatacgcttcgagtcctgatgccgttcgtggtaactcatttgcaatgatttacattgacgaatgtgcgtttattccaaacttcatcgatgcatggcttgctatccaacctgttatttcatcaggtcgtcgttctaaaattattatcacgactacaccaagtggattaaaccacttctatgatatttggactgcagctgttgaaggtaaatccggctttacgccttatactgcaatttggaactcggttaaagaacgtctatataacgacgaagatatgtttgatgatgggtggcaatggtcacttcaaactatcagtgcttcttctcttgaacagtttaaacaagagcactgtgcggaatttcatggcacatccggtactctcatttccggtatgaaacttgccaatatggattggattgaagttactcctgactcgcacgggttttataaatttaaagaagcggaagcagaccacaaatatattgcaactcttgactctgctgaaggacgcggtcaggattaccatgcactaaatattattgacgtgactacatctgaatgggaacaagttggagtattacattctaatacaatttctcacttaatcctcccggatatagttattaaatatctaatggagtacaacgaagctccgatctatatagaacttaactctacaggtgtttctgtagcgaagagtctttatatggatttagaatatgagaatgtcatttgcgattcaatagttgatttaggaatgaaacagacgaaaaggtcaaaagccgtcggatgttctgcactaaaagaccttatcgaaaaggataaactcattattcaccatcgtgctactgttcaagaatttcgtactttctctgagaaaggagtatcctgggcggcagaagatggatatcatgacgatttaattatgtcactcgtaattttcgcatggttaacaacacagcaaaaatttgctgatttcgtggataaagatgaaatgcgtttagcatctgaagtttttaaacgcgaattagaagatatgaacgacgattacgctcctgtagtgttcgttgacgccgtgaatagcgcagaatatgcgcctcaagaacatggtctttcatttgtataaataataaaaagcaaacaacattgaggatatatcatgcctttagtctctcctggaattgagctcaaagaaacgagcgtacagagcacggtagtacttaacgctacaggtcgtgccgcaattgtcgggaagttccaatggggtcctgcatatcaagttactcaaatcactaatgaagttgaactggttgatatgtttggcggccctaataaccaaactgctgattactttatgtcagcaatgaactttctgcaatatggtaatgatctacgcaccgtccgtgtagttaaccgtgaagctgctaaaaacgcatctccgctggttgataatattgaatggactatcactactgctggtagtaactatgaagttggtgataagattacggttaaatatgcagaccaaactgtagatgacaccggttcagttactgaagtagatagtgacggaaaaattaagtcggtgttcattccgacatcgaagattattgcatatgcaaaaagcattaatcagtacccagatttagggtcttcgtggacaactaccattacttcacagagttctggtgtttccgctgtcattactttaggtaaaattatttctgagtctacagttttactgactgagcatgaaactgcccatgaagaaatgacaaaaaccgaattccagactgcgcttgcgcaatataaaatgcctggaattgtagctgcgtatccgggcgagctcggaaaccaactggaaattgaaatcgtatcaaaagctgcatttgataaaggtgaacagctgacgatttatccggctggtggaaaacgcgcttcgactgcaaaagctgtatttggatatggtcctcagaccgatactcagtacgctatcattgttcgtagagatggcgcggtagttgaatcaactgtgttatcaacaagtcgtcaagataaagacatctacggaaataacatctttatggacgattatttctccaaaggttcttcacgttatatatttgctaccgcgcaaggatggcctgaaggattttccggtgttattcgtctgggtggtggggtttcagctaatgaatcagttactgctggcgatttaattcaaggttgggatttatttggtgaccgtgaagcactgcgggtaaaccttctgattgctggtgcttgtgctggtgaaacggatgaaatcgcaagtacagtgcaaaaacatgtgtcgtctattgcagatgaacgtcaagattgtttagcactcatttcaccaccaaggtcaacgattgtaaatattcctctgacccgtgctgttgataatttaattgattggcgtcaaggtgaaggaagctacgactctgcaaacatgaacatcaatactacgtacgcagcaattgatggtaactataaatatcagtatgataaatataacgacgtaaaccgttgggttccgttagctgctgatattgcaggcctgtgtgctcgtacagatgatgttgctcaaccttggatgtcaccggctggttatcgtcgtggtcagattctgaactgcattaaacttgcgattgaacctcgtcaagcacatcgtgaccgtatgtatcaagcaggtattaacccggtaacgggtcaaggtaccggtgatggtttcattctgtttggtgataagactgcaactactgttccaacgccgtttgaccgaattaacgttcgtcgtctgtttaacatgctgaagaacaatatcggtgattcttctaagtggcagctgttcgagttaaacgataactttacccgttcttctttccgtatggaaacaagccaatacttggcgggtattaaagctctgggtggtgtatatgacttccgagttgtatgtgataccacgaacaacacccctgctgttatcgatcgcaacgagtttgtagcgagcttctatatcaaaccggcgcgcagtataaattatattacgcttaacttcgttgctacggcaactggtgcagatttcgatgagttgatcggaccacagtaatatgaaccccaggacattctggggtcatctaacctttagatgataaattatattaccgcacactttaatagcctctatgatgatgtagtcaatcgagaggctatataaatatctataggaaacaacgatggaattaacagacatcacccgtgcgtttgaatctggtgactttgcacgtcctaacctgtttgaggtagaaattccttacctgggtcgtaacttcagtttcaaatgtaaagcagcaccgatgccggcaggtatcgtagaaaaagttccagttgggtacatgaaccgtaagattaacgtcgctggtgaccgtacttatgacgactggactgttaccatctataacgatgataaacacgaagtacgtaaggcaattattgcttggcaggctcaggcccacgctcaaggcaatgatatctctggtatgactccagccgattacaaaaaggttgctacggtacgccagtttagtcgtgatggcaaaactatcacaaatgaacacaccattactggtctgtggccaactaacgttggtgaagtacagatggactgggattcgaataacgaggtagaaacgtttgaaactacctttgccatcgactggtgggaataatgctatggggcttcggccccgtatcgaagttctgtgagttatttgcttaaatatctgacaaaacttcgatataaatatacttatagataatttcggagactccaatggcctttcatattttggacttattcgctccgtgggaaaaacgcgacgaagctgaatataagcaacaaatcaacaatgacctagagtcaatcactgctccaaaatttgatgatggagctcgtgaagttgaatcaaacgaaaacgaaatccagtacaattcattcaaccaaatgatgtttggttccaatgaacctggaatgaaaacaactgctgatttaatcaacacttatcgtagtttaatgaataactacgaagttgacaatgctgttgaagaaatagtttctgacgcagttgtatacgaagacggtcatccagtagtttctcttgatttagattctaccgacttcagtcaagcaattaaagaccgcattcttgaagaatttaatacagttttaacatgccttaatttcgagcgaaaaggagccgaccatttccgccgttggtatgttgactcaagaatattcttccataaaatcgtcaacacaaagaaaatgaaagacggaattcaggaactgagacgtcttgacccgcgcaacttacaattcatccgtgaaatcgttaccgctgatgacgctggtactaaaatcgttaaggggtacaaagagtatttcatttacgatactggcaaagaaagctattatgcagatggcagattatattccgccggaacgaaaattaaaattccacgcgatgctatcgtatatgcacattctggactagttgattgttcaggtcaaaacatcattggttatttacaccgagccgttaaacctgccaaccagttaaagctattagaagatgcgttggtaatttatcgtattactcgtgctcctgaccgtcgtgtgttttacatcgacactggtaatatgccttctcgtaaagcggcagcacacatgcagcatattatgaacacgatgaaaaaccgtgttgtatatgatgcgtcaactggtaagattaaaaaccaacagcataatatgtcaatgacagaagactattggttgcagcgtagagatggtaaagcagttactgaagtagatactcttcctggtatgtccggtatgagtgatatggatgacgtccgttactttagaacagcgttatacatggcattgcgagttcctctttcgcgcatgccggatgcaaataatcaaggcggtgtgcagtttgatgctggtacagcaatcactcgtgacgaacttgattttgccaaatttattcgtagattacagcataaatttgaagagattatgcttgatccacttcgcactaatctaattcttaaaaaagttttgtctaaagatgagtgggaagacgaaataaataatattaagattgtgttccataaagactcatatttcaccgagttgaaagatgctgaagttatggagcgtagaatcaatatgctcacaatggctgagccgtttatcggtaagtatatttctcacaagacagcaatgaaagatttccttcagatgtctgatgaagaaattgaacaagaagccaagcaaattgaattagagtctaaagaggctcgcttccaagaccaagaaaatgaagaggatttctaatggaaaattatatttccgcaattgaatccagagacctcgtagcagccaaaaaagcttttggtgcaattatggctgaacggacatctggtttaattgaagagcgcaaaaaatttatcgcagcgtctgtcatgattgagggtgaagagcccgttgacgatgaagatgaagacgacgaagatgaagataagtctgagaaagacgacgacgaagaggacgagtaatgcttatactgcctgaaaatcatgaattagttatcgacgctgtcgaagcttttcttcctgaagcacaggcacgttttgataagttgtccgcagcgctttctaaagatgatataaataaaattgtagagaacatggttacttctgagcctgatttagcaattgctttaggttcaattaacgaatctctacaattaaatgaatttatcgttaagcacgttgattctaaaggtactattacccgtaccaaagatcgtaaaacacgtgagcgtaacgcgtttcaaacaaccggactttctaaagctaaacgccgtcaaatcgcgcgtaaagcagtaaaatcaaaacgtgctaatccatcggctcaaactcgtggattacgtaaacgtaagaaagcacttaaacgccgtcaggctctggggctaagttaatggaaaacctcaatgaacaacttttaattgagcattggggtcaaccgggcgatgtaattgatggtaaacccatgctggaatctattatcgttgaaggcgaaaatgaatctggcttaaaacctggtctgtatatcgaaggtgtttttatgcaggcagaagtagtaaaccgtaataaacgtctttatccaaaacgcattcttgagactgcggtaagccgttatattaaggaacaggttgctactcgtcaggctctaggagaattaaaccatccacctcgtgcaaatgttgacccgatgcaagccgcaatcattatcgaagatatgtggtggaaaggcaacgatgtttatgggcgtgcaagaatcatcgaaggagaccacggtccaggtgataaattagccgctaacatccgtgctggttggattcctggtgtatcaagccgtgggctcggttctttaaaagactcaggaaaaggatataacatcgtacaagaaggctttcgtctgactgttggtgtagacgcagtttggggtcctagtgctccggatgcatgggtacaaccgaaacaaatttcggaaaatacctcggcacaagttgccaatagtgctgatgatgcttttatggctctcgcagagaagttaaaagcgttataaagtacgaggaggtaaatatatatgtctggtggtgacggtcgtggtcacaactctggtgctcacaacaccggtggtaacatcaacggtggtccgaccggtctgggtggtaacggtggtgcttctgacggttctggttggtcttctgaaaacaacccgtggggtggtggttctggttctggtgttcactggggtggtggttcaggtcacggtaacggtggtggtaactctaactctggtggtggttctaactcttctgttgctgctccgatggctttcggtttcccggctctggctgctccgggtgctggtaccctgggtatctctgtttctggtgaagctctgtctgctgctatcgctgacatcttcgctgctctgaaaggtccgttcaaattctctgcttggggtatcgctctgtacggtatcctgccgtctgaaatcgctaaagacgacccgaacatgatgtctaaaatcgttacctctctgccggctgaaaccgttaccaacgttcaggtttctaccctgccgctggaccaggctaccgtttctgttaccaaacgtgttaccgacgttgttaaagacacccgtcagcacatcgctgttgttgctggtgttccgatgtctgttccggttgttaacgctaaaccgacccgtaccccgggtgttttccacgcttctttcccgggtgttccgtctctgaccgtttctaccgttaaaggtctgccggtttctaccaccctgccgcgtggtatcaccgaagacaaaggtcgtaccgctgttccggctggtttcaccttcggtggtggttctcacgaagctgttatccgtttcccgaaagaatctggtcagaaaccggtttacgtttctgttaccgacgttctgaccccggctcaggttaaacagcgtcaggacgaagaaaaacgtctgcagcaggaatggaacgacgctcacccggttgaagttgctgaacgtaactacgaacaggctcgtgctgaactgaaccaggctaacaaagacgttgctcgtaaccaggaacgtcaggctaaagctgttcaggtttacaactctcgtaaatctgaactggacgctgctaacaaaaccctggctgacgctaaagctgaaatcaaacagttcgaacgtttcgctcgtgaaccgatggctgctggtcaccgtatgtggcagatggctggtctgaaagctcagcgtgctcagaccgacgttaacaacaaaaaagctgctttcgacgctgctgctaaagaaaaatctgacgctgacgttgctctgtcttctgctctggaacgtcgtaaacagaaagaaaacaaagaaaaagacgctaaagctaaactggacaaagaatctaaacgtaacaaaccgggtaaagctaccggtaaaggtaaaccggttaacaacaaatggctgaacaacgctggtaaagacctgggttctccggttccggaccgtatcgctaacaaactgcgtgacaaagaattcaaatctttcgacgacttccgtaaaaaattctgggaagaagtttctaaagacccggaactgtctaaacagttctctcgtaacaacaacgaccgtatgaaagttggtaaagctccgaaaacccgtacccaggacgtttctggtaaacgtacctctttcgaactgcaccacgaaaaaccgatctctcagaacggtggtgtttacgacatggacaacatctctgttgttaccccgaaacgtcacatcgacatccaccgtggtaaatgaataattatgtaacttaacacaggacatcaaaaatgcttaaagaacttttaatgaccgaagctaaaactatcgatgcttccgtcgctcttgacagtattttcgaatcagttcagctttctccggaagctaaagctaacttcagcactgtattcgaagcaacagtcaaaaaacacgcagtagctctggcagaatctcacattgaaaagattgctgagaaagcagaagaaaaagtagaagaagaaaaagaaaaagctaaagaagaagctcgcgaagagctgaaagaagctgcttctaaatactttgaccatatcgctgccgaatggatggcggaaaatcagctggcggttgatcgtggtattaaggctgaactgtttgaatccatgtttagcggtatgaaagaactgtttgttgagcacaatgttgtaattcctgaagaatcagtagacgtagtcgctgaaatggaagaagaacttgctgagcaaaaagcagaaactgctcgtttatttgaagaagtttctaaacgtgatgcttatatcaattacgcccaacgcgagtatgctattcaagaagcaacccgtgaattgactgatactcaaaaagagaaagtagtttctctgacagagggtatggattattctgactcgttttcaactaagctgaaagctattgttgaaatggtgcagggttctgtagagcagtctgtaacggaatctgccgatataaatactatcgacaaagaagcagacggtttaaacttcacaactgaagcagtcgaagaaactcctgcgactaaaaccccatccgttatggatgcttatgtagcccaagcggctcgtctttcttaatttaaaaggttatacaacacatgaaaaagaataaacttatcgaaaaatggcagccgctgcttgagaacgaagctctgccggaaattgttggcgctagcaaaaaagctctgatcgctaagatttttgaaaaccaggaagctgatattaatcaggctccggaataccgcgatgaaaaaatcgctgaagcatttggttctttcctgtctgaagcagaaattggcggtgaccacggttatgatgcacagaacatcgcagctggtcagacctctggtgctgtaacccagattggaccggcagttatgggtatggttcgtcgtgctatccctaacctgattgctttcgatatctgtggtgtacagccgatgtctaacccaaccggtcaggtattcgctctccgcgctgtttacggcaaagacccgctggctgctggtgctaaagaagctttccatccgatgtacgctccggatgcaatgttctctggtcagggtgcaaccgagaaatttgaagcagttaaagctggtgatgctctgactgttggtgatatcgttgttcacgatttcgcacagaccggtcgtgctcatctgcaggttgttgaagatttcactgtagacgctggtgctaccgatgctgctaaactggacgctgcagttactgctgctctggaagctggtaaagttgtagaaatcgccgaaggtatggctacctctgttgctgaactgcaagaagcctttaacggttcgaaagataacccgtggaatgaaatgggcttccgtatcgataaacaaaccatcgaagcgaaatctcgtcagctgaaagcacagtattcaatcgaactggctcaggacctccgtgctgttcacggtatggacgctgatgctgaactgagttcaatcctggctactgaaattatgctggaaatcaaccgtgaagttgtcgactggattaactactccgctcaggttggtaaatctggtatgacccagactgttggttctaaagccggtgtattcgacttccaagacccgattgatatccgcggtgctcgttgggcaggtgaaagctttaaagctctgctgttccagattgacaaagaatccgctgaaatcgctcgtcagaccggtcgcggtgaaggtaacttcattatcgcttcccgtaacgtagttaacgtactggcagctgttgatactaacgtatctccggcagctcagggtctgggtcgtggttataacaccgacaccactaaagcagtatttgctggtgttctgggtggtcgctaccgtgtatacatcgaccagtatgctcgtcaggattacttcaccatcggttataaaggtgctaacgaaatggatgctggtatctactatgctccgtatgttgcactgaccccgctgcgtggttccgatccgaagaacttccaaccggtcatggggttcaaaacccgttacggtatcggtattaacccgttcgccgattctgctgctcaacagccgaaaggtcgtattacctctggtatgccttctatcgtcaactctgttggtaagaatgcttacttccgtcgtgtatgggttaaaggtatctaataccaataagggagccttcgggctccctttagttgttttaatggatataaataaacttataaatccacagaggaaagcgcaatggctaaaatcaacgaacttctgcgcgagtcaactacaacgagtagcaacttaattggtcgccctaatctcgttgcattaacgcgcgcaactactaaattaatctataccgatcttgttgctacacagcgtactaaacagcctgtagcagcgctatatggtatcaaatatcttaaccctaatggtgatttgacatttgcaacaggtgcaacctatgcaggtcaaatcggagccacagaacgtgagtcaattgaagaactcactatggcaaataaagactcattcaataaagacgatatgttcaaatatcagaatgtggtctttaaagtacttaaagatagcccgtttactgatacaacagaaaccgatgaatttggacttgtatctgaagctgtagcagctaataatattcgtatgctgtcagatgctgcagtcactgaaaaatttgaaggacctgattcagacccaatcaccgaagccagttttaaaattgataaatggcagacccaggttaaatcacgtaagcttaaaacagatttaacggtagaattagctcaagatttagaagctaatgggttcgatgctccagaacttattgatgatttacttgctactgaaatggcagaagacattaataaagacatcctgcaatcattgattacggtttcttctcggtttaaagtagctggtgtatccgataaaggtgtattagatttaactaagcaggattctgctccggaacaaggtcgtactctgtatcgtttcatttgtgaaatgaattcagcagttcaacgtaatacttcttattctggtacttatgcagtagcatctactcgttgtgctgcggtgcttgcagcttccggttggttaacacagaagaatgatggaagtattccggaaaacgcatacggtatgctgaataacggtttacctctttattgtgatactaacagtccggttgattacgttattgttggtgttaaggcagaatttggtgggaaagaaactgtaggttctttattttatgcgccatataccgaaggcttggatttagacgaccctgagcatgttggtgcatttaaggttattgttgacccagctagcttgcagccttctgttgctttactggtacgatatgcgctgtcagttaacccatatactataggattggacgaggacgaagctcgtgtgattaatgctgcggatatggataagatggcaggaagaagtaagatgtctgtactgctcggtgttaagttacctaagcttattgcggactaatttgcggggagcttcggctccccttttttgctataaactaaatatgtcaaacctcggggagtattcctcctcgagggatttaaacacgttcttatcatagagattgacgcattctattccatgtctacgggctatatcaacagctactctcgtccctccagatacactcccgcatcttttttcaggcgcccaatataataccttatctacaggctcagtgcattctaggcccaatacctgcatagaattccgtgcaaatagtgtctgtactatcttcgagcattcatcccagtacgacgtaacttctctcgccttaatgatgcttttgattttggcttcgtttgataattcagaccatacaacaacacctgtatcaggaacatggccacaaaagccagaataaggaataatcctacaagaatttgacctatcgtatttcgccaaccacgcttcatctgaacccggagctccacctgaatatgaaaaatgcccctcttccgagaggcgttgaccgattatagtcattagactcagaactctgcgtggcgcttctcttgaaccaatcagcgccagcctcattattctaaaacctcatgccatttgctacgaatagtgttttgaattaaagtagtcagttctttcttaacagcagaaggattatcagcgaatagcatgtcatgaccttcacgagctgcttcgttgatgatatctttcatagtcagtcccataactcgaccaaaatctttggcagttacagtaccaatatgagacagaacgttacttacacggttccaggttacatactcggaaaagatttccagaacacgcttatcagtatcagtgagttcaaccttagctttaataggcttatcagatttagctttctcgctgaacttagaattcttacacttaatagctacacgggtaccgttattaaagaatttaggattaaccggtttaagaacatagccttcagctacaccggtttcagaagaagcctgtggaccgaacacatgtttatttgcatgttcaaggtcagtcgtgtcaacaagttcattatagtaattgacaatagatttaaagtcatttacatactgagatagctcagcgaatgaaccacgaccaagcagtggagctaatttaagaccaagaccagtagcaaacgattctactacataatcgtcccaataaactttttcgttaccggaatccgacaggatatcaaacacgtagaaatctttatcaccataatctacgcccttctgaataccaccgccagcaaattcaccgaagatttgaacagatactaaatccatggtgttcagcatgttctgcatcttaacgaaagaatccttgtacttcttcatgataatctcatgaccaaagaagctttcaccttctaaaataggaccagtacgcttagccggaacgatttcggtaggggtaataatcacactgaagttagtgccatgaattttctcacgagccacccactcaacggtatgcatatcaaaaccagcaccacgaatcttctcgatgaacttaccgttgtaatgattctcaagactagaatattttgcaaacattataatttccttagaatgtgattttcataaagtcagtatcaccgttacgctgggaactggtataatttgtaacaaatccttcatcatgcaaataattaagaacacttgtaatgtgtttcttaactagactactcggatacataattaactcacgcttacccgctaaagcggttttctcaatctgagttaatacttcttcttttgctgccgataattcttctgtagcaacattaatagcagtattagccattctatcggcaaggttcataatttttctctcaataaataaaataaaaccaggagtccatctatcttggacaagggtaatggtatcagaggatttcccctgagcccattataccacatcgatttttaaagcaattaataaccgctcggtacgaagcgatacatgatatatccgcttttagttagcatgatttcaaattgacttttgcttccaacctcaagtactaatggaatatctttatccattagcatccaatcaatttttccataccgttcattaatcaaatccgttattttacgtgcaccacttttatagtagtaagaactctgaacagccatcattttactaacaaatttagatgcaaacaaccagacatttaccccattagcagctggcgtaaatttcttagaaagcatttcttcaaatcgttctactacaattgggtctactttagacattataaagtcctcatgtgtttaacaagtttcttatgacgagattttataccaacgtttgttaagcgtttccgatatacgactttttctttttgcttaaaccgttcgtgtgctttctcaactgagacccacaatttagcagcttccgctggagtgatatctaatgctctcgcaatttcttgaaaatctttaccgctttcatgcattaagtgagcttgtagtgctttcataataacctcatctatgtgacgaggacataataaaccaatccgtgaatagcaaaaaagggagcccgaaggctcccgaatattaaggatagataatacccgcttccagcgcagtacgatgaacaatgtatccatttctagattcttgtacatcgacttctggataatcatctagcattttagccagagtataccgatgcaggtaatagtcgctgtcagggtcgtcgagtttccaatctttgccctcaacagtcattcgctggatttcatccattacccaccatccgcaccagatataggctgttccacggaacggtagaggatgaatatacggaagttctccgtctggctcaggggctactcttttggtaatagttacatcgccagttttagtgactgtaatcggggtgtaatcttctgcggaaacctcaacagaaacctcaatcacttgagaccctatatcagacgtgtcaatcactaaagtgctagtagaaccttctacaggagaaccgtctttggtccaagaataaaccccagttgcaccttctggagcaccgataacgttggctttaaaagatgcttcagacccttgttctgccgtaatagactcaggagtcaaagtaacagaaacaccactcattgtctttttagtaaaagcaacagcaatacctttagttgcagttccattattataatctggagcagaaaccgttacttcacaattcaatgtgtagctggtttccgttgactcggttaaggtaattgttttacccgtttggccagaaataacagaagagccacgtttccaaacataagcaatgcttgctcctgacggggcgccagtaacatcagctgtgactacttgggattgaccaatttctttagaaacagaagttgggctcaaagttaaagtaatggccggcatagttttgttcttaactgtcagagtagtttctgcttcagctgtttcgggatcgccttcagccggagtaacagtagcaactactttaacggtcttactacctgcaggtcctgcagcaacataattcatagctgcggtaacagaagattgttttacaccatttacggtccatacaaacgtttctgtgccttcagctgcggctccagaagttgttgcagtaaaattggttgttgctccaatgactgccgaagcagccaaaggagcaatagatacgctataagccataggtgttccttattttaaagttacaaatgaagaattacgtgtttcacgaatcataacagacccgtttcttttgatgtaatagattaaactaaacagtgtctggtgtgctgatgggtgttcaaacgacgttggccgagatttccaatctggggtatctttaatccattggtaaatccaccatggaagagtaatatatcctgggttcttacctagcaattgcatgtttggactaaagtttttaggaagctcaatggtttcatcagttttaacaattttaactactttgtccattgctttgaagaattcttcagggtccgtagtactaattggaatgtttgtaagttttccttcatcatcgatatggataacgctgtctccaataggagcttcagcataaaatcctttatcattgatagaaggagtttttacttcaaatccagggtcatttactttgggtgtttctttataaaaatctgggtcaatatcatgaattttaacacttgcacttactggagcatcaaacagtagttttgcttcatcagacgcttcatcattgaaaagtgcttttccttcaatttcatcatctgcttggattaaatcagcaattgatagaccatcgttgtcttctggcataggctcatcggccaatttagccagttctttttctaagtcagcaaccatattgtcaaatgagcgggtcttcttcagtttaataccgaaggttttggcatattcgtcgagcttgtctttagcttcttttttatcgagtgcctgaatttctttaatatagtctttatctagcattgggtgtgcctcatgtaatgtataaatatgattgtatttataaactgaggatagtacagtgcacgacatccaagtcaaatttaaagattttagtcatgttcatattgagtgtgatgactcaattttctatgaactcagagactattttagcttcgaagccgatggatacagattcaacccgaaatatcgttatggacattgggatggaagaattcgtctgctagattataatcgtctcttaccgtttggtcttgttggccaaattagaaaattcgctgaccaattcggatataaagtttatttcgatccaactatattcgagcaagaaactctttcacgggaggattttgacaattggttatcgactaaagaaatttattcaggattaactaagattgagccacactggtatcagaaagatgctgtatatgaaggtctagttaatcgacgtagaattcttaatcttccaacgtctgccggtaagtctcttattcaggcattacttgctcgttattatgtagaaaattacgaaggcaaaattcttatcatcgttcctaccacagcgttagttgaccagatgattgatgatttttgtgattatcgtttatttcctcgcaatgctatgttgggtattcgaggtggtactgctcgtgattcgaatgcattagtttatgtatctacctggcagaccgctgttaagcagcctaaagaatggttttctcaattcggcatgatgatgaatgatgaatgtcatcttgcaacgggtaagtcaatttcaacaatcattgcgggtctcaccaattgcatgtttaagtacggactgtctggttctcttaaagacggcaaagctaatatcatgcaatatgttggcatgtttggtgaaatcttccgtccggtatcaacttctaagttaatggaagacggacaagtaactgagcttaaaattaatacaatcttcttaagatatccagatgcagccgcaaatgctttaaaaggaaaaacgtatcaagaagaaattaaattcatcaccaatgttaagaaaagaaaccgttgggttgctaatttagctgctaagctagcatcgcgtgatgaaaacgcttttgtgatgtttaaacatgtagctcacggtaaagagctattcgagatgattaaagctactggtcatgagcaagtttattacgtatcaggtgaagttaatactgaaacacgtaatgctttaaaggctatggcagaaaacggaaagggaattattatcgtcgcaagttacggtgtattctctacaggtatttctgtaaaaaacctgcatcatgtaattttagctcatcccgttaaatcgaagattatcgttctccaaacaattggtcgtgttcttcgtaaacacaaagataaatctttagctactgtctgggatatcatcgacgacctcggtgtaaagccgaaatccgccaatgctaaaaagaaatacacgcatttgaattattgcttaaaacatgcattagagcgtattcaacgatatgctgatgaaaaatttaactacgtaatgaaaacggtaaatctatgattaaatttgaagatatttacgaagccacaattcgtgaggctactatcgataacttcatgagtaaaattaatgcttgccaaaccttagatggtctgaaagaactcgagaagtattacgataagcgctctaaagaaactactcttgctgattctgatgacatcattgtgcgggatgctttggcggggcgtagacaggctcttgaagctgattctgaagatgacgaagacgaagacttctgatataaaaaagccccaaccgaaaggaaggggcaaagccaattggctacatcaacactagactaaattaaaagttgcgtttcttgtaattgctcttctgtgtcttcagtgacaggcaattcaatcgcataattatagcaagctccgggatgaaccgggcctttgtctgtgtggacaaccaatgcttcatcgattggtcctttacagacgacacataccgtattcgacatgattgtctccttagtttacaagtttatttattacgcgccagcttcaaactgacgaaggtcaataatgtgcttaatgctaaaacctcgtgacttgatagcatccattgcatcgctacagaactccaaaagaattccccaatattgcaatttagtatctacacccaagatttctttatcagcgcttaaaacagttttcatttctgatttttcatatacatccatgcatacttcaccaccaacctcgccacggccagtgtaataatccaaccgtgctttaagattttgctttttgagggcatctaatcttaacatctcttttcgacaggtcgagtgcttacgcacccatttaccatacagaacggggttattagccgcttcatactgtagtttagtctggtcgataatcaaatcattatccaattcatcctgtaattcttctaatctcattctatctccactctactgtttctttggaaggactagtcccattatactctactgctagagttagcattactacgcatctgtatgcgtatacgttctagcgtatcggggtcgtctactatagaaaactgcacggtgacaattatagcattatcgtcatataacggaagcacatcaactgatagacgattaatcctaggctcataattacgcacagcagagactatattacgctttatcgtatcaccagttaatggagtcatgttttcaaataattcgtttgtgatatcacaaccaaacgctgggtcaaatggccgagacccctttcttgtggttattattccaagaaggctgtttttaactgatcgagctcctactgtttttgacacgtcagtgtcccaagcaagtcgcatttctgggtcaaggtcagaatagagtttatcgatattgctcatgacataatcttaaagaattctttaagccccttaattacatgaatgtgagaaattccgcattcacaagtaatgggaactgccaattgaacctgtggcttcaatagcatatttttaatgttaactacatcttcggttgtaatagcagaatataaatcatcgatttctgcatcgtttaaatcattaaagtaaatctgctcatttccaaccacgatataatctatgcattttgatatcatcattggaatgtcggaatcgtcaaaaagattaggatacttgaactttatcttgaatccctttaagtcataccagaggtcttctggaggatcgatttgcgcatgtgtataatttaatggcacaggaattttacgcccacaggtgcaattccaggtcacctcatgattaacctcgcctatactatgcgcccaaagtataactataagtaattccgattcttgtttgtttaacccagtagcattagtacattctctgagcaatgctttaacacattcatcgattgtaccgtttttcttcgctgcaattaaattagcgtattcttctagtgtaaaagctcggcactggatattcttgccatttattcttgtttcaaatttatatgtgatgttcatatccactcctcttattcaattatttataaatagtataaagaggattaccttatggccaacatagttagatgcgaattaccagatggtgtccaacgttttaagccatttaccgtagaagattatagagaccttttattggttagaaacgacatgaacaccaagtctgaagaagaccaaaaacagcttatagcagaattaatggatgattattttcatgaccatcctgtcgagtatcgtccttatatatttcttaaagtatttttgtcaagtattggtaaaactaaaataccagtcagaatgaagtgcccaaaatgcggaaaatataagcagtatctttttaatcttaatcagcctccgttgacaaatccgaaagtagaggttgcaggattaacgcttaagttcaaaaaacctatagaaataattgatgatacaggtaaaatgattttagacaacattatatctgtgaaggattcatctggggaataccagtggaatgaattaagcgatagtaataaattgacagttatcgatgctatagatgttgaaaccttggaaaagattttatcgcagatgaagccgtttaactttgagctaaagacgtcatgctgtgataccacgacagtattaaaatatgataacattgttgatatctttaagctattgctacatcctgacgagattttcacattttaccaaattaaccatagattggtttctcaaggtaaatatgacttgaattctataatgaaaatgctgcctatcgaacgtggcataaccttatcgcttattgaaaaggaccttaaatcatgacagcacaaagattaggatatcctaatataagcataaaattatattctggatatgatgcgtggctagctaatagattcgttgaattagcagctacatttattacattaacaatgagagattcattacgcgggactaatgaaggtctgcttcagttttatgattcgaaaaatatgcacacgcgtatgaacggtgatgaactggttcaaatatctgttgcaaacagtaacacatcaagaacacaaactcgaatttacggaattaaacactttacagttggtgttgatgataaaggcgatagcattatcacccttcagcttggaacgctgcatgacataatgaatctcaagttcagtagagcgttttttagttctgcatatgaaactataaaagaaatgataggcgcgatgtatgttgaccaaccattgattgctcctcctatcaacggaattaacgcttacgtcccacgagttccatggactagtactctcaaagattacttacgatacgttagaaacgtaggcatttctactgataacgaccaatttatttttgcctgggaagatatcactgggattaacatgatggattatgaatcaatgatatcccaggacccaaatgtattcatgttcggggctcctcaaacaataggtcagtttgcagcaggattaaaatatccattagcatgggattttgaatggcttgttaagtcaaatagatataatagaaatcccatgaaaaacgcaacattttatgcacactcatttgttgacaaagatgttacccgaattattaatggagaaggccaaaacagcgtattcattaatagatcaggcggatattctgacatgatttttaggaatggctatgaagaagcactacgcatttctacgatggctcaatatgacgggtatgctcaaactaagtgttacggtaattttgaactaactccaggaatgaaaatcaactttgttgatttaaaggaccagttcagaactgacttttatatagatgaagttatccatgaaatatcaaataacacatctataactaacttatatatgttcacaaacggctctgcccttgaacctgtagatttgattaaggtgaaaaatgaacttaaacgtgattcttcctattaagaaaatagtaataaatgaaaagacgatatcaattccaaaactggggttaaagcaccataatctgatgaaagatgttaagggtccagatgaaaacatgaatcttcttttggattcaatttgtccaggattaacagcagccgaatctgatattgttgtattacatttattagcatttaacaacagaataaaagaaactgctgttaaagatgattttacctacgatttgaataaggtttacatttgccagcgattaactcaaaggttagatggtaaagaattcaaattcagagctcctcctcgttattccaaactaggttcagtagattcaattttgagcgaatttcttgaatcagtagatggaaaaccaatggatataaactttatgaagcttccagcttttgtgacaaagtgggctgatgacttagtaaacactatagccattgatggacctgaaggaccaatcaaaggcatgcttaacgtaatggaaatatttgaatgactaagaaatcagaaatgaattcaatgcgtagaagagttattgctgactcggctccacagaaaaaggctgagtctcaagctgatgctcagattaatacgctagaagatattggtcgtcgcttagacgaccaacaagcatctactgatttgatttcggatgtaatagaaactaaatcaaacgaaattatcaaatcggtagaagatgtttcagctggtgttgaattaactgctgaagcttcagaacgcacaacagatgctgtctctaaactaaatgataccgcatcgttaattaatgataagctcacgaaacttgccgacttgttatctaaaaagcatgatgttcagcaagatgtccaaaagactggtactggaacatcattagaaacgataacagaacaagtcccggatgctcctactcagcagccgctagaggaattactcgaaagacttattcctcctcaggatggcagacgtcctgacgcggatttctttcctagcacagaagagcaagaggaaaaagctgagcctaaaaaggaaactgaggacaagaataaaaagtttcttgacctaaaatttggagaattaattaaaagcgttaaatctggttttggaaaaactatttcattaacagataaaattagcagtatgctgtttagttatactgttagcgctttggcccaaatggcgaaaactgccgccatggttttgggtgtgataatgcttatagatttaattaaagttcattttaattattggactaaattattcgaaaagaactttgttgaatttaacaagcaagccaaagaatggggtccgctattaacagcaataagcgagatgtcgaatgaaatagtaaaatcattcgtcaagggagattggggcggattagctaaagccataggttctggcttggttgatgtaattgacaagctcggagaaactattatgctcggaatgagtaagcttcttgctggaatgttacgcgcattaggatttaacgattcggcagataacattgaaggcgctgctttagacagatttcaaactgttactggagcagaactcgatgaagaagatgctaaaatgagagcaaaatatgttgaccgtcaagaaagagaatatgacgaacaacctgaatggaaaagaaagctttctgctaagttccaaaaattcaccggtcagattgatgacgatgaatataacaaactgctgagcggagagaaaaagcagtcagcgtatgcagacttgccagaagaagaacgcctcaaaatcatcacagctcgtaataatgctgaagcagaaatgaagagaacaaaagcatatgttgaaaaaactgatgcatctgattccactcgattagactctgctaaggatgcagtacaaagcacaaccaccagatataaagaattggagaaattatctccagaagttgcaaaagatttaaaggttgaattagaccaattgcaaaagcttcttgattctaaaatatcagaacctgctccaactgccgaagctatacctgcagcagaacaacctgaggttaaacagtctgcttctattaaagccgccgcggatagtcgtgaagctgctcgtacacgtgaatctaatacacagtcgcaacctattcaggttaataccgctgtaaataagaatagcacatacgtttatagaacgcctccacagacttcgacagctgctcctggaatgcaaggcgctatgaaaacctcttaaggaaaaataatgatttttgaagaactggccgatggccttgaaaacatcaaaaaatcaggaactcgaatttcccaaggtaaatctaaactgacgaatgcgccaaccactaaggtggcgcagttcccagctgaacgttcagctgggaatgattccgcccaagatatgagagtacatgacttatatcgcaatgggttattattcacagcatatgattttaaaggaagaacaactcctgatttgcgttcatttagacgagatgtaatgttatcgtctgtattcgattcaccaatgtcagcattggctaattcatcaagctctaccactagtactgcaccagtagctaatattctattaccgcggtctaagtcagacgttgattcagttagccataaatttaatgatgttggggattctcttgttacgcgtggcggcggtactgctaccggtgtattaagcaacgtggcttctactgcggtgtttgggtcgatagagtctttaacgcagggattaatggccgataatggtgaacaaatttataacaccgctcgtagtatgtatgccggacctgacaatagaacgaaagtgtttacttgggatttaactcctaggtctgcagatgaccttatacaaattattcgcatctatgaaatttttaactactattcttacggtgtgacgggaaattcatcatacgcaaaagaagttaaagctgctattgatgaatggtataaaggaactcttaaatccgcagctccagatggggctaaagtagaaaacacagtgtttgagcaaataacatcgtttttaagcaatgttattgtagtttctaacccaacgatttggactgttcgtaattttggatattctacatcaatggatggtagagaggatatatttgggccatgccaaattcagagtatccgctttgataaaacgccgaacggacatttcaatggtttagcaattgctcctaaccttccaagcacgtttacgcttgaaattactatgcgtgaaatacttactcttaatagaggtaacgtttatatcggaggtattgaataatgtttactctcgaagaatttaagagtcaagctgctgatatcgatttccagagaactaatatgttctctgttgtattcgctactgtaccctctagtaaaacccaggctcttctaaacgactttggtggagagctgtataataatatgggtttagatggaaattggcttggattgacaccaggtgaattcaatcagggtataacaactatagtgacacaaggaactcggcaagttgttcgtaaatcaggtgtgaatacatttatgattggcgcaatgactcaacgtgtggtgcagtcattattaggagaatttacggtaggtacttatctgctcgatttctttaatatggcatttccaacagcaggattgatggtttattctgctaaaataccagagaacagattatcatatgaaatggataagttccataacgctcctaatataaaaatcacaggaagagatatggaaccgctggttctttcatttaggatggacccagaagcaagcaactaccgggcaatgcaagattgggtaaatgctgttgaagacccagtgactggtctgcgaggattgccacaagacgtagaatgtgatatccaagttaaccttcatgctagaaatggattacctcatactgtatgcttgttctcaggggctatgcctgtagcgtgtggagctcccgaatttacatatgatggagaaaacacgatagcagtgtttgatgtcacgtttgcatatcgtagcatgcaaacaggttcggttggaaaacaagctgctatggattggttggaagataaggctattcagaaaattgagacgattaatccaaatcagggcttgagtgcgtctgcttcaagattgtctcgtttaggcggggctggtggtggaatttctaatatcactactacaacaagtagaataatttaggggccgtaaggcccctttgttttatgcaatgcagccaataaaccctggctcagtgcgaagaagttccatttcgtctgtggtccaaactactttaacaggaatgataccttctgctttaccgtttagaaccgcttcgacaaacgatggttcagttggcttacggaagatatcttgaataagaaccgtcggagtaccttcgttaaacccttcaagcatgataagaacttcttcattgaacttctctgcatctttaacatcagcagaccattcaataccgttaaagcgaaatacgtgtttcatatcaatttcctcattggtttgtgtaagtctatagtatcacgtccttgtgataagtaaacaactttatgcaagtttttctgggataccatccaggttgatagcaccagccagtagctccatggtacgcgtgtagctaaccttatctgtagaacggtctggcgaaaagtaaatctcatttaaaaagcctttgaacttgctttcttcaagaggttccactttgccctgttccatcaagatgtcaccatcatagagatgaacggattcatcgatttgctctggaggaactaccgtcatttctaccatgaatgtcttgttattcgctacaccaactccatttctaaaaggagttccccataccttgttaactttcattgccaacccgcgaggaagaataacttcagcctcatcgctaaagcttgacaagacacccgggataactaccttaactttatcggccccatgaataacgaatccaaacttaaactcatcaccataggcaacttcctcgcctctatcaactctttccaagttgtctgttccaataacggaagatactgcatcaatagttgtttctttgttttctaaatcagaactaggtgcgtctggcattaatgaatcaccagcatttgaataagcaccaaagataattggacttaacgaagtagaaacatagttctggaaataaaacattttagactcaatgttatctttaaagtcttcatattttcctcgctgaccgcgatacaaaagagtgcctggttcaagacgcaaacctttttcaaaggcagaatcgagcggacgaattttcttgtcaataatcggatcgcctaagctttccataccaataagatagttattaacaaatgaataaccagaaccgcagtaatggtgtattgcatctctttcttcttcgcttaaacgagattgcatttcacggttatattcaattgctttggatatagaatcgccaacaattgacacataagcggatatcatataattgacaagattttggtattgacgtaaagctccgaaatcgtcagctggaggcatatcaaatccacgagtagctacttcaacgattttacgcattgtttccatagatgcaggatttttagcttgagcaataacgtcagcaacgtctgaaattcgttgttcagcgattttcattttgtctgaacccgaaggaatgaaaaccttccagtcgtcatgcattctagacatttggcctacaaataatctctcaactgcatcgccaaaattacttccatatccgccacgaacacgatagtgcttgatatcatcaacataaaaaggaattgatttttctaatccggctttgatatctttttggaggtctaccgtatcgccttctgcgtttagtactggagtgttagtagttaattcgtaccagcgttcacgtttattttctggccaatcttcatcaacatatgaaacaaatttgccgtactgtgctcggattaaatcttttcgagacactttcattttactcattacagcgagttcagatttcttgtcttctttttcgccaatggaattagccaatgcttcggctttggtaacgttttcgccggtttctttagacacataaacttcgcctactttggaatctactttggtgtaaagttcttctgaaatttcaggaattccttcaatctcttcaagtttcttacctttacgaaccataatagaataagcatacttacctttgtagtaagccatatctttcattagattgaaacgaccgccggtgcgagtagtaatcaaccgagcaagaatgcgttgaatagctttatcctgtccttgcattttcttcggattaaagcggaacattaccgcatcagctttaatttgcttaactactttgttgacggtctcaaaaatggtattgatagcaccaatcgggtcttggcctaaaccacctttaagcgcgccgatgttgcctttttccgacacagagaaaacatagacctggatgaatttatcacccatcttgatgttcttaactgcatcaccttgacctgacccttgtactaaccgaatcattaaattgttattacccggcaccttaatcaaaaagacctgtggtaccttaagttttggcttaacgttctcgacgggatagattttactattctcttcatcgaaaacttcatttaaaagttccatgacatatcctcgtttgtttattctatttatacgaaaaaaggcccgaaggccttaattaattattgttactgtacgccaaacttgtagtccatttacagactcatactcttcaatgttttctttgaagtttcttaatgtgttaatgttattaaactcaagaacttctgtgtgaacagaaataccaccacgtccgtcaagagatttagcaatcacttcgtataaaactttcattttattcctgttgcctcagtaaagttaacaccaaacgcggcttcgaatgtattagccacttctttatcatatctacgctgtttaatgataggtaagaataatcctactgtaccatcatcacgaccttcagcagttacccatccattgcattcaagttcccagatagttcccggaagagaatctctgagcttccataaatgagtacggtcaagttcatgtaattcttcgggcttatctttaagacctgacccagcgttaacacgaatacgaccacattctgatacgaacattaagccgcccattttaccaggttgttttctatgctcgtacgaaccgacacatttcaaatctacggtgataacctctttaaatttaacgaggttcttagaacgcttatcttcccaataagcaccgatattcttaaggataataccttcgagaccttggtctacgtatgtcttatagatagcccgagcttcatggatgttatgtacgacacggttttcaattagaataaccttgtcatagcctttgctcatcatttccaatgcacggaagcgtacatcataagcaaatccaggaactttaccttcggaatatactacatcaagcggaacataatcccaaacttggaatctcataccttccgcttcttcagcagagattgttcctttgattgctttattagccaatccgtttgattctgtacgagccgtctgttggaattccttagccttacttagctcaggaagctcaggctctttaaacatatcaaacaggtcgttttcttcttctttcacttcgacatgatataccaactcgccgtcaatcatcacaccattaggatggcgttctcgggcttctttggtcatctcgataagttgacgcttaagtttatctagacccaggtattcattaccggaacgagtaagaagagttacatcatctaaatcatctccgcggatttcagcgaagcaccgggctccatcggctttaagctgagcgaatgcaggaaatttaatatatgatagcgctttctcagaataagctgatgctaacatctgtggcatctcaggaattaatttcttccataccttgttagcaatagaacctgaagcgccgcaacgcatatccttaagaaggacacggaccagtacactagcatcaccctcgttcatcttagagagcaaatctactagcccctggattgccatattaccagtaagtactcgtgctgccagaatgtcttggaggtaatctagaccatcagaaaacgtctttgaaggaacatttggatatttaacgggagtatattctggaactttcttaataaagaatttaaatcgcccggaatacgccagcagataagctcgttttaaatcaacgttatctttattgtcaataagaatttgggttttagctttagaacccttagcatcttcaattgctttgatgatatcaaaaatcattattcacctaattcttctgaaagttcgcttacgctacgatgataagttaatccatcgatataaacaaacccgttattgatgcattcattccaaatcgggcacgcctttgcttcacgccaaattggattccaacgataaaactgattaacatgaccgtaatcacatgataaccaacgtttacccaccttagtatgaactacaaacattattcctccttgggtatggtcattataccatacccagattgttagcaattaatttggtggttatcacatgtaatacgaccgttattccaccagtcgtttccaggaggaacatgcggaccaggactaaacggaatgataggttgtttccaccaatctcctggaacttgtcgtggaggccaattaaaaggatgttgctctttacgaatttggtctttgatagcttcttcccacaatccagaaagagacttctgcggtttcttaacggatttcagagattccaggcaagttacaatttgatgccaatcttcaaccataattccaggagcagtcactgaaccttctcgctcaccacgaggcatataaaacacacgagtttcagtgtcttcaaatactttgctggccgcagcaatatgtttaggcaaatcatctacatagcagacgatgcgatcgccgtattttactttagccttttccagtaaagcatctttagattcatcataatcgcagaccatgatttctgtaaatgcatcagggaacaaagcatttagattgaaacgacgattaaggttagcatctactgagttaccaagagccgtgatagcgacaaaatcgtatttttctttgagcttattaactgtagctaaagcatcagcatacggagcaagataacgaataaaatcgctgttgttgtacttcagaagcagcttaacagccagttcttcttcacaatcaaacagctcagcgggtttaatgaatttttcagtagtcatcatatcaaggatatgctctaccggaagattatatttttgggcaaaataaggcagaccactttgccacttaacgatgattccatcaacatcggttgcgattactggctttgacattcggggaaattcctcaatgcttgtttaaatttggcaacgctatttgcggcaccggtgaaattgaaccagattaaccctggagcgtccgcgggttctatatcaattatttctatattataatactcagcagtctttagcatttccctggtgatacgtcgggcaaccatatgaccgaagtgaggattaatagacatcgtcgttagcagcccttaattgagtaattggataaagctcggattctgcatggattgaacgattgccatcaacccaattaacttcataccacggttcaactgagtaggctttaatggctggagccgtatcacatacaactccaggaattccatttgctaatcttactgtactgaagatatgatatttcatgcatcaagtctcactgcccattcaggcaattcaaagaaatccggagcatcaatttcatactcaacggtgtgttgtttaacgttagctgacatgatatcaaccattgggtggtttttcaaactgcaagaaaaaataccagctttaggtttaggcacggatacaatcatgttgatttcctcaaaatttagttatgaatttttctttcggcattttagcatttgagccatcactgtcagaatacccaattggcatagttgcattaatgaattcaattttagcatttataacattaatgctcagagaatctacaccgtcaatcatacgaaattcaggagggcaatacttatcaatgtatgctttcacaccatttttattagcaggtgtaccatcgcgggtatcgctgataatggtttcaacttttttctttcgtgaatcatagaaagctgatacaatcatttcaatttcctcttaaaacgggcgaatattaacgtgaaccacagggacagcaaaaggttgcatgattacaacttttgtgtctttagttgcattcaggcgttgtacttttgcaagattaacagcttcttcctttgtcaatccacctttgtaggtatcatttcctttatttgaggtccaaacaccccaatcattgcttccatcgtcggtcttcggttcaagttctttgtagatggtttcttcaaaataatgctgaaattcttgattagtaataatacaccacatgtgagaaaagcgaacttcatctacactaacgcgtttgcattctccatctggcttaatgatttcaaattcaactaatccggtattttccgcatatttaaaggttctggtaattttaattggattattaccgatttgctcaaaaacacccttgataagagcgcctggagacaagcttggagtctttttaagcttatagaatttacctttttccattatcatttcctcaatagtggggccgaagccccgagttagttaaaacttgatttcgtttgaaacgatatcccagattgcttcacgttgttcttcggttgttttacgaccgaggatgtggcgcagataaattttaacaagcagctgacgatttgtgttccaagacggatgtgaagataaatcacgtttacgaacttcatcatgaaatccaactttgatttcagaaccgttgaactgaatatccagagtaggaccattttcaaagctaaagaatacgtagttatcttcccagtacatatcgatttgagctactgtgccgttgttgtgttcccacagcaaagtagtagaaacgtcccaagcattgttctgtacgtatttgcggttgaagttagtgaagttcatttttattctccgtagtttgtttatctgtttgggtggtacaggtctatagtaacccagaccacccaagaagtaaacaacttttattcaaaaacttcagacatttttcacctctacagtttttacagtttttacttctgcaaatccgatgcttttaaacagttcatacttggtagtttctggaacgatatcggttagctcaaggatgatttcttttgcttcttccagagtaaagatgcttcttccgtccttaacgaccggtgctggtttaatagcagctgatacttcaaaaaccacgtagcggtcagtagtactttgattttcaaacgctcctatttgcacaacccgtccttcttctaactcgtgagaagaaaataagcatgacagagaccggtcatattcatctcctatggtttttgccgaaatgattttaccagtttcggttttaatcttaacaacccggcccagcgaatcaagttctaatggcgtccagccttgaactccaacaacggtggcaatgagatagttaattgtgttcttagcgtctttccatctacggtaagtttctggggaaatgcaatatactcggtttttgctgtaattcattttgatatcctcaaagatggggccgaagccccagtcaagattactgtttagtccaattatccatgtttaatttaccaacctttttcatttgttcaattaaagcatcggcacgattacgaccattttcataccaggttacatcttctgagtaaccgtcttcttcatctgtgtaggtttcagaacgaatacgaccaacaactggagtgttcagaacatatacagaacccgtgaaccagtttgttaaagtgatatgccagcagaaatcatctgatggaccgtccggtgtcatgcatggaacgatatcaccttgaactttagacaaaatccacattttctcatggacagtttgagctttgtaaccgtcatggtctttagtcttgatagttgcgttcaggttgatggtattcattttattctccgttgtccgtttgggtggtacaggtctatagtaaccttgttgaacttagaagtaaacaacttttttcattctgcggaaaataaaaaagggactcccgaaggagtccctgaacttatgctttcggcttaccaaaacgagaagcatcatcgcgaagaaccgcacgagcccgacgcatgattttctcaaccgtctgattgatacgcttgttcgacccacgcttgtagccagcgcgtttagaggtaccaacaacttcttttactgcagtttttgctttagcttgtttagccattttatcatcttccattttggagaaatacatgggagcacgttcttccgaggttcaacttctttcgacagttctttcggttgtagctcccgcaagccctcaagggggtacgtttaaactcttatctgttgcacaccgttagcttaaaggttccgggtccgatttatcggggataagatatacaccgatggatgtataggccttgaggcgtactcccgattggccatcgcctcggggtagcatgcacttgccgtttattttctagctgcactttggtagcaaatcaccgttggtttcgggtgttttacgtggggataaccaacaacgtccacatcatacgttacccatgcgtacacatggtgggcgtacaaattacttcagcgttaccacaaagtggcgaacagctttgcgagcagcagaaccaagatgcttagcatacttcagttcgtccatcgcttctaaagtatcacgaaattcagcttgtgctgggttcaggtgtttaaaccctttcagaacttccagtgcttctgcatagatatcgattgaagcaccgtagttttcgtgaccggaattccatgcattacgttggagttccagagctttagtaagttgtttgttcattgaatcgttcctcaaatgaggttaaaatttggtggacggtaaccgaggtttagctcgggcatccaccgcgtagaattgctcgggtaactaattgtccgacgcccaattcatattattatttatatacgcatgcaagggacttataatgacaagtcacaaacttctgccgaatttctttgggtttcttcacacctgctgctactaacggatgaggtacgtttctgatattaccaacaggcagtggagtcaaatcaccgacttcaacaaatcctttcggtacatcatcaccgatagaatagatttcacacatatccggcagttgtccttgttcttcttttccaagaataataccggaaggagaaacaatttcatcaccttgctgagcaggttcagatacgagaattacatactcgcctagagctttaattggaagttccatgtgttacctttattgtttgaccatgtagttatattaacatggtcagtttaaagcaaattacttaccgatcatctgcagcagatgctcaactttcataccatttaccgagataagtttatcaaaggtaaatgagcgccaaccttctttctcagtatcatataccggaagtgaagtagtgctttctgctcgggcagatttaatagtgctttctaccaaatcagatggaataatatctttatcacgagtacagcgcagagtacgaatagtgccatcagctttttcaaacacaatctgggattcgcccatgctcagcacagccttcagagtttcacgaatatggatgttttgttcagtagtcagtttcattttgatgtctctttaatagttttgataattacagatttgcgcttggataattcttttaataatcgaactgcttgatcttcaaatttaaatgttgctaatggtttccatttaaaccaataccggcgttctactgagtatgatataacaacatcaccacttaggttaagtttattaatttcaacaattctaagtttcattattcaattccacagaattctttaatgttataccaattcaacttatccaaattacgttttggaacattgaacacctcgattccagcagaacgaagaatatcgtcccaaccgggttcgttcttgtcgtatgtttcgcagtatactaattttttaataccagactgagcgatggcttttgcacaatctggacatggagacagtgtgacatacattgttgctccatcaatactactgccgttccgggcagcaaaaagaatagcattaagctcagcatggatttcattgactttagaccatgcagagtgggctgctcgatgttctttgagcaatccgacttttttgacttggaatccgtcttgacgcaatcctgtagatttgtaaggaatttcaccaatccaaccttgttctgctgcatggtcacaacagttcacaccaccagaaggtgaaccgttatagccagtagaaataattcgtccgttcttttcaattactgcgccgactttccacgagcagcattttgactcttgagatacgagatacgcaatttgtagtaccgtcgacgctttcatttaaatcaccagataagttgtgttatttgttttaaccaattttaactcgtcagtaggagaagcaaaactctctactcgagaagtacgaatgcctgtaccatctggaaacggatgattccctcgttcaagaacatcggaaaagacataaccataaagaggttggccttccttaacattaacgttactgtacaaaatagcatcatattcttcgcgtggaattgaccaaacaccttggtcagaaccaataacagcactgatcagccgaatgccatttgggctgatttctgctttaatgccacgagcatgttcaattaaaagagcttctaccgcttcacgtaaagtcattagatatgtcctaaaatgttagtcatttcaacttggcctgttccggttaaagccaattgagtgtgttgattgctctttccattattaactgtaatgatataagcatcaacatagttaaaggatgactctcgtcggagagtcactttacttccaggaacccggtttgctacttcctgtgcgaagattttaaccttcgaaataaattcatcatgcgaaaatttagcgtcagacaacataagtctcaacctgttgggtttcaaaattagcaataattccaacgataaaccagtcgtgttcaccttcgccgcaagaaattttaatttcagacgaaccgcctgaccggtcaatagaaaatttaataacttcgccgtttggaataagtgcattcattgcagataaaaactctgcatgcattttggctacttcagatggagtaaactcatctgttaaatgattagcaacaacttgcgtaaatgatacttttactacttcggaatactttggaaacattatactttcctctaaaaatcaccgtgggctacttgccagcattcaacaccgatacgacgccacatttcaactacctgcgccctgtcatctactgcaagtttgacattataacgatcagcaattcggtcccagaagatttcttcttttaccacatcgtctttgcgtgaatcgccttgcttacgttggaagtgttcgcctgtttcgccaacatggtccaacaaccatttcttcgtaatgcgttgataaacagtagggtcttctttagtaccagactctctgccggaaacagtaagaattttatatcctttgttacgaagcattttaagaaattcaattaccatttcctttggatggtctttaccacatttggccaagtcataaggagaacgatgattgttatctgctaacgtgccatcaaggtcaaagataactgcttttggcaatgattcatctggaatgtacaaatcatacggatgcatcttagagtagaagctacggagcacttcaataggaactgcattcgcgccacgatagaggttacgcttaactagttcagtccaaggaacgtcaaagcgtttaatttcccacttgacaccatcaatttcatatgccaactcttgccacttcttgatagtcgttggattaaggttagtatcagcaatgatgacacctttagtggtttccatctcgagtagagtcttcgccatagaaaactggcatacagatacagacttctcacgaagcttagaatatttgtaatcattacgtttatcaaggccaaagatgccttcacgcaaatcatcacgagacaaaacataccaaccgggattagctgctacgtattcgttagcccaggttgttttaccagagcctggagccccttgtgtcaaaaccaattttttcattatacatccttaagagtgtcaataaaatcatgaagagccttagacttttcaccccaatttgcacgatatttttctttaattgctcgcaatggcttattcattgacagtatatcatttttgtcataattttcagctgcgcgtccaaacacgatgcacgccaattcattttcagcaattaaccctttaagtgtttcatactgttctcggttcattataataccatcacttaacgcaacgaggttctttaaggtcagaacgataataacatatcattccgttagcatctttagtataacgtaaaatgtcattcatccagatgcgatactcttgagactcttcaaacggcataccaacccaggctttaccgtcaattacttttacttcccaatgtccttcccatttttgaattgggtctggccactcaggatgcaaaaccgggacatccggtgcactagaagaacatccaacaagtaggctgataatacccatggctaatagacttcgtttcatctggtagcctcctggatatcttctgcaaacttattgaagcttgcattaatctgtttttcaactaacccaggtttagctgcaactacgtttccacgcttagcatctttattcattttagcgttggaagtatcacgagctgctcggttttcctgatagcctttataggttgtctgcagattttttatagaaacaccgatattttctatttcttttgcttgtcgatcagattcatcttggacgactttgaggtcagctttaagattttctacccgccacgaaagatatttcaatccaccgacggataatgctaacacaccaatcatcaaccaagttgtgtttattttgagcatagtttaaggataacctctacgatatcatcacgggataatcccgaaatgaggatgtgacgatcagaactttccgaaggagaacacttgaagcaagcttctacatattctgccatctcagaataattcagctcgcgatgcataatgccaagacgatgtttgccataaatcgggtcaacgattacatagcatttgcatccgttggcatgaacgtttggttgagtgatgtttttaaacacctctgcaccatacttcgcgagatgattatctaggaaatcaatcatttcatctacggcttcaggcaaggcttcggcacgctgctcgttcacacgattagtgtactctttttgcttcttacgagcagcttccttgcgtgccatatgcgttcgtaggtcagtgacgaatcccactttcttggtgccattccacacaaaatcccgtcagaatgagtaccatatttgttaacaaccatatctaaagtaattgcttgcatatccatttcattatcctcatcagttggtgtaagtctatagtatcacaccttgatgaggatgtaaacaactattcttcagaaatttcaatttctttttcgtactcttttggaacatatccagcccagtacttcaagaacactttttcgaggtctttaagcagtttatcaacatctacagttccttcgtacatgttcatgataacaccaaaaagatgacgctgattaaccgtggctttctgcgcagcaatagcgtagtctttacgagcacgacctctgtattcatcatagaatgactgacatagctcaagtgactttccgaggtaatctagataagcttgctcaaacgcagaaattttcttaattgcgtattcatctccagcaaaaagagaacgcaaatcatcggaatttgcagatacgacagacgcaaacagtctttcatttgacgttattgagtctttagtgtgatgaagagccgagtaccattcggttttaaccttaaatctctgcccagtgtttagaactgcaatgtatccttctacgccttcaagtgcacgaacaccttcaacccaagtgtcggggtcagaaattccataagcattaattaaataaggacgaattttagcattagcgtacaaatcgtcatatttaacatactcgccggttgcgttatcacggacgtttaacacaaacagctgtggctcctggtatgcaagaacaacacgattatcaggtgaaacaaattccatgtttacagtatatccatctagtgctagttcaagaacaacttgatgaagcgaagagtattcttcactattaagcagggcagaagaccttctcgcctggtcactgtagagagatgtttttgacttaaggtatagatacccatcatcaacataagatgatactagagagccatcagccttatccataatgtattctacatcgctaatatcaattcccatcgttaatgggttttcattcaaattaaagaatttttccattggacgagaagcaattcgaattggagtatcaccatccatttcaaacatgatgccccggcactcaagagcatctggttttaaccactcgctgtagcttgcatagtgatatgaaaacactctgaacttaccatccataggaccggtaaaatctttataaaagaattttgcaacttctgagctttcacacagattcattaaatttttatatagctctaacatttctttaccttatgtttgcaattatcgtagtgccatctgatagcaatggcctttgaagttattataccacaatgcgggcatggactgtacaaaggctttttctttcctttttggctttctgaccgcttgagtttagtttcttcagattgtgttttaccggttaaagattttgatatcttttcgcgtgtttctttggcatgagtctttccttgagtgggacttactctgcctttcagtgctttagataaattctttctatgttcttccgttcgtttctttccggagaataagttagatgtataattagaatgctttattctagagctttcataaaatctggaatgaactttaaaattctttccagaagaattacacatcatccaaagagcataattcattttagaattattatgtatctttgataatagcaaatgggcaatgaaatgttcacgtccagtcaataaaactaaattagaaacatcgtcatttcctcctaatgattttggaatgatatgatgagcttcagtataatagtttaattttcctttatcattgcctcgtaatttaccctttgctattaggttatcatatactttaacatagttcatttagctttgttagtatgttgtgtgttccatggaggattgaacttcttaatcagaagaggttcttccaagtccatagtggatattgacatctcgccaagttcattattaatcgaaagattaaaacactgacgagcatagaactctacttttttgccagccattagtgcttcaaaaatcttggcagatttagctgaatcagaggtttggtctttccgattaatagcagttctataataatttatacgtttacgaagattttttgtcttaccaatgtaaaccagctcatcatcaactgcgatggcataaactacgttcaacttgtttgctatcagaattggtttgatggtaaaatctggttctaactcaagttgaacatattttataaaagaaaactcgttagcaatatcattcataataaagaggggccgaagcccctttccttataagtactttttaaatccaattagaacatcatcagtgacatcattgtcaatctgagctaccagataagaacttatctcaacttcctgaggagcagattggactgcatcagagttaagatattcacgaatccagggaataggatgtcgagttggtgcgtcagtgattgggcacggcagaccacagctacgcatgcgagatactgttaagtagtcaatgaagtcatgaagaattttaacgttcagacccggaagaccaccattacggaaaagatggatagcccaatctttttcttggcggttaacttccatgaagattttaattgcttcttgttcacactctttagcaatctcaacccattcttcgccatcagtgccagtttgaagttgacgcagaatgtactgtgtgcccttcagatgaagttgttcatcacgagcaatgaacttcatgattttagcattaccttccatgatttccatatttttatggaagttgaaggtacacgcaaaactaacatagaaacgaatagcttctaatgcgttaataacatgtaagcaaagataaagagatttcattaaatcgcgtttagcttctttaatttcgatattatcttgattaaagcagcgatttttggcattttcccatgcgcgagtcttcgctataacatcatcatagtaaacaccaattgactcagcgcgtttcatgattgcttcgtcaagaacgatttcatcaaagattttagctgggtctacataaaggttacgcatgatatgcgtgtacgaacggctgtgaatggtttcactgaacgtccaagtctggttccaagtatctaggcttgggtcagaaataagtgcagataaaactgctgctggagctcgtccttgaattgaatcaagaagagattggtacttcaagttatcagtgaagatattacgctgatgttctgggagtttttcaaactgaccacggtccatcataacgttaacttcttcaggacgccaaaagaaactcaattgcttctcaatgagttcctcgaatactttatgacgctgaatatcatagcgtgcaattcctagaccagaaccaaagaacatcggttcggtcatgatatctacttgcttggtattaaaaactgtactcattctatttcctattctgtggtgttaaccatccgtggtctaattataattcccttttattaaagcttacaggccgcgcagtcagcagagtcttgaatcatatcatcgttaccggaaccgtcacgggtgttatgatagtaaagagtcttaccgccaaagtaccagaaataaagcaagtcgtccatcattaccgacatttcaacttttcctttagggaaattcgccgggtcgtaataagtattagcagagatgctttggtctacaaatttctgcataatcagaacctggttcagataaggcttattaccctgtttcgcgagctgccaggcataatcataaagggaagcattgtgctcaacatttggaacgacttggttgaagcttccttcttttgattctttaactgacactggtccacgtggtggttcaataccgttggtagagtttgatacctggctagacgattcgcatggcataagcgcagataacgttgaatttcggataccgtatcgcttgagatcttctcgcaggagttcccagtcacagacatagtttggagctgcgagttggtcaattctttcgttgtaccagtcaataggcagttcaccacgtccgtatcgtgtttctttgtaaagcgtgcatggacctttttcgctagcaagtttaacagaggctttgatgagtgcatattgaatacgttccatcatttcgtgagtaatatcattagcatctgcgtatgaagcaaagttgcttgctaaccaagctgcatagttagtaatgccaacacctagtgctcgacggtctttagcttttaacgctttgtctacaggatagtcttggtaatccaaaaggttatccaaagcccttaccattacttctgcgatttcgttgacttcttcttggtcttgccagttgaagttgtcgagtacgaatgctgcgagtgtgcatagcgcgatttcgccatcttcttggccaacatccgaagttggtaacgcaatttcgaggcagaggtttgattgcttaaccgtagccacatcacgaataaaaggaccatattcaccaacgttatctaccatgtacgggtaaattcgagcagtaccagcacgttcagtaaggaacaactcaaacagttcacgagctttaatacgtttctttcttacgtctgggttcttttccagctcttcgtataaagtacggaacgcttgtgcatcacggaagtattctgtgtacagcgtgccaagacatacatcgggactgaacaatgtgatgtaatcattcttaatcaaacgttcaatcatcaggttattaatctgaacaccataatctaaatgacgaatacggttttcatctacacctttgttgttcttaagtacgaggaggttttcaacttccaagtgccagattggatagtacagtgtcgccgcgccaccacggactccaccttgggagcaggatttaactgctgtttggaagtgcttccagaaaggaataactccagtatgtttgacttcaccgaatccaatttttgaaccctctgcgcgaatcatgcctgcattaataccaatacctgcacgcttactgatgtatttcgtaattgatgcagcagcttcgttaattgaattaagactatcaccaccttcaataaccacgcatgaactaaactgacgtgtcggagtacgaacaccagacataattggcgttggcaatgaaatctttttagtagaaactgcatcatagaaacgaataacgtttgctaaacgattttcgccatcatcttggtgcaagcacataccgatcaacataaaggcaaactgtggagtttcatacaattcaccagtgtgacggtcttttacgagatacttctcgataagctgcattgttccagcataagtcatagtgaaatcacgctcatgcttaatataagaatcaagcaaagtaatttcttctgctgaccatttacttagaatttctttatcgtacttatttgcgttgacgcatcgggaaatgtggtcaataaatgcaggtggctcaaactgtccataaacacgcttacggatttcaaacatagctgcattagacgccacatattggtaatccggttcatcaatagaaatgctattcgccgctaccttaacgatagtcttttggatatctgcagtgctcatgccatcacgtagatgggatttaataatttcatataactcgtatgggtctactttggttccttcgcacgcccattcgaggactttaatgattttctgcatgtcaaattcttgactaacacctgagctcttaattacttgcataagtcctctaattcaaatgtatctttaaaaagtttattcactacaagagctattatatcaccatggcaagaaagcggtttgcaggtgcatcctaatctcattcctcttaaagtttctaagtgctctcgctttatttctccgttccgaatcttagcaataaaatcgtccttaaatgccgcaatagcatcaggacgattatcgcaatctttaccgacgtaatttccccacattgttccacgttggatatttacatcgaagtcggaatggtatttattaaccacccgacatatcttcatgttatatcaacttcaaaccagcagattaattgtgttttgccaatagaccattcatatgatttaatgacagataaaacgcgttgttcgatcccgtcaaaaactatcttgtcattaacttcaggcaaatcactagagaatgcatcacacatctcgcctaatattgtttgtcctttacgaacaaatcgaatattcatatagccattttccccttaattgttggatgggatttatatccttcaagaacaaagtcagatggtttcatcattcctgtaacccaagctaattgttcttctgttgctaattcatgaaattctttatcttttactggaggccaataattaatttcaagttcacacagctcttttggcctctcactgttcaatatggttcagataaatgtgagtgttaccaccagtgaataccaaatgcccaggtttaagattggtcattttagcaatgatatgaaccaatgctgcatatgacgcaatattgaaggggaggccaaggaatacatctacagaacgttgataccactggaggtccaaatatcctttacgaacgttgaactgataaagcagatggcacggtggtaatgccattttgtccaaatcaaccgggttccaagcggtcacaatctggcgacggtcagttggcaattgcttgatacggtcaatgaccaattttagttggtcaacgcccatgaaatcacgccactgctttccatacacgggtcctaactcaccaccagaataccccatgtcttttgcctggttttcataattgtcgtcccagacagttttaccttctagtaatgaaccatgctgaataagacgcaattcatgaacattagtagacccctgcaagaaccaaagaagctctgcaatacatgctttccatgcaagacgcttagtagttacagcaggaaaccctttttgtaaatcaaaacgtaactgagtaccaaacttcgcaatagtgccggtaccagttcggtcatccgtctcataaccgttttcaaaaatgtctttaattaattcttggtattcacgcattaaatttttcctgaagaggagtaaagaaaagctgatcaccacgcttttcaaatcgcccaataatagacactacatcatctttgaccatcacattgccatgtgacattccgatgaacatcttcttataatcacgttcaatttcaataggtatatttccatttcggttatatactgtagttgaaccgttataagtgctaagaccattataactgaaaactagaagatgaataccatgcttaaatggaaatcttttccacctcttttggactttgtcttctgatagctgagtgatatcatagtttgcgctcatagaccacctctgaaatgttagtcacttcatcaatatgataccagtgattttctttagtaatgaatcctgattctggccaagtaggagctgctacaaattcagcaggtagagtgacatcagaattcactctatgactttttctgatggttgtttggataaccctatctgcatatggatatgccttctggatgattccggcaccacctatgatagaataattaaggtctctattaaaagtgatagtactgttgtaagaagtatgagcggccataatgtcaccacccaagaaaccgataaattctaattcacttacataagcatctgcaaagaagccatttttagcagttgccaacgcacgactcatgtcttggacaacgattgtcttacgaccaggaagaggtttaggaaaactcataaaagtctttgctccgcaaatcaagatagtatctcgagtacgattagcaaagtttttcatgtcctgggaaatatgtttccatggaagaccatcgcctaaaccgaaagcattttcgtttttgccgtctacggtttttgtaggagcaaatgcataaactatttgaatcatttaaacctcagcaaaattcaactcgttcaacattaccatcttcccacttctgttgaagctcttggagacgtttgatagcgctatcgatattggacattgcacagatagttacccattcacggccatcccaccaaatcaaatcatcgtaatcatctactgcgaaattttccattaaccttgcctcattccacacttaaaacaccggccacctaattgccataggctaccgccgcagtacttacaatcccagtcagttaaaatccacatgacttgtacccactagctttaatcatgttctgaagagttttaaacccttctttaatggcttctgaaatttcctcaaatacttcctttttaagaatatacaacgaacccgcttgattgccagaaagagctgaaatcacaacttggtcattaattaaaaattcgccatatgctgaatcaattttacctgaaacctgattgcctcgggaatgagggtcaaatacgagctcaatatgagttactccaggaatttcatcaaattggcagcgaatgttaacacgcggatatcccgttacactaaatttagacatataaaaataatcctaatataatgccgctaataaaagcggcagtaacagaaattagcaaaactactaattcagcctcaatcatttcttggccttagcaagtttaaatgcttttttgaattcttcaacatcttcaacaggaatccaaaagcctgagccatacccatcttcatagcatgggcagttatcacagtaatcattccaatagacagtttcaccacccatagtgaatggagcttccatttggcacagtacttcttcaacacgctctaattcttctgggtttttatcgcaaatgcagaaattccatttaccacgatattcagaaccaagtttgatgctttgacgttgaagtttcatttttattctccagtagattatggagctatactatcacaagcatagctccttgtaaactactttttgaaaacttttttgatcaagtcaatcatttcttctgcattttctggggtaacgatcaagtccaagcgagtaggaccaggttggattgcactaccattttcatataccggttcgaagtatttgaattcataatcagagatttcaaagtatgcgtctccaaatccttcagcgtcagcagttgttccatctttaaattttacttctgtgatgaaactattatcttcgtcgagcattttagtaggaaagaacgaaccaccatgctcttcaatcatcaagcgcatccggcgatttccgctagatgaaaggtcccactcggcagcaagacttgggataatgcgatattctgtgttcagtttcataatttacccgctaaaagtcgttaatgtatcttcacggcattcatcatccatgccaggaaaatattcttgttcaagccataaccatagtgtaggagtatcaccttctaccgtgatttcgtttcctccccatggggcagatttgttactaacttcaatcaaaccgtatttttcaatggtttcaatgaagtgttcataatcatatatttctacagtaacctgtgccattatcatttcctcaaagtggggaccgaagtcccccaaaggtaattattcttgccagtcttccatcatccaatcgatatcgtcccattcgttggcttctaaccaagcacgaaccgcttctttagaaccacggaggtcaatatttggccaaccgccaccagggccttctttaataactaaatcaaaatcaataccatggtcagtgtcataaaaacgtgaaccatcttcaaaaatcaaatcagtacaaaatcctgatttattgatgtaaggttctgccacgatatcaatgtttaatttacccatgatgttttcctctactcgttttgtttcgatgtagatatagtatcactcatcaactggcttgtaaacaactttgtgaaaatatttttgtagggataaagaaaaagggacccgaaggtccctttatattagaggtcgttcaaaatatcattcagatcgtcatcgccaacactgtcaccagcatcgcccattatatcgtctgcggaacgagaagaggtcggtttggattcaaaatcagacaggtctttgtcaaaggaatccaggtcatcaccaattttatcggcttgagctgctgcttttgccgcggcaccaccaagagctgctgtacccataatctgtttaaatttggcttcgttaacttcaaacgatttaaactgagatggagcaacaatttcgctgaggtcagccatattttcggtcaggaatttctgagtttcttcatcattgatgtttgcaatctcggactgaccaaggaatttacattcatcatagttctggaaaccaccgactttcttaactttcatgacgaagtttgcaccttcatacacacaagttacatcaaccggagtttcacccatatcaacatcgacttcaaccatcgcgttgattttgtccataattttctgaccgaaacggaatttgaatactttaccttcgttttctgggttagccgggtctttaataaccaggatgttagaccagaaagaagttttacgtttcagaagcttatattcagctgggttgctgttataagaatcgtttttactcagatgagcacaaaccgggcaagaatcaaaatcgccgtgggtagaagtacaattttcaatgtaccatttaccgccgtgtttgaaaccgtgattgatcagttttacaaacggcagagagttttcatctttaccaggcaggaagcgaattactgcttgaccattaccagcattatcggtcttcagtttccattcgtttttatcttcattagagaaagaagaaccacctttcagaccggccagttgctgttgaagttgagcaggattttttcttttgaacatgatttattttaccttgattttatttagacagttatttgtgtgacgcgctattgcatttacagaaatacttttcccgcacactggacagttttttctgggcattgttttacctttcatgccgcaaggatgaggttgtgtttgatgtcgtttcttagcaccatcactccaagtttttagaacttgtttacctcttgtattatttattctatcaccattttcataatagcgatgcaatccatttgaaattaatttcttatgctcttctgtctttggaacatctgttaagagttctgatattcttttacaatgatgttcagaatttttctttccaaatctaggagcattttcaccagaaccaccaaatttaccggaagcagtagataaattataaaatagttctgatttagcaacatcataatgtttatgataaaattcttcttcgtcaagagcgttatcacatacatgtagtattttaacatcgggtttttgaagcgaaattgcgttcaaaaatctttcttgttcacatgacgaccaatactcaatatttctgttgtcaaaaataacaccattgacaaaggtgcaatcatgttttgacccaatataatagtaaggtggagttttattctttaccctatcagtaaaggtaaaccaatatacgatattcattggataattatatactaatttctttacaagatttgattatgctaataaagagtttcttagcttcagcaccgtcaacgtttaaaagttttttataagcttttaatttagtagagtaattactccaaactaagttatccgttgcagtatcatgtgtatttattatatctaaaaacgagtcaagcatgatgaatgtctcgaaagatataacgtttgactgcagaagtttgaacacataagatgttccgactttctcattatattcaaaaatatcatgaagcttatctacattaactttcttggcaaaatagtaaatgttctttacatcttccgagaacgttgttttaatctgcttcaacttacctatatattcacgataaaacacaagggcatcagcatcactgatatcgccaatccaagcatcttggttagctacgaggttactcatgaatatcagtgttaactcttttaatgtatatttctcagcgagtttctcaaagaaatatttgtctctacgcttttgataagctttatcagagacccgcataacccagttatacttaacaacgtcatatcgaccggcaaagtgttgtttgagcattaaatataaaagataaacgctcttaccgttaacgtatctgttattatttccaggcatgcggagacgaatcataataaaaagtccagactattcgttttgtgtgtttgactaaatgatggacgaagcatattttcttccaatgcttctgacataattttttctatgattgctggaggaatatatctattgaagtttccctcaggaatagaattttcttctaaccactgagttgttgcttcaagataccccattccaagttctgttaccatagactcaatagtaaatccgttagcttgcttatctaacagctgattaatggattcagagggggaggtatccccctcgtctttaagcgaaaatagagtcataagcttctaccacttcatctttttcagtttcaaaacgatcgcgtgtgcctttatggaacagagcaagcagttgattaaacagtttgccttctacgccaagttctttcttggcgcggtctttaatgtctttgttaagttcaagatagctttctgctttcaacttattacctgaggcttctttaatcatatctcgcagagcctgtccatgtaccgcttcatcaaatactacttgctctttttctttcttagccattatattcaccttaaaagttgttaatttctttcattaatttagacagaccggatttaacaaagtagctataaattttgccacgacccggtaattgatagttattataacaatctaaaatgttagcaacaatgtcttcgcggatgtaatcaaaatcgattaacacgcggttttccaagaaacgcttatactgttcttcagtaagcaaatctttaatgttttcgccagcatcaagacactcttcaacaaacgtcattttcgttgaaggagtacgctcaccatcaacatgagtgtaccaaaaatctgaacgaactttaatagaagcgacgttatctttcttgtcacctttaataattttaaccatacaatctaaagcaggagaaccggttttagattttaccagtttcttctgcattggtgaccattgcttaacattaggatacttatgcaattgagtaaagtcaccatccgaagaaacaatcatgactggatggccttcgagactgaactttttggttaataccgcaatgctgtcatcagcttcagctttatcaatatcaatgacataataaggcatatactgcttaaattcatcaattacagtacgaagaccttcaaagtatccatcccagtcccaattggattcttcacgggctttagcacggttctttttatagtaatatgctacgtcccgacgccaatacccattaactgcgttatcaacgcagatgacaattttagtgtatccatctttcttccacttaaaagcattaaattttaaagtagaaagaataagatgacgaaccataggagtggttagtttgtcaccttctttatacgtatgaagaattgtcgccattgcaatttgtgacaagtcaattaaaatgacgccctcttttacctggtcttcttcagcgaataagcaatttaaatcagacatttgaacctcgttcaattagttagtacagccattataaatacttctataatgaagcataaccccataggagactctatgagcgatttactgaaacaacatttccgtgcaacaaacggcttggacgcaggcggaaataaagttataaatgtggcactagctgaccgcaacgttaaaaccgacggcgtctccgtcgagtacgttattcaagaaaacactatccaaaaatatgacccgacacgtgggtatctcactgattttgctgtgacttatggacgtcgtatctggattgcaaataaagatattccaaagcctgctggagattttaaccaggcgaattggacttctttacgtgttgacccgaactggatttataccgtccgtaaaggagagtttgaaattcaatctggtcagttcatcaacgttgactctaacgctgcaggtaatgctacattactgcttccgttagcaccagatgaaggtgataccatcgtagttcgtgatattggcgggcgtcctggctataacggaatcttaattaaagcacaagatactggtgcgtctatcgtatttggtgaatcgcgtctgcgtgaggtaagacttacacgtccgtattcacaaattatgcttacgtttagtaatggtgcatggcgtgcaagtttaaccgattttggcgatactgccaagatggtagttccgaacgggattgttccgacgcaagttcaggcaggtgataacgtagttcgtcgttatacttccaactcagagattttcattactctgccgttgttcgctaattcaaacgatatcatcaattttactgaccttgacggtacatcgccaattaaccatatgactgtgcgtacgtttgacccaactatctcaattgggactcctggacaaacagaggttcaagtacgtacttcaggtaatgggtttttggtatatgactcgattgacaaaatctggcgtatttttgaaaatgatttacgcacccgagtaagaataattacttctgatgttactttaatgcctaatgagcatatttctgtatttggcgcagataacaatactgttaaaacaattaacgttactttgcctacagacgtagctgttggtgatactgtcacaatcgcaatgaattatatgcgtaaaggacagactgtagtaattaaagcttctgatggtgataccatcgctagtaatttgaatttactgcaatttccaaaacgctcagagtatccacctgatgcagcatgggtgcaatcaagctcaattacctttaacggaactacatcgtatgttcctgttcttgggcttgcatatattgaagataaagcatccggaaaaagctattggattgtaactgaatctgaccctaccgtagaacgagttgatgctaaagacaatacaactagagctcgattaggtgttattgctcttgctacgcaggctcaagctaatgcggagtcaaacccagaaaaagaattagcaattactccagaaaccttaaatggacgtcgttctactgaaacccaaactggtatagcaagaattgcaacttccagcgaagttaatcagtcaacaactgcttcttacttggataatgtaatcgttactcctaaaaagcttaacgaaaggtctgctactgaaacccgtagaggtttagcagagattgcgactaatgctaaaatggatgcaggaacagacgattttacaattgttactcctaagaagttgctttatcgtactacatcagattcacggttaggtgttattcaattagtaaaaactggtggtgctcctaacacaactgctgatcgttcttctgctggcaccggtatattcgatcattctgattacaaaaatgcagttactccaaaaactcttcgtgagtataaagctactgtaaatcagtcaggaatagtttggttagcaactgatagcgaagttagaaacggaactccggcttcttcaaatattcctacagtcgttacaccagaagctttgcataaaaaagttgctactgacggagcaattggattaatccaaatagctacacaaactgaagttaatgctggcggcgtgactaataaagcagttacacctaaaacattaaatgaccgtacagcaactaacgatcgtactggtattgctcgcttcgcgacacctggtgcccagggtgaatttgaagctggtacttcaagtacagtaatggtaaaccctaaattactgttcgataaatttgctaatactgatcgtatccaagttaatactagttctggcttaactattactgggaacctctgggaccattataccatcaacatacaggaagcaagtacttctcaaagaggtacaaccactcttgctactgctgctgaggttagaaccggcaccgacgccaagaaaatagttactgctgccacgctacatgctaaaacagcaactgaaggagctatcggtcttgctcagtatgctacacaggcacaagttgatgcaggcacattaagtgatagaattgttcctcctgcttacttgaaacagactattcaggtaacagagtcatggcaagctacagacagcgttagagggaccgtgaggctatctacaggcgatggaacgtggaaaggtaatgataccaatggctcaactcttccggataacgggtatgcctctaagggcgtcgcagtgtctccgtatgaattgaaccttacactgaaacattacttgcctcgtctcggtaaagcctatgacacaggaatgttaggtggtcaaaccccagacaaatatgctcgtcgcgatatcgcgcagactatttctggagcttggtcatttagtcaggacacttcatttagcaataatatttctgttcagaatattatatatgctaatggtggtgaagtgaagatttctccaacagctgatactggaaatgtgcatgttcgttttcaaaatagagacggaactgaacgcggtataatttatgctgagccacagactgcttcagctggaactttaaaaattcgtgtcaaaaacggaactggaactactgctacaagtcaaacttatgtatttggcggtaacggtacgttagaagttcctaatgaagtatcaactaaaactctgaggtcttctggaaatgcaatagttggcggaactgttatggttaaggacgttcagatgcttgctgtcgagggattgaattcaatattcggtgcccaatcacagtccgcatttattcgttcccgtgacgctgatacacaaatttttgcacaggattcaactggatcgtatccaattttaactaccaaaaactatgcaagactagctgatggccgttatgtcaagaaagctggtgatacaatgaccggcaatcttaacataagcggttctgctatcgtcattacaggttctgaatcatggtatgtgccaacgaatgaaaccgtaataagacaaggttcttggactgctgaaattaaagacgctactaagttaaaaggccttcgtggttatatggttccaatcagaacaccgattgacccgggtaacccaagcactttggtagtgaccggatatgaagaaaagactgctgctggcggtgttttaactcaggttggtgtaactacaaacaatacttatcagctttggacaccttatcctccgacaaccgaaactgctgataagcgtttcgcgcatactgtgtggatgaggatttataatccaaaccttaataagtttgatgattggatgcgagtgttcacgtctgctactcctccgactgcagctgatattggtgctccgagctcagtatcaactcaggttaaaacccttgaagtcctggaatggattaagcttggcccagttaaaatctggccagaccgtccaaaccaaactctcaaatttgaatgggtaggtgattaatggctgaaccaattttaatggcagcctttggcgaggatttcgtggaaacacgaatcctctctgaggcaaactctgtgaagtattggctaaaagcttatgctacgcattctaatgctgttcctaataagccagaattgaatattaatggtgcctttgatatgacctcctccttacggagggggattaatgttgttcaagttaatggtgacagttttattaactttaaaacatttgacgttaccactgatgataataacgctaataacaaagcgtttgtagaatatgcaaatggattaacgtcaggattgtatattataatgacacatgaacgatttcaatccagtccgttaatagacagatggtttaaaaacaagtggtctgcttcttggccaggttctgatttttccaaatcatttccaaactctgcctatgttggagtgctcggagcagcaaaaggacgcatattaattgagtcattttacggaaatgatggtgtagttaaagaagattccagagctaaagtagatactgtatatgataacgttggcgatgtaggatatacaggttgcccttatcgttccattgaagacactaatgagtactcggattctactggatatgaatataaacgttatccagtacaaaatgaatctataagcaaaatagctgattatggattatctcctggagattctgtatttttagtatgtgatatgtatgcatctaaaagccttcttgatgcgggttctacaactagagctagcttgcggtggttcaagggtacatctttattatcttcaaacgtatcattagaagttccaaaaaatggagctgatagatggttaagatttgaaagatttactgctgttcctacggacgctgatggatttactattgtggtatcacgatatccaaaaacgtctgtagttggtgattctaaaatcaaaaaccttgtatttgttcaaacctctcacagcgaaaaacttaacagtgttgttcaagagtttggtgtgaatggtataagaatgaataaaggcgttgaaggagaaaccacagtgattatggaacttccaaattcaaaagtcgatccgagcggtgttattccagttcaatcgttcagagaaacatcagactaaggaagccttcgggcttccttttttcgtataaatagaaaatatataagaggataaactatggccgatttaaaagcaggttcaacagttggtggaaatcctatttggcacgcgggtacttttcctcttgtgccggcaggaaactccctaacttatagaggtaaaaaggtttatactgagatagataaacctcaagcaaatgataacgattttgtatctaaagctaatggtggcacaggttctcaagggttccaaaaagaagttgaatttaaagctggcgttaagatttccgcaacgttttctggtggttcaaacttaaatggattgtattctggtaacggagatggagataccagagaaaaatctaacatggatttgcgttcatggtacggtatcggtatttggaactcatgtacaagtgatggggtccaggggcgtacaatctggttcagtgctaggcgtggtactatcggaacagttggtgatattgtttcaggttcccaagttattgctaatgcttctactccaacagccgctcagcatttaactcgtaaagattatgtcgatgggcgaataaatactgttagcaacgtagctaacgcagcagtcaagaaagctggtgatactatgaccggtgtacttagggctaacgctggcgtagttatagtaaataaagcaacatccggtgaatatgctcctagattagatcaggttatttcacgcggggtaacaatagattttggcacatactaagaggtagccatggccgatcaaaacttaaaacaaatacaatttaaaagaactagcacagagaataaagcaccaggtgcagatatcgtagcccgtggcgaaatagtgttgaatacacatgggcgtactctcgctatctacaccaaagatgaagccgataacgttgttcagcttgcaggtaaaggtgttcctttcttagatactgcaggtaatcttaatgttgatggaactactacgttaaaagacaacgttactatttctccgaataaagcgatcaattttgaagcttctgatttaagcggagcattagtacgtcatatcaccggtaagtgtgctaataatgatggctggtacattggagctggcggtgcatctgaccagggatttcttgaaatcggtacgtatgataacggaaatgaacctatctattttgttcaaagaaccggtggaacgactcaagctgaagttcgtcgtttagcattattagatgggtttggcgatacctctatacctggggaccttcgtttaactggtaaaacagtaaaaatttcaaacggcagcactcttactttggaaatgggtgtaggttctaatgacgcttatattaaaaaccaaagaggtactggcgttcttcaattaactaatgacagcaatttaacgttcagaaattcccaggtttattacgccatgaacggaagaggtcctggtaaatccggtactcttctgacgaatgtagaaaacaatcgtcaagcctggcaatacacaatttcagctgcaactgccacaaccccgcgctgggttaaagtagctacattgaaacacccaggaatggcttcttcacaactggatttaatgattacaggtggcattgattctggacacggaagacattatgttgattttatcacgttatcaggacgcaatttaacatcctggagcactagcaatttagataactgggttgaatggcgcaggatgggttctcctaataaaggaaacgttccagaatattacgttgttaaaaacgatgctgctacagattcagaggcttcatttgatttttacgctaaagttcctcgatacggcaatgggctttatgtcacagtgctgaacactgctggatacaacggccaggatagtggtaaagtaattatctatgaaaccaatcaggacactggtgatactggaccgtccggaagtattcttgtttcaatgaaacagatttttgatagtttagcaaaaccagatttcggtgataccacaggtactcttccggttaaccgtggtggtacaggtgctactaacgtaggagacgctcgaaataacctgggtcttagaactgcggctgttcgtgatgtcggtgaatccagtggaaacgtgatggaagttggtgccttcggtattggtggtcacggaaaatcacttgtagatattacttctgacgttgatttaatgactcgccttaaggctcttggcggtacaacgtttagagccaacgtagcgagtggttataccggggctccttattattcacatggcgcaggtttcttttctagaactggcgatacaatgtctgcgcttaatatagattacgcaactggtaatgtcagagtatttgctataaacgatagcggtttagcaagtggaagagtgaatgctaatatgctttacggtacagcaaacaaaccaactaaggctgacgtcggacttggtaatctgacaaacgatacccaggttaagaaagctggcgacaccatgaccggtgatttaactgctcctaacttgcatgcttctggatcaggaaccgcatcgctttatattaatgcgggaagcggaaatgctcatatatggtttagaacaaacaccaatgaacgtggtgtaatttgggcaactccaaatactgctgatttaggacaaattaatattcgtgcaaaaactactggtggtacttctgctggtgattttagcttccgttctgatggcagatttgatgttcctgtagcagttaaagttggtggagcagcaatgctaaccaaagacggaaacatcacctctggttcaatgtttggcggtaatcttaataactatttgaataccattaaaaacgacattgttgccggcgataataagcaagtaagtaagactggcgatactatgaccggtaacttgactattaacgctaacctaaaagtcgaaaatcctaatggaacatttgttgatttgggttcagagaactcagacaaatacagcagattgacccttgcacgtaaagttggtgatggcgcttccgtagcaatgcttaaaattactcctgaaggatacgtgcaatttggttatcaagatgcagttgctactccatctcctagcaagtacatccgagttaaatctgatggtcttgatgtagaaggggacttggtttttaatcagacatatcgtggtgctgaaaatgcagttgatatttctgataagactaatgaccttaacaacatggttattaaaggcagtgatttaggtactcgtctattatacaagtgtacttctaccggtggcgcttctaatatattgaacagacctacatctgatggtaactttgttcttgaagttctgtctttgcgtaaaatttctgatactgactggtcatgtaagcagacctttactacaaagaatggtaatgttgaaggcacatatgttcgatactgccaaaacggcacatggtccgcatggaaagaggttgtcgctggtgttcaaccgattaatttaggtggtactggagcaacttctgtagctgccgctcgtaataacctcggtgttggtgaatggcaatctgtggcatttggtgtattgaatgtcaacggcgttagtaatgcagacccggccatcacatttaaaaatggggctatggttcgtgaagcccaaggtggtagtctcggcgcgttaatcctgtcggcttctactgcatctccagacggcgcgaaatatattgcttttcgacccttcggtgattcgtctggtactgagattagagtaaaagccaacgggtcaagtgagtcactacttgaatggtcttatggcccaggtattcgttcaaattcatctggcgcttttgttatctacgcaaaaacaggtcaggcactccatttaagaccaaacggtgataattctaaccaagccacagttattgaccaaaatggtaaaatgactgtcggtggtgaatttgaggcccagaactcaaaaatcactggtaatttgaatgtatctgaagataatagaatgattgttcttggcaaaaactctgatattggtttagtcaagaaaagtggtatgccaggaaaaatggctatcggtaaatctaactcgtttactattatggtatcaacaaataccaacaaccaaattaatcctgctgatacgtttaatgacatattcaaagtagatgctgatggaaaccagactgtttacggaaatgcccaagtcaacagacagttaactgtttctagttcagctactgttaatggtattattaatgccaacggaggtattattgttcctactaccaagtatgtacaaattgccgatgctcctacgcagaataaccaagcaacaaataaacagtatgttgatgataaggttgcttctgctattagtaatgctggcgacacgtatcttccattagcgggtggtactgtaactggtaacttgattgttactggaagccagttaaaaagtacatcactctgggttaccggtgatgctgccgttaatggtgttttaactgttgacggaaaggctagatttaatcaagagttcagtgtatctacttcagttaacgtccagaacgatggtaatagccatgtgttcttccgtaaagcaaatggtacagaaaaaggacttctttgggctgacgaccctggtaacgttagtataagagcaggcggcgccattgggccggtgtggaatttctggagcagcggttcctgccaattcccaggagctatttctaactataacggaattagtaccactactaattatcctgcaggaaaacctaatggtacatataacaataccgcaggactagtaactagatttagtaatggtgcttatgcttcaatatacttccaagagtatgtaggaaactatcaccaggctattcttaatgttaacggatttggtcgagacgacaacttctttttccgatccggtggcgacttcttctgtactcgtaatggctcttttgataacgttgagattcgttctgaccgtagagccaaatcggatatcaaagttattgaaaatgctttggaaaaagtagaaaaactaaccggtaatacttatgagcttcacaacacatccggtggtactactcgttctgcgggtttaatcgcacaggaagttcaagaagttcttccggaagcagttactcaggatattgaagcagacgggggtttattgcgtctgaattacaactcagtaattgcacttctcgttgaatctgttaaagagctttctgctgaggttaaagagcttaaatctcaactgaaataatgtaaggggcttcggccccttttaggagaaataattatggcagtaacaggaccatgggtaggaagttcggcaaaggccgttactggtgaaacctggatggcccaggctggagcaaaattgagattggggacacccttttggatgtccaacatgattggaagaaacgtctggaatgctagaataactatttctggtaacaacccagctacaggacctaaggttcgtggcgcttggaaagataagaacagtgcttcatggaacgtgttactcgacgctcgtggggctttatcaggaatttgggaaactgggtttaatttggttgcctttggattatcagagccaagcaaaacgtttggttataatgacgcaattgttctagaaggcagtggaaactttaacgttaactggcgagttgatactgaagacggtaatcaattccattttaatagctcccgagattaccgaggaagacgctgttatagctgtacagacaacaatgctttttggaactggctttatgctaatgatggacgaacattccagctgtcgtttactgcatattaagcataagttagagcaataaatagctctgtaaggagagcaatatgtcaagcaaacaatcaataccattttttgatatgtttcttgggttgctcgagctattattcaaagatggagccacgggaagagttctcttttcccgtgtttttgttgtcatacttttagcattgttggcgtttgctggttataagtcagatagtcttattactgcttacgtcgatagtacatatgacaagtatgataaactggttcaaaaggatagggatacccgatttgataatacagcactcgaacaactccagatagtacatatctcaagtggtgcagatttttctgcggtctttacgttcagacctaaaaacttgaactacttcgtagacttaattgcttatgaggggactttacctagcacggtagattctaaaaacctaggaggatatccaatcgacaaaacgtctgctgaatacagtacgcatttatcgggtagatatttttggacggataaggaattcgttttcttaccgacaaaaagaaaaccacctgaaatatcgtacatgtttagctgtccgtatttcaatttagacaatgtttatgctggaactgttgaaatgtactggtacaattccaaacctgcattatctaacgaaagactaacatcgatatgtggtcaggcggttagagctcttggaagagctaagtgattacttattactatgcatagccatcgttcgatagatagactcaaatccctcgttgtattcttcaacgagaattctcttctcttcgtcagttaactcagaaaccattttacgaaagttgctctgatttaactgacgcccctgctcgttcttgattccaatttcattcaagaacgcaataaattcatctcgcttctccatgatatgttcagcattgaacttagtcagaatagaagcaacagtaacgatttcttggacaatttcaaacttagtcattatttttcctacaacataatggattatgtgattatagtatcatcttgataccgcgttgtaaaccagtttatgccaattcccaacgagaattcaaatcttccttggtagtgatatactcagcaccagaggacatccagagcccgtagcgaccatcttttactttagccgttaaataccattcctttccaattggacgaaccctacgattcatccagtgacatacgtcaattgcctcctgaaaagacaagtcaatcagacttccaagcgcgattttattcattaacgcttcgagatatctttgtgattcaacgacagattctaagttatgactcatgctaaaactacctctccacgattgtctaaaacacgttcaatgtattcaactgcatttataatgtcacctctatcctttgccttaatagtaataattccatacgtataaaagtcggctgacaaactgaatggcttagaagtgtcctggttaaacgtagacattactgcttgctctaagtgttttacttctaagtcattagcccaagagctaagaactttaagcctaacttgtaaagtgtattctactttaattgctgaaagcaattcaacacgtttatgatacgccttggcttcatcttctctgcgtaaagtttcagtattcatagataatctccaatatcataagcatcaacacatttctgaaattgttcaagaacttcttcaggttcaacgttagctataatagctacagtaaaggtaccattattccaatcatgtaccatccaatctccatatccaacattctgaaggtcttccattagttcagaatggatatctgctactaatccagaatggtcccctaatttcttgtggagagcttctaggtcatcacaaataatagttaaagtagtacatttggaattattcagaatgcgcattgtctttacctttgtgtttttgcttacgttttgattctttggcagcgcgctttttatctttatgcgcgcctcctttgttaaagtcattcttcgctactgggttgtacatgtgcaattacctcatttaagcagttgcgtgtaatatcaaaacgcttagcaataccacattcttggatatgtgcttttaaatctccggcatgcacataccccaattccaagataaaccgtttaatttgagccttttctgaacgatttaagctattgaagtaatctgccttggcgcttattgctctcacgctctatcttccttacattcaagttccttgatataatagtcaatatctttaatcatttcttctgtcattattttgtacatttcagcaagaaatggtttagcaccgccattaaatggatggctaaacgggcagatgtattccttatccatgagagttttcatgaatttgctatctgccattttaaacccggcttcattggtatatgtaccccaattatcgtccatcatttctaatgagcgctgaagcgatttacgttgaatttttaaaagcgtaatgttattctttaatgtactaatcattagtataaatcctctgagaataattcattggcgggtcccgatttaggacgaactgtattaacttggcctgcatgtgtagcgatgattaatgcttcttcacgcgtgaagtactcaccccattggtcaacaaatccttgattgtctccatggacatgatcagaaaccaatttatcgcgaaacatatctaaaacgttcgccatatcagcagaataatggcgagtgcctggaactacaattgttccaccagatttcaattcaaaacgatttgctgcacaaacgatacggcgttgaagtaatcgtccatcccaccaatcagctactttaaagcaaatttcaggaatactaacttcttctggttcattaattagagaaccgtgacgagaagcatcaacaaatttattcatttgttcggaaaacttgctcatttaaagaatcctttaattttctgccacaaacttttcttttcacgaataccgatttgccgaataacaggttcaccctgcattttctctaaccattccattgagttaacagcttccgccattggaacaaatttagcaagggccttttggtaattatctacatccatgatatgtttaccatctgcattgtagatagcatagcattttgtgaatttcttatcaatgtatccgataaagtgcccacggaaccatacatcccaacaatcagttgggatattagcattcaagttaactttttctacacaacgctgaagttcattcaatactttaaacttgttcattacagttccttaatagagcggatgatggtttcaatgttttcagcagtacgagcgatatctaagtaagtattgcctgttgcagctacacggcaagacattccgaggtcagtgaagtgtttctgatgctcttcagaaatcttgtaaccgaagatacggaaagtacctttgttgttaacttcaagactacgaataccgaatgtacgtttttccagaactgcgatatagttactacggtaaacagtaagttctttcagaggtaagatatcttccatctcaccgagaagtttcatcatcaggtctttgtgctcattcatgtcttcagtaagaggacgagctttacgagtattgcgtttcttcagaagttcaggcttgttctcttctgcatagataactgctgctttagagatgatgtcctgcgcttcaccagtgatgattaaaccgtcaccagatttctcgatgagacctttcttaatcagaacaccgatgtttgagtttacagaacttgcgttcatggtttcttcaaggatttcacgcagttcagaagaagtgatgaaatcctttttagctacctgaaccaggatagcagcagttttctcgttcagagcatcttcggaagctttgatgatgtaagttactttagacattgtgattctccatgatgttttattcaatttgtttggtatgatactataataacatctgctaaccagcttgtaaaccattttattctgctctctgaaaaattttcttcaaagagcagtaaaaatgctatacgttaaagatcaagaacttatcgccattctcaagtttaagcacccagaaatcatcatatacacaaagaacgacttggtactcttcaccgtcttcatagttacttgcttgaattacctgacgcataggatactcgcgattaacttcgaactcatcgagcaccacaatgttacctttgacatagtggctcagtcgagtgccatcagcttgagtagaaatataaagaatgtttttgatatcagattttaatgatgtaatcattttgtttactccgtgttgttttgatatggctataatacaacaaccgtgtaagcatgtaaacaactttatgaaaataatttagggcattctaaggagggattttggatggatatagatttatatggaaggacctggagatgacctccaggttccctagattaattgaggagcaataaaactagacctaatacggcaattacagaacctataactaaataaaattctatcatagttcttccaggtctttcagatactcagcttcaggagttgtcttttcccagtacttaacctcttgtgctaggcgttttgcttcctgagcaagtttcttggcttcatcatcagtgatgtgatagatgttcattgaaacgagtttttcagaatggtctttgaatagttcattctgttcaatttctttagtcaactgcttacgagttttaccttggataacgatgttacctgcaataacctctttaataaattgagcttttgcctgagcaagattaaacgcctgtttagtttcagctattttatgctcgattcgtttagcggtgaatgtcttacggacttctacaaaatgacgaatcagctcaccggaagttttgaacttgtcgttcagcttaccattctcatcgatgaccacaatgtattgactcattttctcaatgagtttaaaatccttcatgattttagcatgacgctgctcagggtcatcgctcaaagcatagtctttacggaatttcaccttaaagccaaacccggtcttagaacagtcatcatcatatgtgatgtatcctgcatcttccaacgggtcaagtactttttcaacgtaagaagctcgttcaaacttgtatggaatttcactgatatagattgagttccgtgaagtttctttatacacgccgtgcagctcaacagaaccgtcttcagtttgaacgatttttccgttaaatttagggaactgaacttcaggttccatcatttcgccacgaagtgctgctttagtgcattctaaaacagattcaaaactatgcggaagaatagaagttgaataacctgttgcaataccgcgaacaccattcagaagaacagttggaattaccggaagataataagcaggtggaacatgctctttatctttatgcaccggagcgatttctgtgtctttgtagattttacggaagttgtcagaaatccggcagaaaatataacgacttgccgcagcagattgaaccaaacgagaaccgaagttaccttgtccatctaatagaggatagttgttattccatgtgtttgccatcagtgcaccagcatcttgggcagacgtttcaccatgatgatatcctaaatcagctacaccaccggcgacagacgcaagtttgtggaatttttctttattaccacgagccaaatcaagggcacgagcaataacaaaacgctgtacaggtttaaacccatcaatcaagttcggaatagcgcggttttctacagtgtaaatcgcatactcttttgcttcattatcaatgatagatttcaaatcgcgatgacgaagatttgacgccttagccaaatcatcaatagaacctgcttgttttaatagagtgtcaaaaatatccattgtacctaccaaattagtgagccgatttgtactataacatcggaaatgaaaagcacaatataaatcattccgtaaatcattccatagtacaaaaccaaaagaatgatggaaataactgcggcagaaactaggagtttcttaatcatttgtaaactcctacaattttacaaatgcgctcaaacataataaatgctgcagtgaacgcaatgcttccaattactttagtggtaggcacaaggccataccacatgaatgttcctgagcaaatcattaaggccatcagaaacacatagcccatcacgaagaaggttctcattagtatttctgcaaagtaaagatgaagttatcattcagaatacgattcagctcagagtaggtctgcgcatcacttgaatgctgacgagtaaacgccaatgcaagctgacctttgccataaccagtggtgagtggtttcattttattagcaggaatccagaacacaccgtaagtcatgcaattcgagcgcagagtacgacccaactgagaacgtccagaacggatatgagaaagaacactttcaaatcctgcctttgaacgctgtttagctacaaagaaacgagcagatgcaccaatataccctgctttgccatcattgaacatcaaaaaataaaatccttcacgctcagtaatttcacgagatggagcacctgttgcccaatcaccgttacgaatagaaccgatcagttctgcgccagcgttatcgagatcagcaaaagtcataatattacgcatgttaatttcctcagttgattaaagtttattctccgataaggggccgaagccccttctactaccaaaaatatactactgccgttacaccaccaacccaaaacacaagaagacctaaagcaagcagacgatacacgatgtgtcgtttcatttttgaccttcccatacggtttctactaaggatttaaggccatcagtttgaataatatcaatcgcattaatggcaaaataaattccgaatccgaacacggtgacaatccccagtgctaccgcaacaataacagacagaacagctgttctcattaagttaaagcgacgatcaaaactattacgaaccattatattttcctcagataaatgcattaatccaaacgttaaccaaatcccatgcgaaaacaccaatgaaagtaacgataaggcagaatactacaaagatgttcttcagaatcgtaagtaactttttcattttgttctccagtttagctaacaagactatagtatcactggagaacaagaaagtaaactattaaatgcacaaattacgaattttttcttccagagctttgactttctctatgtgctcatcacgagcagcggcagctccattaggatacaacccgccatacgttgaatcaccgttatcacaagcaatgatagtataatgccaattcatagattcaagaatcttatactctttcaaaagctcagctttaatagaagcatttccgcgtttggctcgaagtgattttagctctaagtaactcatgttttactcccgttcagtttgtaaggccatagtatcatggccaatcccggaagtaaacaactttttaaaatttatgcatgatgtacccgccagcaccaactcgcgaaggttttacgacttccatgagctgttcgataccgccactgaacatcggtgtgtaccgtatgacattctgggacacttcttctgcaacgaatataattatacagtctgcgactttatgtttaaacatgggccctagatttattccacttccatctgggaatggaccgtctttaccagttgtaacattaatccatggcttatgatttgctcggtcatgaacaaagtgtgttttaacttcaactctaacaccttggtagtagggatgagctagtacgtcccaggcccattcatacggatcgttgttattatggtcaacaacttgatcgtttacgtatccatcaagaaaatccgctaccacatactctgccggtatagcaattctacatcttttaagaacatcaattctgtcttgagatggatcgatatctaaactatatcttgcagtatcaatgatttttacttttgcttcaccccttagcttattcaaatctagggtaaatgtccggagttggttcaatctctgcagggctttgttcatcaatgccataaattcctctgatatgtaattcaccaaaataaacacgatcgtcgtggttacaagtgtctggttccacaacaaaatcatcaccaagttctacaagttcatcacagtgcaaccaagcatagtgaacatcaccttcatgtttaactacatgatgacaaaacaccgtagcagcatgatgagtaccacgaagattaacaactttagaatgagatacgttaaatggattaatcatgtttcacccataataaaagaggagcccgaaggctccttataattagcgaagttctgaaccccaacgatcagttacatcttctaatactacataaccacatgtacgcattttagcgtcgttgtaatcaaccgggatagatactacatcacgcggatgaactttaactgaaacaatacggtcagaaccactaccgaagtgaccgatgtaagatttagagcagacatgcagacctgctgaacaagtacgctgatcgtcttcatctacctggttacgcggcattgtaacagttttaccgggagagttatcaaacgtgtttgaagcacagtccatataagtggaacgaactactttccaaccaatgaagtgaccatcatcagtgatgtcgatatcgtttgcattcaggaaatcaaacagacgataaactgcacgacgagatgggttcagcatcaggttttccaggaaaggcagataacgtttaaagtcttcgccatcttccatggctcgaacgatacgctcagtcagaccagatttcagctcgatatctttatagaataaagtaccatcttcaattcggacgttaccctgaacgaatttcttgatgccttgttccaggttaatgtggtcaatagcaccagcgatatcaccatctacaagtttctgcagtgcagatttaaacccaggatgttggctatcagcgttataagtagtacggccttcagtaattgaaatgaatttggaacttgctgcccatttaaattcacgctcaactggagcttctactttagcaggaacagctgccgcggcagctcgagcttcgcgttctttaaacacacgccgaatggtgtcacgggaaacaccataattctcggcgagctctttcttagtgtacagaccgtttttgaagtttttaacgattgcatctttttggatttcagacagacaggtaacagccatttattcacctttattttcagaattttgagtagaagctccatcaaggagctccatgatttttacgatatcatcgacgagtttgctgtcagtccgccaagtatccaagacacttgcgatgacaggataatcatctttaaactgttcaatctttttatagaagattgtctcagcatcaccagacagtttattataaattttattacataaagctaaatcatcgttttcatctttgattttactggtacggcaaaccttagcgattttgtttagttttgtcaggaacggatttttcattccagacgcagtaaacttactcgacaagaaattcaatttatcgtaatgcgcaatatttccacagatacggtttccagtagcatttgatggcatgtactggtcataatctaccttatcaatacacttgatgtattggtcgataataaatcggtcaaatgaaagcaatccatcagcttttgccgcggctttcatagcacccggacgaattgcatagaatttcttaattccacacgcttctgccagagaccgcatatctgtgatgctcatattccaccaccaaacattatctgggaaagtgtggatttcatcacgattgcgaccgattgcataaccttcaagctcagcaatttcagatgatactaaagtctgacggtcttcttcccagtacccgtctttatcaatccaatgcagagaaacattaggagattttggacgtttctcttttggaccagtatcataatcaggaagagcttttctctgggcttcaagttcagacacacggaatactacaacttcatcagtatccatgattttcttcagctcatcaatgacatgtaattcatcttcattgtctttgattacagtaatgtgtgcccagattggaactaacccagatttacacagagctcgaaccgtagcaatacgcttacccgctttatcgtcaataagaacgaacgctttagttctatcaaccccgcaaatatcagaaatgtttacttggttatgacgatgccaagaactgcttgacactttacgacgagcaggttcatcgcatgaaacataaactgatacttcgttgtctacataatatgaacgaattttatcgagattatacttcgcaactacttgtttaatatcgcggttcccaatggtaataccacggctctgaagaatagaacgttccttagaactcagcttattgaactcacgcaagaattcacggtcagattcatacgcttcaaacgctttaatatctgcggtaattacctcttcttcaagagcattcacacgcttctggatattagcaattgtttcttcgtcaagagaaagctcttcacgagatggagtaatgtctaattcgccaagagggaaatgaacataaaccttgccataacgattaagcagccaatctgccttaacatctacaccgctgatcggatatacgatttttccataaactgcatacagaccataactttcgtaagagctattaacgctgaaccagtcggtcttatctaccgggaaatattcaatttcacggcgaagagaatctacctttggaggtacagcaccaaaggtacgcaaaatatatgcgatttcataatgccaagtatcaatatcttctactttaaccggaacagtgatttcaagaccagtttcttcgtcttctttcatgtcatcaacgaacattggacgaatagtaggttcgccgcggtttttcatgacagtataacctgtagctttaccatcatgataagacactacgttaaatgtactcgtatagcttaatggtgatttagaaccaagaccaagagcaccgatgaaatcattactattattctttgtggattcaaagaacgttttgtacatcgtcatcatgtcattatgattaagacctggaccataatcacgaattacaaatcgtgggtcaagacgagtaggagccttgatataaaatggacgattttcattaccgttcagtttatgagcatcatcacagttagtagaaagttcacgaacaacagcacgaactttatacttatagagtttgtttgacaagatgtcaaaagctttacccgaggccttaatagtaaacgttgaatcatcagcgtcagaagaaccaatgattacttcatcatcacatttaattttcattttattcctatcaattatgtcgtttaatgatttctgctacttcaagtaactcttctgcagtagcggtattagttgtaaaaattttattatggatttctttgaagcgttctttgaattcctcagctgcttggatgtcaaagaaccgctggatgatacgatattcacgatatatagcatcgttgaataattcttctgatgggatgtaactacgtttcataatattttcctcagtgatttagggaaattatatcactataactttaagcaagaatcctagaatcatctccaagcacttcttgattaaagccatataaatccattcttataaagaaaaagggacccggaggtcccttagattaccacaccctactaactcgaccataaacctcatgtttagaaccatcaatgttttccacccagatagtaacccaggttccgggcagaggtttcttttcagcgaacagatatccatagtcgcctgagatcaaagtaatccaataacgttgcatgttaattccttctaagtaagggcaatagtacccttactatttattctttattcactcatccatgtcttacgtggtgcagcatcattacccataattaattcaaacagttctttccagttttcaggaagagtgactacatcataaaccgggtcttgaataacacgttcgtattcatcttcttcaagagagccaagacctttaatataacgaagtttccaacctttgaaatcatctttatggtcttcatattcaccaagagaatagaaccaacgttgttctttacctttggtgagaataataaccggagttttcacaaagcggattcgaccttgttcaaataattctggccaattactaaagaacgccaaaagacttgggaaaattgaaccaacaccatcaacgtctgcatcagtcatgatggcaatatttcgatagttagtattttcagcgggttcaccgatagtcaaaccagtgattgcacaaatgtcaaatacttccttgttcttcatagcatctgcagcagacattccccatgtattcatgaacttaccacgcaaaggatatccgccatgaagttcacggtcacgagttgtaagtagataaccgatcgcagaatcaccttcggttaagaataaagttgtgtcagcatctttaccatatttgttggctttgatgtgcttagctactttagctttctgcgctttcttggcagctttagtttctgcggctttctctgcagcaagtttacgagctaacatcgcctcaataatcggcatatgaatatcttcggatttcataatagcgttagcaagtttcttataatcaatatcaatatggctacgaatttctccccaaggagaagtcagacgctctttagtctgagaatcaaatcgcatgttagacatatcacgaataaacatgatgacagtcagacattctttaattcgcgctttattaacttctagtttgtacttacgctttaatgctggaataagttcattgctcagttcatcaagaactaggtcaacgtgagtaccaccgtttttggtgtgaatgttattaacatatgaaagttgacggaacccgtcatccgaacgaccgatggcaatagcacaagtatcagaatcctgcactacagcattttcgtcatacatgtgggcgtaagctttaaacttgccttgaacccgtttacccatgaatttaaattcaatatcaggataaactactgctaacgtcatcagacgatcgtgaatgattgattggtcaacatcagtcaatcctgtgctttcaaagtgactgaaatctggaatgaatgatactgcagtaccagtcttatctttgatgaattctttatcttttgctgggtgttcttcccaggagatattttctgagccgttagaacaacgaacgatgatttcatttttaccatcgcatgttgcaccagtaaaagatactgaaaagatgttggttaacgcagaaccgacaccgttcataccaccagttttacgctcagaatcatcaccaaagttaccacccgcacgaggacgagtccatgcggctactggtcctggaatagtttctccttcaggtgttactacaggagcctgcggaagaccacgaccgttatctgttacaataattttgttgcctttaatgtcaactgaaatcttattcgcgtgtttgaaattagtacgaatagcttcatcaacagagttatcaatgatttcatcaataagtttgataataccaggaacatactttactgattggaatttaccaaaaagaaaacggtcatgcgcttcaaacgcagaactaccaatgtacattccgctacgcttaatgatatgttctcggtcactcagaattttaatttcgttcttaatcattacatttcctcggttagtgaaggaattatatcaactattaattatagcaagtaattcttctttgatatacatcaatttaccaagaacctcatggcctcctttaaccgctttatactcgggatatcggggccgctgtcgttcaaacatagtccattgagcatcactaacgttagcgtatgcatatcgagttccgtagtactgttcaatccggtactcgttgttttcattaagtgaaatccactcttcacagacttcataatatttctgcatccaaatagtacgaccattcacgtcattaattggccaccaagcaaacctgtattttccaatagcccgctctactatttttaaatgtcgtttagcacgtctttgcgcagttgtcattccaataatcataatattctcctctggccaacaagactataataccaaaacatggtgtccatgtaaacaactaaatgacccgaaggtcatttattcataacgaattgtgctatttttgagaaaaagccctgagcacactgttccgttaacaggttttcctgttggcccaatagccgtaaagcctgtgtgctgaaaatcatcctctgagcaagaaaagaacttatatccggtgattttgatatcagtaaatcccgcgttatctaacacgcgagttgcgttatcagcgtcagtgcatccaatcatcatgaaggcaagcgctgtaattaaaatctttttcattttaatttaaccctataagttatattacctactttaataacccggatttctccgggtttcatggtaatgcgtgctttagttcccatcaataatcaccactctttaatccatcgtagtgaactgccggagcagaaaccacccgcttcatttgaccttcacacttagggttaaagcagttaacagtatagtcacgatgggaaattttacgcataatttctatcttttttccacagacttcacacttgtaatcatacgttggcattaacagcatccttccatttttgtgttttgactatgatttgctcattcagcgcacgagtaaccatcatggagatttcatcatctgatacatgagtatcatttttatgacgatttctgaaatgcagccaaagtgcatccactacacagttaataacatctgcgcactcgccttcaaattcttctttctgccgccatggacgattaatccaatcacacatttctccagtttctgaagaaagttgcagcatgacattcccaatgctacgattaggaataggataagacatttttgatgcttcaaaaataggagctaaatttaacattgatatgcactctgcagtgctgcaatagcagcgattgcttgaccacgattatgaatagaaagattcataaccaaatcggttggaattacattcgtggaagttccaacttcagtaaagtatttgaattcgctatcaaaaattacaaggtcttcaccgccgacttcatcgcattctgtgccattagcccacgtaattcctgatactctattattttggcggtcaactttagtaacagtaaaactcccgccattttcatagagttcatacacaaagtcttcattaacctcatagcgtgaagaaaattcttcttcagcttcatcattgacgaatttgtactgtacgccttctttaaaattcattacacaatctccatgtattctgggccatcaactgtgattacacgagcaaaggtacgaactgggacgatatcaccatggttcgcgaatacatacaaccaagtccagtgctcttctttaccgaaggttttctctttctgaacaacgattaagtccgggttgaacagaacatcttcaaaagcttcagcagtaatttttacggtattttcagttttcatgttattctcctcagtagttgataagataatagtaccacatccttgtggcaaagtaaacaactttttatactaaaccttgacgttgcgattctgtcggctctacatcggctttaggcagaactgcatagttgccttgaaacactacgtttactagggttttaccgtcttcttcccactcatcagtgacaagaacatttttatgcagcgacagattagtggctgaattagtagaactcaccgattgggtaataacattgtccagtgaattcacgtgtacccacttgcgcagatagctttcgttaaacatagaatcaagcaaatcacgcgattcgagagcaactacgaatttttgcagcgaatacactgctttgtcttcattttccagttgaagcaaatatgaagacattttgttagaacggttaaagattccaacaattacgccttctttaccgatatgcttaccaccaatcactttaacgttttcgcctacaatcaaatttttcatcgtgtttctctcagtttgttaatgtagagccattatataacggctctttcataaagtaaatagctatcggtgagaaatttcacatccaacatcgacgccgaacagatacccagcttcccaccctttagccatcatagccttggccaccagaaccatcgttggagagatttccgggaggatttcccggttgaaccactcttcgaagttttcatcgaactcaaactcttccattagccacgccccttaggtaaactcagtggatcggtatcttctggacttggtgcttcgcttaggcctagagcatagcgttgagcatatttaagcattagaatatctttggcacagtcatggatactatcatgcgcgataaatccgtcgagcgtaccctttggaagaggagtagttgtcaatccgcgtgtcagaagcagtgattcaatcgcggtacgaatatcacgctgattccagaacttacacggctcttctttaaatgtatcaatttcttcttcagaaatcccttgagctctctgcacatcgcgaagacaatctacaaaaatcggaaagtcaaaactctgtccacgacaccaaccaaaggaatcccatggatgaattccattatcaatcagatactgctgggcttctttaattccagcaattactgataaatcatctggcgttgaggcaaggttagcacgggcttcagctgactgcttcttccaccattcaagagtagacttaccaaacaatcggtgacctttctgagatttcaagtcaaacttaatacgatgaccacgcttgaccaattcatcgaagctttccagaacttcagggtcagaatcaaaggtgattagagcaaggtcaatcacagaagagcttgacacatttccgaatgtttcaaaatcaataataaagtctttagccattttgagcctctagcataaatttaatttcgcgtaactggcaaccaatatattcgctcagatacacctttgggtcatatcctgtgaaccaagtaatagcattagcattatctgctatatcacgaagctcattcagaactgtatcaattttaatgttaatagcacgcttaacattatccggtgcttcaaacttagattcttgtaagccaacaatcattgtttgaaggtcttctaatttcaattcaaacatattacc

SEQ ID NO: 29 - DNA, 171719 bp, synthetic construct
  source 1..171719: mol_type = other DNA
tcacacataaaacacatcatatcgaccacgggtagtaccaacatataataactgctgtgcgagagaagcatctgccatgtgaatgcatggagtataaatgaagcttctgtcaattgagatgccctgggccttatggaaagtcgaagccggtaatgctttcactttatgaaacttacgcttagcgtcccagaactcagaccaaggagctttacctcctttattccaattcttatatgtatctgcagtttttgccaagaagaattgaaatttattcatttcttcttcggatgagatgacacagattttctctctagcgtactcttcatcgtcgccataggtttcaatatctaatacccaatgacgaaccagatattcacctggaacacctctggcacccaaaaatgtggtggtttcaactgcatccaatatgcgaacaaactgaccattattgaaaagaatttcgctgaatttcttcccttcaaatttaagttccttggtaagaggttcttgcataacaacaatctcgcctactacgaatggtcgttcagtttcgtatattcttcgtctgattatttcattcaatttgtctacagatttattcgtgaatgcaagcattcggttttcaaataaatcttctggtgttttaactaaattaaaataatttagcataaaatctttaagggcagttcctttcgtaaacccacggacaccatgaccatcaactacacagtcacgaatccatccaccatttctgatttcagtagcaacttcaatgattggagcattacttcgcatcacctcggtcaaatgaagctgtaagaaatctttatgagtgaagaatggactcagtgcaggttcattacttccaggttctaccggacgtatctgagccttatcaccaatggcaatgacaatacaccaggcaggaatagttgccatcaaaatcttaaacagcttacggtcatacattgaagcttcatcgcaaatgagaactcgaatagatgccatatccggaactttcttttgttcaaacagaacgttttcttcatatgtcgtcgggttaattttcagaagactatgaatagtactggcctgcattccgctgagcttagataaaacctttttggccccatgtgtaggtgctgccaacgcaatgccagagataccctgagaaatcaaagcatcaatgataaatttggttaaagttgttttacctgtaccggcaggtccattaatcgtaatatgttgacctttagctccttgtttgaccatttcaatgactttattaaaaatcgctttttgactttcttttaattggtcaaacgtaatcatgccacttttaccctcactacatgtagatttttaatttttgcttcgagtttttcacgctcaacatcgctaagtggttcatacactagctcagttgttttccaccaaagcattcctttggttttgctttttccagtaaaattcccttttgctaatttgtctgttaaaaccgacattgtacgaatccgtgctttattagccgattcttcattagtgaagaccacacatcgttctccatcgtacatatcagttgtgactggatggtcaaatccgtctttatccttatacgctactacatatccatagtgttgcattacattttacctctcaaaagttggaagaaggacgcagtcaatggaagaccttttttcaattttaacttatctagcattgagcatttttctaaccgacgaagtgagctaacaattagccgtattgattgtacacggatttcagcatctgatggacgattcggaactgatgctaaaatagcagataacttacgctcaactttagctaattcagacttaccaccgctgatacgagttctcaatgcattaataagttctaaatctgccgaggttgcagttccattcttttctttttgcacaaattgagaaagatgattttcgcgattacgtaagttagttttaattgatgttatagttttttcatactcacgaatcttttccaaacgagaagcttctttatcacttgttggcttaacagaatcagaagagcgaactatgcgtgccgcaatttcattcgcttttcgttcaaggccttcaatcgtattatttccacgcaaagtattatacttttgcttgacaggaataacattccctactacatatcccaagtcattattccaacgctcgagcgtcatgctatcaggatgatttcctttaacagttccaaacttttcgcctgagtatgcgcaatgtgtctgctgcatgatgttaaacagatattctggggtgagattgaactccttgtgccgacgttgagcagaacctaaagttgtaattaaacgagtataaactttagcggtttcagcagtaaatttcatcatgttttcctcaaaaatgctttcgtcttacggacggtataatgggtctaggtccctagttctagataatcactagttgactaagctatagtaacactaaagtagtccataagtaaaccagatttttcaactttgttatgaccaaccactttgaacttagttcccatcggtagcatcctttcttgttctttatcaatcatctcgatgtcagcgcttctgcgctgagcaatgttatcaatcacatcatttggtcgcatgaattcagaatctggtgcagtaattaaaagcgatttcatgttggtatgataatcaaatgattgctgacaattattgacttcaatgactacaaaggtcgagtaatgccatttgcctgcaaactctcgggcgatcgtttcatctgttgtgaatgatgctacctttccaaagtcaaatttctctcctttaataagagcgtcataaaaggctttagcctcacgacacgatagacctctatagagaatttctctgttatcgatttgatgacgtctaacgatagagtcaagtttcttatgaaattcttcgccaatcttattgttcatgcactgccacagaattgactgttctttgcagtcaaaacgattggctaatgcttcccatacgcttaaatcatataaaggtaatcctttgctttctcgcgcgaagttaagaacatcaatggagcgaatgggttcttcgataggaataacctttgataattttactgaaatagatgggtttaatgaaatagccatgatattctccattttggttacgagaggtatcttatcatggctttttggaagagtaaactactttgtgaaattattttgcccagggagaccagggcggcgggtcagaccagattgaagctagttcatctagaagagcttctggggctttaataccatacttctgtataattatacggtattcgtctttgatgtccttagaaatcactggatgaacttgaacctcttcctgaggctcttccatcatttcaaacaaatccatcacatgaaccactcagtattgcgatacagacaactactgctgttatatccatcagctgctttttgcaacagcgggcttggagcaagtttgataaaatctgcgcccatatataaccaaactaacttagtaaattctattagagaatctgtgctatcaatgataatctttttgcctcttgaaattatgtcattttcgtattcatataagctagtttcatgacatacattggtgtatcctttcaagtggagagcatgcagtatagaaacaggacttcctggaactgtatctacgtcaaagacatgagcagtcttaataatgccataatcttcagaaggacaccaaccaaatgcctcgaatttattaattaaatctttgaaatctttgtcgaacgtactgtatagagcaacagtaaaaattctatcttggtctagacgcaaagctccttttgcatcatttcttgattgaactgcgcgctgtaagcttactttatagatttttgcgtttgccacacatagctccttcagtcatgttgttgtcttcaaaccacttatcatttgctttaattaaagcaggcgcagcttttagtaataacgctgcagctcttacacctctgtaccaacaatcaaaatgagacttctttaatggcgattgataccagggcttagtataacatatcattttcttctcctcagttagtaggaataatatactattcccagtatagcataaaaggactcccgaaggagtccttaattttatacttcgccatcagccggaacagcttcaaacattttcgcgttggtggttgcccaagtagcagcatcatcaactactgttgaataagcagctttttcagatgggaaaatctgatactgcgcattagcaatacgatgcgaatcagaatacaccttaaaagctacagatacttctgtgcctttaacttcaccatcagcagttgcatggtcaaaagttttgatgtttacgtaagccattttaatctcctatttagtttacagaagtatttatacagctgctgtaaacatctttaatatttctttatcaatttctcgagtgatttcttctcgaagggccaatactaaggccctttctttttgttttctgataatttttaaacgacgcttagatattcttttagccatcaataaccactgtcttgacgagcaaagttctctgcgtttttcagataatacagcttaaagatttcttcagaatccagaccaagcgccataaacatattcagaacaaagtgcaggatatcaatcatttcaaatttgatttcaagctggtctttatcagacaggtctttgatataagtttcctgcatcttgacgtggtcagctttccatggtttccatacggcagatgctgccttttcaccgttactcataccgccaagagacgtcagcaattcgcggaattcgtcatcaatgtaatctttttggttacgcagccactgcacgatatcaccggcttgggccaattcatcaggatgcatgttagtaccaggcttatcgtttgctagacgaacctgaagagatttttgcatatcaagcattacttgcagagggtcaccaccaactttgcgtacgatacctgcgtatcgagcttcagctttatctgcaccagcgatcagttgactacattcgttgaaatgtggcatattatttttcctttcaattaaattagataaatattatatcacttaacataaatagcaggaggattcatgtctgaagtgaaacgagaatgtaaagacaaaggaggatttggaagatatctttacgtcggaatcgccactgctgctttagctgcatggaattatgtggtagttccattagctagcacacacgggctagttcttcctccaatgccgttagaaaaagttgtgtcgtttattatgactggaggattgctttaatttaaggggctttggcccctatatcttcgcatatttgtcaagacgtaatttagccattaaaccttgcgatatattttgattaatataatccgttatttcagaagcagttgccccctctttcataatcatatcatttatatctttgcttttccaaggcgacttatcccagaaaactaccttttcaccagcatctactaaacgtttcatacgcttaattgtatcaggatgacgaggttcatggtccataatccatgctcggttatcatgacatggaacttgagctaaatctaaagacccgccagtgattgcaatagcattatcaatgaacaacgaatctattggtccttccatgacgaatacgagttttgactcatcaatggtgtcgagaccataaattttggttgcatgttcatgggctttgattgtgatgtatttttgtggagcattctttcgtagtgctcgtccttgaaacgactcaatctctcctttcttgttgaagataggaataaccaaacgtggttcgttcgtctcattcttataggttcctggattaacagagttaacaagagaaggccattggttagtaaaccataaccttttccaagaagtgcttggaatacatctggcagtcacatatttaactatcggatgttccttcggaagtctatctaatcgctcgcagaaattaagtttttctattacggggagttttgcattaattttctcagacggttctacagcctttggcttatcaaagacttgttcctttcttttctcaagaagatactctcgatagaggtcaggctcattatctttaagatactgtgatagccacttgttatactcacagttgaagcaatggcagcgtaatccttgacctgcatcaaaaatccagaatcgggctttattgatatctttctgtgagtcaccacaaattgggcaacgacagtttaacttgaatgttgaagatgtagtaacgtgtctaaatttaggtaggtgagatattgcgcgaattgcatactcgttatcaacccaagacataatatttcctctggccttaaactaataaggccattttatcactttttcttggcagcgtctttatccgcttttcgtttctttggaagagtttcgggtcctttattgacgatgtccccggaagttgtacctgatgcaatattctgtggattgccgcccgcatcacctgcgaccatctcagtaacaaactctttgtatgttttcatagagcctcctactatttattcatgcgtaatacgtaagcatttatatgtaggatacagcgtcggagacattgattttggattgtctttgataagcataaactgcttgcctgtatcttcacacttttgcttaatcattgcttcatctttaccagtgaatgccatcttttcagtagacattccgcctgaacctgtagatagcgccattattaaaacgtatgtaatcatcctaaaatccacttaacaatgttgaagttatcaaactgggcatcacagtaaagaacataattcaacttaagtgctgcgccgtcgtctttaagttctgcttgcacttctgtttgtttgctcgggtctacgttttccacaatatgaccaacatctgcacgaatctgctgagctacttcagactcatcagcagtcattgaccactcgcataagtctttgtcatagttggccatggcaggaactgcagagcaacttgatactgcgaacactaaagcaagtacaatctttttcattttggtttcctcaagcagcttgtacgttaagagcagaaatcaggcgataatcaccgtttgcgtatactaacattgacacattgccatcagtgtttttgaatggctcaacaactactaaaactgtatcgccttcatctaatgcttttcgtactacgccatcacaacgcagattagcatgtggagatttaactactttgcttccaactaccataccacaatgcggtacggtttccgctgattcatctttactcttaaagactacgtctaatgctttttcaattgtccacatgatgttttcctctactcgttttgtttcagtaaggccatagtatcatggcctttggagaaagtaaactaccttttgaacaattttttcaacaaaatgtcagaggtcagattcttggtaggtaggtatgtagcagagttaacccagatgccatcgctgtcatacaccttgacctctccatagtcgcatacagataggtctgctttgttatatgcctcgatgcctcggtgaatggtatctgtggctgttacgacaaaagagtgacctgattggtcacggaccgcgctaaacacaaaaatcataaaatttacctagaattttaactcttctgccagagcatcaagcttagaacgtgatactcgttcttgacgattagattcggctacacggttctgtgcaccggcaccttctcggacggtattgcttggattaggcttagttgggtcgttttgctgctcaatttctacccagcgttgattagccttatgcacacccataaagaacttattgttgatgttcttatcgccataacgtgatttaatctgcttaattaactgttgcttcatctgagcaagttcaggagtttcaatcacagctaacataaagtctgccgtagcaggtagacccgcagattctgcaatatcactcatgtccatatcagaagcatcccaagctgaacgaccgacctgagccgcggtccaaagaacagtttcagattctacagccaatgcacgaagttcttctgcaatagctttaactaatgtgtaactgttttcagtatattgacgaatacggcaagaagcacaaataccaagatagtcaatgatgataacagtcggtttaaagttcttcttgagtttcaactcattcagaagagctcggaatgtattagcgttagcaccgccagtcggatactgtttaatgattaaacgaccaagagtactagaactacgccatttttccattttgcctttatattcggcgtatgatacacaaccatcatcaatatcgtcaagtgatacatcaagcaaattagcatcaatacgtttagcacaaacttcttctgccatttccatactgatgtaaagaacgttatgccccatctgaagatagtctgcagccaatgaacacaatcctaacgatttaccaacgttgacgcctgccatcaatacgttcagtgtaccagtctcggcaccacctttagtaattttgttcagaatgctaagtttaaacggaactttacgagctttattctggtatgataaccaacgagcttcataatcttccatccaatcatgaccaatatagctatcaaacgatactgataacgcttcacgcatgatatcaggaatagcccccatatcaggaagacgcttatctcgcttatttggctcaagctgggcattagcctgaatttcaataattcgagacgtagcgttatacatagccttttcttgaacgtacttttcagtttccttaactaaccaattcaaatcttcgggagcatcagataacttatcaataagtttctttgcgccttcatgttccgtttcagttatagacgaattatccagtgctacacacaacgcagtctttgaaggaattgctgtatattcattaacgtgtttcttaattatgttaaacaccgtctgagcaggtccttgctcgaagtactctttgtccatatatggccaaaccttcgtaaagaaagcctggttgtaaatcagattagctaagattgtttctaccactttaacctcttaaaagattttccataatgattttttcttggtctttaatgcactctggatttgttgtttaacacaagcttccacatgaggataaagttcatccttatgagcttcagatggagtactaaactcaatagttacttcccccgaaggagaaatatttaatttatgaacataaaccaagtgtgattgaccatttaattttatcacaatttcttggataacagtcttcatagcttcttggattatttcatggcttttcttgaacactcgttcttgacgctcgaagtctccctcttccgagggagattcttgttcaaatttctcgagttcagattctaaatcaaactcagtcttcattcatgaagttctctaattcatcttcaacttcagcagctgatactgaaccactctcagggagtttaacaccatcaaccttagttgaaacttttgagttaatcatttctgctaccgcttcatcaaccgcagcgtttgaatcaatagcacccaactgatagcgagctttgatagcgtcacggaatggctcatgcttaaacagaggaccccaaaattccgtactgctcgtatcttttgcccgccaggatttttcttcacgaatcatctcaccggtttcaacgtccaggaattctcgtgcgtaccatccatttttcggtttaacaacaaatccgatatccagagccatatcaagcagaccactgtacggatctataccaccatcgaatttaacatcgatgaagaacttacttttctctttgacagtacgtgatttctcggcgttcaggacaaactgatatccctcaagctcagtaccatctttaatttggcgtttaccgatgatgaacacagtatccgcagaatacataggacctgtaccaccggtcattaccgtcttactgaacatctcgatggtctcgattgtgtggttaaccgcgacacaaggaatgttcttaatagagaagtaaggagttacgatacggaagagagacttcagacttttcgcacgagtcatatctgcgacagatttctcgttcagtgcatcttcggtttcctttttagacgccatgttaccaatagagtcgataaacacgatgactttttcaccacgctcaatagcttcaagctggttaaccatatcgatttttaattgttcaaccgactgaaccggtgtatgaattacacggtcagggtcaacacccatagatttcagataagctggagtgataccaaattctgaatcatagaacaagcagactgcatcaggatacttattaagataagcactaaccattgtcagagacatgttagatttgaagtgtttagatggacctgcgaagatagtcaacccggactgcataccaccatccaacgctccgctgatcgcaatattgagcatcggaattttagttctaactacatctttctcgttaaagaattttgatttagtcagttctgctgtcattttagaagtggatgctttaatcaggcgagattttaagtcagacattcattatattccataagtctccattatatttttctcacaggttaaaggatagggtaattatattaccttgttcttgaagctattaacagaagttccatttcttcttggtgttataaaccactgtttccgtatctatttcataatgcattttacatccaacacacatgccatgccaccagcaatgcattccatctgagccagtagttccttcatgaacaaactcatcagatttacatacgaagcatctgaattcttcagccttgaatatgttaccagctacatcagatttattatagatgttcataagaggtcctttgagggctttcgccctcacagatatggttctaccttaccaaactcgtggaaggcctgagatttcactcgagtgttaatacacatacgaattgatttcagaggttcgttatcaccgaataacccacgtctttcgccgtctttagatttccaacgggcttgatttgggaaagcagcatgtagttgttcaagggctctattctgtcgagcagtatcacgctgtgtagaacaaccaccaggagactgcaccttaccagatttaacgaggtacttaaacagagccaggtgaggatgacccatgttaattaattttagaaaagcataagcatcttcgttaaggtcaataattccgtaaccaatatcttctgctgtaagtttagtcaaatcatagaaagtattggtgaacccaaaactattctcgcgataatgaccccagcttgatgtaattttgaaaatcggcaagcgagcatggccatgataataaccacaatccatagcagtctctacgtatttgaccatatcatcaaatacctcttgactcattgcctcgccgacaccaagtggaacacggcgatcgtcgcgttcacgaatttcagtcagatgaatggtagtatcatcatcaagcatccaaattcgctgccctgcatacatttcagtaatcagacggcgagtaccagcgattccatcaacatcatcggggacagtaacgattttagcagcatgaccgtgccaagtttcgtatgcttctttttctgattcacgcactacaagatgcggaacataaccttcaggaaacatagtcagggcagtaactgccccggcacgcttataacttggaattacaaactgaatcatttccactcacctttatagtctttctttgcaatatgagtttcaccagtataagcatagttatctacaagatagaaatgacgctcatacacgtgcaaagacccgacgttccaaataatgtcgccaactgaataatttttacctgatgcattcagaagtttggttaactgttccagaacatagagctgccatgcatagtcattacgatatccaaatactacatcatttgaacgcatgtttacaacagcatgaactttattatcacgaatcagatactgaacattgttagtacacatgaaatcactcatgccatcgcgctcaaaatcatactgcatttgaggccgtgtataaatcataattccgcggcgagaatcaggattactgataagttcttttgcacagttagcaaactgcgaatagttttgtgatgaccaaactgcccagccatagttagaattaatctcaccatgtttggatgcaattgctttccaaatagctggggtttcacctggaatatctttaacgaataaactttgagatttataccactcaagttcccgagcaatatatccatcattaactgcgccaaaaattaggttttcatctgcaataaatgatgcacctacgatttcaatagtcttcacacccgtcttatcaatcacaaattctttgttgagcaaagcatcagcgaattcttgacggatatcttgtactgtcattggagttacaatcatgagacctcttatttaacttgctggataataattgtattctgctgtgcgttagaagcagaccaaatcagcgcaattaaccaaccgataatggaccaaccgaatactagatttgtgataaagattccaccccgtgatttatgcttacgactgcaagctacaaaggtcggcaaaaaatagatgaagaaaagaatgattaaaccaaatactgcttccatgttaatctcctcagttagacatgcatttgttgtagatgtgattttggagagattttaactgctccatacgttgtttatgctcattataactcaatccgccgttagcaaaatcagttaaacgaatctggtcattcactgctgccgcttgagcagtacatgtacgttctttttgagttttacgcagacgcttaatttcttccagctcatgcttattctgctcaatcatgtctagttccatcgcagatagctgacgattaggattagctttttctttcgccaaccgacgctcaaccgcgagcgattcagcagagacctggttgctagcacgatagtatcctacagtaccgccaattgctcgcacctgtccaacagaagaagccgggacgatatcaccttgtggcatttgacaaccagtcagcgtgagagcaacgataacagcaagtaacgatttcattgtaatctcctcagtatgttatttcgaaaaccatggtaccacatccttgtggcaaagtaaacaacttttttaaaaatcgaacatgtcaagaagagacgatttctcttcatagtctaaccctgctgcttcagacatacccgtcagaggtttaacgaacgatttttggaacagaacactgtggtcaagccacactagaacttcctgtcggatttcttgtggcagctcagtgcccgatggccatgccatgcatttctcaccgtacgggttaccttcacgcagcgggatgaccatcaccttctcgccttccatgattggtgttataccttcaaagcccgcggtagctcggttatacgctaaagcacctttgacgtgatacggagtacctttatctggatatcccgcaccatcatcatacttaccgatgttgttggcggtcttaacttctgctattactttatagtcaagttcacgatactcagactcaaactgcttataatattgctgtaaagattcttcaccttcctgcagcatacgccgaatagattcttccaacgcattctgaacagcagttggtgtagaactttgctgagtttccatacccatgattttcaggtgcggttctgcataacgagtaccttccatatcatacacgttcagagcatatcgtttcttcgctttccaaaatccaccaatgccgtttgaacctaacggaggacaagaaatagcttcacggtccatgaacattaaatgttctttgttgttcatgtattcacacatctcacgatatgattggtcaatccaaggttccattttcttcttaccgaattggttcaggaattctaccaaatcgttagtttctttgaaacgctcaagacctactttctcaataaccttatcaacacaaacgtaaattgagtcagtatcaccggctactacaaacgaatgtccttcagtaccgcataccttgttgagatattcattaactttacgttcaatccattggattgccatttgaccaaacaaggtgattgctgatgcgttacgtaaatcataataacggaagtaaatgttacccaatgcaccataaagggagttgatcagaatcttacggtttaactggttagtgttacccaagatttcagcgtgtttacattcaaacatcagtttgtcaagacactcttcggtatatgtcagcagttctgctttcatgtcatcagagaaatcttcatagacattaacttctgcgaatttatcgatagttccaaacttcttatcattcagaacctttttaatcagttcttgatttcgtttggcacccatcattttatttttccactctttacgctgataaaataccttcgcgatttcaactggaatgacaccatctacatctttacgatacatccaaccattgggtgaacatgaatattcatcagacggacgaggagcagtcttgttaatgtactcacccagcggatgaagtttaaattgtccaacgatagtttctggtgaaatattaacttgtcggattattgacggatacagagatgtcaagtcaaacgacatgatataacgatatgcagcaggaactggttccttaacatacgcaccaggatatgactgtttaacgtgagaacgactttgcggaataactttgtcttgctctttcagactgttaaagatgattgcgtcccaggttttaatcgggctcattacaccttgatatggcatcttcgcataataagacattgagattgccaggtcaataaatccacgaacagcatcaattgcttgtaccgattcaacgtcgatgatgttatatgaaatatatcgttggtgattagtttcacgcaatttattgatcggaccatcatatgctaatttacctttcttggtttcataataagcaatgaaatccaacttatatgtcggttggttcgtgaaactaaatttcttatacaaatccatgtaatcaagaatagtcacacccatgatagaataaatttctttatcaccatacatgtttgtgataatcttagatgaaaccttgttcagaggagagaaccgtttcatcgtacgctcaccaagaatctgtttcacacgattcatgatgtacggaatatcaaatccttcaatgttccagccagtaaaaattgctgggcatttctgttcccaaagattgatgtactcaagcatcatttctttttctgaattgaacggcatatatactacgcggtcaagaatatgttgtggaacttcatcaccgccttcggaatctaaacgagcagcgagtttcttgtcccactcggaaacggagccataaagcgaatgcagtaaatcaaacacatagaacttatcatcaaccgaatcataatgagtgatagcatcaatttcatattctgctttcatcgggtctgggaattgagatgcagtaacctcaatgtcacagtttgcgattcggatgaattttttattatagacgatttctgaaccgtaagtatcactgatatacgcgagtttgaaatcatccatacccattgcttccattcccatatcttccatacgacgcatccaatcgcgtgcatctttcatggttgggaatgtattcttcttgcaatacttgccatagatgtctttgtactttgtttcttccatgcaatgactaaacataacaggagaatacggaacacgacgcatgcgttcctcaccagtagaatcgatataacgttctacaatgtcattgcctagagtttcaacgctgatataaaattctttcatgggtttcctttgtttatagaccgagttattagtctttagatgggacaattatactccaatttttataaagtaaaaggcccgaaggccttttcttatgcaccaatcgtatatttagattttaaggtccattcatgtttctgcttgaacgtaatgacccggaagttattctgcatctgagcaagagtttgaccacgattaatactcagtagaccccagtcagcaagtagttgtgcgattgagtctcgacgaatttcatcttccaaatcaatagtaacagggcgaccatcaagcttcagcatttctttaaaatgaacaatatagtaacgaccttgtttctgaagaatgtggcagctttgatatagtaccttatctttgttattagcaattcccatacgggttagagtttctttaactttcaggaagtcttcaggctgtttcagtgtaatttcaatcatctttaccattccaatgctgttttcttaagagttttctgttctttcacgtttttcgtgattgtcttgaccaattcatcagtcacaagacctttcattttcttgagagcaggtttaagcttgtttttagcttccagggtctctctatacatcctagcatcaatcgcattgaccttgtaatatgtcattataacttgaagaatcaatgcatcctggatgttttctgttaacttagcccatttaccataccgacgacctctaggaacagaggccatcatatagttatagtgtgcttggtcagataacccttgaccaacaaggttcataacataaaccgaaggcatacagtcagggtgttgagaaagagcgttttcaaccatgaattttgaataatccatcgtcgagatattcaaatgctcttgcttttcgttaatagacccgataattgtgaagaattgattttctgctttttctttatatgaatcagataattcctggactttcgtccagtctttacctaaccacgctatttgatgctcgttatactgatcatcatcttcaaataaactcatcatttccactgcatctctacaacaagttgaataagcatataaaccaagtgtaattcaatcgaagctgctatgccatgatactggttattttcaccgatgatttcatacattcggataatgcttgggccagtaaccattgtatacagctcagaagaaagtttatctacaaaccaagtatagtctgctgcatatttcggagcaagagcacggagttctttgatgttcttagttttaatagcttcaatgacatcttcaattgaaccacggtcattcagaacgatagacaagatacctgcatcaatcacacccttagaagaataatgatcaagcatgttaatggtcttacggaattctgggaaattctttttgaccaaagcagctacaactttcttatcttcaactaccacgccttcattttcacaaattgcgagacaacgcttgagcatctcgatttgcattggcttaacatcagatggagatggtttaccaaaattaattacacggcaacgagactgaagaggtttaatgatgccatcaaggttgtttgcagtaatgataatagtacagtttgtgctatacgcttccatgaatgaacgcagatgtcgttgagattctgcaagacctgcacgatcaaattcgtcaatcacgataattttctgcttgcctgcaatagaagcagaacttgcaaatgcagttaacggtccacgaacgaaatcaattttacagtcagaaccattcacgaacatcatttcagcattaatgtcattacacaatgctttagctactgtggtcttaccggtgccaggagaagtgctatggagaattaaatgaggaatttttcctttagctactaaagctgaaaaaatttctttatcttcagcaggcaatacacactcagaaatagtacctggacgatatttctgttcccacatgaagtctgcttcgtttactgtcaatttcatttatatttcctcattcagattaaagatggggccgaagccccgaaattattactcaaaatcaaaggtactgtctgcttccattgctactacataagaggctgatgcaccttcaaatttcgctgcagtctgtttcttggagccattcatttttgcccacagcatcagtttataatcgccgatagtcattttcatattgctcatgttgatgataaagttgaagttaccgtcaccttcataatcaccgagtgtcagggaatacttcggacgggtcagtgcagcgtcttctactttattataaccgcgcagaacaattttaccatcaacattggtgatagcaattgtgtcaatctgcatgccacgagatactcgcatcagctgttgcaggtcttcacctttaaaatcgataattacgtttgccaccgggaatgggattggtttagtcgggaacacgattgtgctcgggtcagctgctggccagaagatagttgagcgagcatctttaattgccagattaccatcttcctgcatgataatatctgcatcatcaccaaccagagacagaatgctcagaaaactgttcaggtcataaattgctacatcagtatcgatggtatcagaaattgttgcttcagcataagtcgtaccattaacagcacgagtcatgataaaattgccaggtttcagcatgataccggagttgatggtggagaagtttttcagaatgttcagagtttctttagagaatttcatttcaataccttttaattaagttcaggataattatatcaagctgcgaatgtagcagttaattcttctgcaacaatctgacctgccgcaacgagttgctcatcagcatctacgcagtaatcattttctagacgttcgccaccatgacggtcagtaacaattttagcaccagccttgattgattcgttgtaatgcttacgcatcagttcaatccatttttctgcgacttcatcatcgatagatttatagaaagcaaagcgagcttcggaatctttaatcttatctttgatagcctgtttagtttcttcggtcagagccagaacccaagacttacgaatacgattttggttattcgggttggaatctgcacgtacgtttttaacctggatatctttcacatcaacaaaattaatcattatatttaccttaatcgtaataatcttcaaccatccaaccgggattcctgctggacatgactctattatattcatttcctgtaaaagcgtttcgtaacatttcttcagttacgagatgttgctcattagaaaacaaattaattaacacatagcgctttaattcaggaaaggccaacagatgttggcccgtagtaaactcattcattccatcaccgtgaatcgtccgaccttcttcatttgaaggtgttggccatatgcctgcgggtcgtggtcacggtgagaaataataaacacattagcatctaccatcttattcagaatagcagttattgccttaacaccttctgcgtcggtagccgagtcatagacttcgtcaaggaacaaacagtttattttaacaccagaaaccttttcagcaatatcacgccacgtgaatagtaatgctatatcaattcgagctttttcaccttgactaaacgaggcataactaaattcttctcgtccacgtgatttaatcgtttcagagaactcttcgttcagtgtgaacgaataatcagcttccataatttttaggtagctgttaatttgcttattgaacatcgggatgtacttcttgatgatagctcctttaataccggagtctttcagcatttcagttaaaataccacgacgatatttttccataaccaaattagttttgacgaggataattttatctaattcttcttgtagcagtttaatcttgtctgagttatcaataaactcctgagatgctttatcaatagctgctttaatgcgacgtgccttttccacagcagtgatagtcatttgctttaaactagacatttgagttttgatatctctggcacgtgaccggacagtgttatactcgcgagctagttcatccagttcactctggcgcgtctttaactcaccaagaatggtattacattcttcaacatgatgattaatcttagtgattagagtgtcattagaatgcaaatcctgcaagcacgttgggcaatgaccacctttatcatacagtccaagaacctttgaatatgattcaattttagaccgaattttaaatgttttaccttgaacttcttggattgactctgctgggtcgtctccaattactaactcaagcagttctctctggagagtttctaattctgctttatatcctcgtgcctctttcacctgctcatcatacatcgcctgcaggcgagctacgttatcaccagaaagtttcttctgcttttctgcatactcatgatgagttttaatttcattagtcaatgcttcacgctgaacatcattaacctggatttgctgattgatttctcttatctgtgtcttgttcagtttgtccatatcagctaaaagagacacttcaagcaaatcttcaacgagctttcgtctattagcagttgataaccccatgaacggagtatatcctgccgttcctaatacgacaatctgcttaaacgatgtgtatgacatgccgatgagactttcaaagtaagattgaaaatcctttgaacttgcggcttcatcaagcttattgccatctcgtaaaatctcaaagacattcggtttttgtccacgtttaatgtagaaactatgaccgtcatactccatccacagttctactacagagtccttcttattgaaggagttaattaattgacctttcttaatatcacggaacggtttaccaaataaggcaaaagtaatagcttcgagcatagtacttttgccaccaccattcttacctgtgattaaggtcttttggcatttatcaagttgaatgtcaatggccgcttggccaactgacattatattcttatacttgacacgatttagtttaaaagtcttcactgattttgtgcctcaatgtataactgtttagacataacctttaaggctttgatatcatctgcggacaggtcttcaagtgcttggatatattcttccattaaatccaataagcttttaacttctacttcttcgccatcttcagactcaaccgagttgtcaactttagaaacagttcttaattcatgtactaccttttcaagttctgattcaaacttaggaaggtcttcatcgaccgcagtgataataatgcgtactgcgagattacgaaactcttcaaagtcaatttttccagtaacaggataaatcagttttctatgccaagtgatttcattagggacgaaatcaaaggttgataattcagtgtcttgaacccagaagccacgtgggtcgttctcgtcacccgctgtaagcgtccaaggcgttccgatgtacttaacgtttgctgcgcttgatatggtgtggaagtgcccagaccatacttgtttgtactttttgaggaaatctggttccagcccatgagacttcattcctttataaaaataaaagccattaagctcccagtgaccaatacagtattcagcagacgattctttgatatgcttcatgatttctgacgtgttctcttcacacatccatggacacaagtcaatcaaagtcccatcaaaatccatagtcacgggcttttcaataacagtaatatgcttatacttaccaagaacttctgttgatgcattaggcgtcaacgtattcttgtagtgcatatcatgatttccgacgatcgtaattaagttaattccttctttctcaagagactccgcaatttcacgagcgaattccattgtcttatgagtgatagctttacgaacgtcaaaaatatcaccgtattgaatgatagttttaattccatgctttttggcataatcaatatgctgcttaattccgtgtcgttgtacatcctgtacccacgggtcatctgcgcggacacctaaatgccaatcgcctgagtgaataattttcatataacctctctagtagagtttaattttatattattccatgaatagcaaaaagggcccgaaggcccattacttattttgtcattaactcaaattgttctttaaagcaatgctcagaatcttggtgttctaccaggaattcaaatgctttatttcgctctttatcatagagcttctggtcagatgacagatgtttcattcgttcaaagacttcatttttattttcatcattcaaccacagaatgccagaatcatgagaagtcaacggctttccatcaacccggaatttcaaagcatcaccagtagctttatggaacacaggaatagttccacaagcgcctagttctaaatgcgtgtattccagcgaacgctcaaggaatttatctggaagacgtgacagctgataaccaaatccagactgagacatacgctcaagcatttcagagttaacatatcggtcaagaacttgaggattcagacctggtccagttttaacctgatgataatgacggcaataatcaatttcatagcgttctttgatgttaataaatgcaggactgcgttctaacccttccaagatagtcgttttgcctgcggggcgcagatgactttcatgaaagtcaaacatcaagaaatagcctttccacgtagtagtacgaccaatccaacgatgaatatcaaaatcaatagcagagaagtctttccaatacttatcacgaattgctttgatgttcatagcaggttgaaagttataaaccggaggagctgagtcagaatcatcaaagaaactcaacccgccgcttggaaaatattcttccattagcacggtattaaaatcgccgtttgagctatgactaaacagtacatcagcacgcttaacggtttcttcaagaccagcatttctacgaagtgacaatgctctatggtcatgttgatatacgactaccctaacttcaggtttaatgttctctatgagcttcttatagttatcaatcgctgcttctggagcattgatagcaggtactgagttaatgataagaatgtcacatgcgttaagcagagataaagtcttatcatagtcatctgcaagagacacaggaatagttacatctttatagctatgtgctctattacgagtaaacgctttatctttagcgtaaatgatatttacttcatggccatgttttactaaccactcacggtgctcgagactgaacttggttacgccgcatccctcaagtccgcgagccattaaaatattaatcttcatatgttgacctttgttgttaattttgaatattttaccattcccgtaataaagcaaaagggccgaagccctttaaattttcttgtatacaacataacccgctgcttcacatatacgcttagcttcttcaaagcgtctaagcatatctaccttagcattatgaatcgcttcataatcgggagcaggtgcttctctccgagcagtatcacatttataacagaagtaactacgctttggtcctgtataacgttctgaacaattactgcaccggcatgtataatttccttccggccaatcatgtccaggattagaacccatcaaattcgtcatacatcccaattctcttcactagtaataaaatcagggtgttcatctaaatcaatgaatccccagttctcttcatttaccattcataccaccgtttaacttggaaggtgtcaacccagacaagagagttcttatctattagcttacatccttcggtagagcctaacacgcgatattgattatctgctacctttactgccatcgtaccagtcgcagtgtttaaagtaaatcctgcgtctttacgaacacgtttaaattttacttgtaccagcatttagaatgtcccaaacagatttacgagaggtattccaacaagtcagaataatctcatcattaaaaggttgttttaaaatagtacgcagtttttcaatagcatacttgtaagcagggaaattattgtctaataccgcgtctccagcatgagctcgtaatcgctcaagttcacgacggtttttacgaacaactttgttggctcgagcaatagcttgttcttctgccgcttccattagtttctgttgcagctcgtcgcgctcttcctgggtaatattgttcatgttattcctttggatggtaatttatttcaaatgtgaattcagtatcagtccaattataactgtgttcaattatagcagaatctgacctgaaatcagcgtcatgtggatttttcgggtcaatgtgaatatcaagatcaagcacctcccttaaatacatctttagcaaataagggatagcgtctaggtcttgcacatcttctaaaaacccgtcgaggttaatcttcagcctcatataaaaattccagattaggtccatcgcttgtaggttcgctctttttagcagaccctggcgccttataagcggtggattcatactgcgtcattttatcgtagatgtcctgaataaaggtttcatctgctaacgcaaccatatcatcgtcccgtgaatcatacacgttgtggacaaaatagctgtatttctttgccatttctttgcgttcttttttgatacgctgaacgaatgcattgaaacaagcttgggttatatacgcatgcgggttatcatacttagtttcatcgaagttgattaagcctttaattgcggcttcaatcccgtctgaaatcatttcttgcttccaggattgggtgtatcctgaaaagttgaaacgcttactcagaccttctgcgatcagcataatagcaaggccgatcgtatcgttctgttttactactcgaggaccgccagcagcttcagactcccgacacttctctttccatgcacagattgatttatacagttccttgttatttacataattactcatattgcctcttcgcttcaattaataatatctattataacaaatttgggaagcgagaggattaaagcattacttaatcaattcagcgcatgcaattaatttcatcatgatacgataaaaatcgttatacgtgaaatctaatggaacatcaatgacggcttcaaaatcttcaaatacacgctccattccataaccagcgatatcatctgattcagcataccagtacgttccatcttgtgcaaaagttatttggctattttcaagacagaacacacctttaatattttcatgtgtaagagtcaattgaattttcatagttcacccttcataatacgatagcattggaacagctgttccatgatacgtttgaactcaaccaaactaagttcaaaccaatcagattcatctacttcatgcatcatttccatgaatgaagagtataaactttcataatgggtttcatttaacatagaggcatgcgtttcccaatacatgccctcttcattgtcaaaccaaacacccatataagaatctatagtaaatccgccaatgccttctactacaatcataatttggtttactttagccatgctttcaccgagtcaatagcatcttcaaatttagagaaagcatccacggatgtgtattcattctcaccagagcgttcataaatccaaaacgcgtcaaaatcttcttcaatgatgaattctccgttaggagtttcaatcgtgtttctgccatcaggcgttttagatataaaccatccaagaaaaccaacttctacaatttgttcttcagtcatttagaatttccaccaattgattatagtttaatgcctttccagaagaaatcataacattacaaaatctgtataatgcttcttttgatactttatacacataatcagaagttgttataatgtatgaaatacgtacaaatgttggggatttttctgccaattcatacgccagttttctagctctgccaatatcatcggcaaacttggtatcagcaagcaaaatactatcaaatacccaacggttagtaaaaatttctgtgtatagaataaccttacgcatcaagatactctcgcagttcctgctcgtttaacccttcttgccacatctctgacggagatggaagttggctgtctagagtggatgaatcaattggaaatactctgataattacgctagtatcttcatcccattgatttgcgagtatccgtttagcttgactaatgtcaggctcagaatgagcccggatatacttaatccttctatgccatacaccggtaggaatagatgcgcacacgatatatgaaatcatttagccgccttaaccgctttaacatcgcggaagcctttcttacgttgattcttcatcttacgaatagtgctttcagaaatttcaccgatacccggagtgattggttctacaccgaaggctttgatgccaaattcagacagaagataagcaaccactaattcacggatgcgggctttaccaattttttggccttcttctttcatcgtaccgtgaagctcaacttcccactgatcaagcaaagacggagttacacaacgtccttcttccagcattgcagatactttatcataagcaaaagagttcagtacgtttttgattgcttgggacatattaatttcctcagtaacgattgttttgacagaggagattttaaatcaaatctcctgtagcaaatcaatctttgagagattttaactcttcgagcatatcgtagtattctttactagcaaccggagctacagtacagtggtagctattgaattcatggtatttcacgaagcgttcaagttgccactcaatcaggttgttaattcggtgaagcagaaccccctctgaaccgacgtagacaactacttcaaattgaagcccatcccaaattctggtacggacgatatcacctacattaaatgttttcatgcgatgtaccaatgttcgttttgccaagactcacccttgtaccagcgagtcatatcatatccattttcatcacagatgaccttgttcttcatcaagaagtattcgtcatcagtaaaatgcacatgctttactttacagcctttactcatagcttctagagcttcttgccaatttaaccagttcatattttcctctcgagttaaacggtatgctgttatccgttgatagagctatagtatcactcatcaactagcttgtaaacaactttgtgaaaggagtttaaaaataaaagagaggtcccataggaacctctaaatgaagggtatagaaatatacagaaggtggtcaagatgaccttagaaaggaactggttaatcttctatgatatctgggtcatgcccagcagcaataagattggttttgaatgttggaatgtcatactgcttaacgttatccataaaaatgacaggataccgaatagcaagcgatggatagcacccgatgcgtttagcaagtgactcaatcaacggacggtcataaaccggttgaccgtcaacctcgttgattacgttataaaactcatacggaagttgtagcttatcgagcaagtcacgaactgctttacatccagggcatctccaaacttcttccgggatgccatagatttctatcatagttcagccttaatctcagaaatcaatctttcaattaattcaagtttatccgctgtagtcataggataaattttgtcaacagtggcttcttcgagatagcaacggtcagcatcattgagtatacaccactgatcaaaatcatcagcatctatgctaacaccgttgaaggtcttaactcgttcaacagacccgtcctgtgtcagagctgttaccaaaaatggcttaaatttaagcatgttgtagaattcaacatcctttgacgatgcgttatttagccatttatcaacagagtcttctttaaacttgtaccacttatcgcaacaaaataattctatcatttcatgacctgttgaagtttagcagtcagagtattaacacgcttctgaaattcttcattagacagtttttcatctttcttagtaggattaatccagtcagaaataatgatgagaacaataaatggaatagctacgaaagcacctgcggttaatgcaaccagtgcaataacattagaaataaatttacgaatagcattaatgaatttcataattttccttaaatagttaagatgaatgctgtcatagccagaaattctggtccaaacagttcagtagccatgtggttcagagtaaacataattttgtaagtcagcatataaatttcctcaatcatgtgtccaggtagaaccgtttcttacccagagtctttggttgtcagaaccacgccagtttttagtagttggcagtgatttctcatatttcccatcaattataacatcgatgtgttgtagcaaatctaaatctttgatatcttcaaacttatatcctgtccacatccagatatctttctccggaaatcttgctttaacccaagaaactaaatttgaaatctcttctcggttctgtggataaagtgggtcaccgccagttaaggtaagaccttggatatacgatttgcttaagtgagatgcaatttctttaacggtattcatagtgaatagctgtccgttacgagcattccaagtagatttattataacacccttcacatttatgcaaacaccctgtgacaaaaagaacgaccctgcatccagggccgttcacaaagcaacatggatatattctatcatagttcatttatatatttccaattatagccttcaacacttttgcgttctccatttaaacattttaaaatatttcctttactagaaatgttaaaatatttcgcagcatccggtatatagttaaatgtttttaaaagaacaccgtttttatatgcaccaaatacattgagagtatatttttctcgaagacgctggtgctttcttttcataatttcaggattttcatacgccagctttaatgaatttttgtgccgctcttttacttcaggcttttgcattgctagcttagttaatctagaaattttgcttctaactttatcgtctttcattgtatttgataaatttaataaagttttatttctaacttcaggattttgcattgctagcttagttagttctgcatgtctttttctaaaatcatcattcttccacatggtcttagacaattttgacatagaatgatgaagcagttctctttcttttgaatataatttaagaatttcatccaattcgtcagtattaaatctattaacgtttgagtttatcattctatgaaaggcataacacattttaccgtttccagtttttgccaaataatagtgagctaacgcatggtcatagtatgataagttaacgatattccatttatctgatttatgctcaggaaatatagatttaggaagcacatggtgtgcttccgtctttccttttattttagaattattgtaatttctttgtattaaagctgtatacgatagtaaatcgttgtcatcttcgaatattgaagatagcttatcattcacaaaatcagaagggtagattctgtcgaaattcattgaaccttacctcattacgtgcttctacttctgcatcatatttccagggctcatcagtttgaatagccccagccgataatccactttcggggtcacgggttatagcaattccaagcgggtgcagaacctctttgttgattttccaaatcaatccccattcgctaagttggttccaatcaacttgcttcattggtttctctaacatgttttaccctatgcataatttctttgttcttaccaagattgaacccacgctcagaaggattaccaagatagccacaggttctgcggatggtattcattttctttggatcagtttcaccgcaaatcgagcaagtgaatccattttcagtaggtgtcatctcatgagtagaaccacaagaaagacatttatctactggcatattaacaccaaaataatccaacttctcgatagcatagtcccataccgcttcaagaccttcaaggttgcgcttcatgtcaggaagttcaacataagaaatatgaccacctttagcaatagaatgatatggtgcttcgcggtcaattttttcaaaaggcgacaggttttcttctactgacacatgaaaactattagtgtaccagcctttatcagttacgcccttaacatcaccaaacttggcttggtcaatcttacagaaacgatagcacagactttcagccggagttgagtacagactaaaggcatagccggtttcttccgtccacttgtttagcttagtgttgatgtacttcaggacgagtttaccgcttcctttaaaagtaagcatatcaaattcgtggatgccaatatatcctaatgaaattgaactacgtccatttttgaatagctcaagaatttcatcatcaggtttcatacgcacaccaaaagcaccttcctggtaaagaataggagcaactgacgcagtaacaccttcaagtgatttaattctagttaaaagagcttctttacaaatatcaaggcgttcatccagtagtttaaacagtttattactgtcatctgaacttttataatttgcatccagagctatcctagggaggttcagtgttactacccctaggttattacggccatcaagaacgggtttgccagaagagtctctccaagcaccaaggaaacttctacagcccattggagatacaggagtttctgaacctgtaattgctctattatttcgagcactgatgatatcaggatacatacgtttagctgcgcattctaatgcaagctgcttaatatcatagttcgggtcttctttacgtagattaatgccttcttctacaaacatcacaagctttggaaagattggagtaattccatcgcgacctaatccacgaatacgattatcaagaatagctcgttgaattaatttttcttcccatgacgttcccataccaaatgtgatagtcacaaacggagtttggccatttgagctgaacaaagtattcacttcatattcatatgcctggaaagcatcaaatacatctttctcggttttagaaatagcgtaatcttttactagagctacttgatatttgcgtgcatcacgtacatgtttagcgaatgtcttctccacataaggagccaatactaaatcgacgttagcaaacgtagttccaccatactggtgagatgctacttgtgcagtgatttgcgccatgatagcagtagctactccaatactcttaggagtttcaatttgagcgttaccaagtttaaagccattctgcaacatacctttcaaatctactaagcagcagttagtgaaaggcaaagctggactatagtccatatcatgaaaatggataacaccttctttgtgtgcttccattacagagaaaggaatgacctgattggcgatatgtttagatacgataccggccatcaggtcacgttgggtaggaaaaacacgagaatctttgttggcattctcgtttaaaaggtccttgttggttttattaataagtccctggatttctaattcgatattcattttaaactcttacgaagctgcttcttgtattttgaagcaagttgtgattttccatcactttcctcgtatgtaaacccatgcaattccatttcagcaatcatctcaggcttaccaagacgtgaaaagcgtttagccatatcggcaacatattgcgggtgaatattactgtctttacgattctggcggagatagaccagcaaattctctaaccattcgaggtagtcaatatcttgaccttttaaaccagagcggttgaacttatgcttcatttggccttctgccgcattacacaggttacagagcaagcctctgacctttcctgcattgtcaccttctaacgcatggtcatggtcgaggtgattcttttgaatatcctcatctaaaggacgtttgcagcaaggacataatccgttctgtgcctgatatagtttttctttttcttctttatataacttaccggttaataacatactcttacctcagcgattagataagagtatttatagttaaattaacgagtaactactatagatgttatgattagactcttttatgcagaaagaagtacagaaagcatagatgccttcataatcatccgcattgaactcaatatatgaattagtttcttcatgaagaagactcattttagtccaagccattccattgatgtcatcgtcgtaatagcctccactaaattctactacatcgccaacttcataccaatgactgcgtaaaatttctcttgtaacacgatgaatatcagcgaaatcgagaatttttactgtaatagttttagtaatgcacgatttagacatggcgaactccaagacgggtttccaatgcgacgatgtaatccgcggctttttgcattaaagcatactcttctgaatcacaattttcctgtccagcaaatgcgtaaagagctctggtaattggaacgattgcgccttggaaatggttaagtttaatttcagaaatcagaggaacatcttcaccttgaccgatttctttaatttggtgcatcgtatcttcactgtagaagcaccagaaccaagattctccgtgtggagttgggtcgttaatagtaatgattttgtttgtcagcaaatcaattacggcagtaattccacacatttcaaggtcatcttcattaactacagaaatgacttggaacttaaatcccggaataaacacaggaaattgctctgttaattcgtcatcattaataatgacttcaaactgcttaccaataagtcccattcactttgtcctcataatcaagtaattcatttatagtgggttcagaagtattataatcttcttcaggaatagcatcttcctctggctcgacagtttcccagcgagccgcataccagggttttagacctttgctactttgcatggtgttggttcagaatcattagcagaatcatgttcaatacgccattcaacttcagtgcgagtaaccactttttcatgacgtgtaacgatatctacttcaggaggactataataccaatcagtatgatatgagcctgaacgagattctgataccatgaaatgaacgccacgcgctggataataccaaatttgagtgcggtcttgatacttgtgctcttgcgtccaatctccatcttctactaaaacaaagatttcttctgcatcatcgtctggtgcattaggcggatattcgaaatcgtagttgtcgtcccaaccgccagtgacgccagcgatatgtttgatttcttttactaattcagcgttagtcattttaacctcgcagcttctgtaaatcttcatcatcaatccagctttctaaaccggatggaagcgcacattcaatttcccacagcaattcttcaattgcttgcaagcgttcaagctcttctgctgaaatagttaccatgcgtggagcttttaaatcgccaatatcataactcatagttcttcctcatgttaatcataatttcaccatacactcgccgtatttccatttagacataaccttaactccattagagtaagttacctctacctttgctcgatgatttttgatttgtttaatctcaccggtttctaatccgccatagccataataaagggctacaatatcaccctcccgaaggagggttccacgataatcatgcattgaacttgaatttacggagttcatcaaaaccgccgatatgtgtaccgtcaggagcaaaaatctgaggcatagttaatccaacctgtgattcacgacctaaacggcgaagcaaatcactgataaccacttcatcaaatacacctttttctggcattacattgatgaatgcatattcttgcttcttaacgtcgagcagacgttttgcgttatcgcaaaatacacacttatgaatgctgctgtcgtaaccaaaaaccgtgaacatcttcttctatttccttaaatacttgagcttgaactgttttccaatctgggtggcgtactgctttaacgtaatttgtcataccaagacgcttcattacttcgccatcaatagctgcttgagcaaaatttcttccgcgggtcatagctcctttgagtttagaactatcaactatttgaccagtctcattataataaaccgaatacatgagtagcattactcgttcggcttcttccatatatcgtttacgagccattttcagccttagtagttataactaatgttttaccatctaacgcatcgagaatatctttgatgcaattatctggcattggttgaacgctagctaattgcttggcaatatcatcaggaattcccatacgtggtatatttaatttgctaaaatcaattttatccattagcagttaccgggaagtgttctgccaatttagcagcaatggcagcgttaatttgatcagcgaaatttttattcattgcattaacaatgatttcttgaattcggagattagctctttcaatagacatcttaatacgaccttcagcttgcttaacagcgtcatcaatagtttgacgaaccatatcatcaatagcatttttagcgcatgattgggcagcgttacgcatcatctgcgacatttcttctgtagcagacatatcattccaaccgcgagtatggaacatctgctgaacttgcttcttaacttctgctcggacatctggaatagtcacagcagcaatattaacttcagattgtactgcttgcttcagcttattctgtgaatcttttaacaccatttctttaacgatgttattgattactgactgttgcagttgagcacgggctgctgtaccttctgggaataactggcgtactgcataagtatcaagtttaatatcaatcattttacctttttcactccaggaatattagagatagtttcaaatacttcgtcaaagttatctttatcaacagtgactaccatagtgcgagcggtctgtttctttttccaacgtttaaagaaagttgcaagactcaaatcatgggaagtgaagaaatcatcggttttgtaaacatatccgctttcaatttttactacagcatcaggtgaagggtcttcatattcttctacttcaacatcatcaaagagaattaaagtatcatcatgataatagccttcccagaaggcttcatcgttataaaattctttccaaagcgcgccagttgttttcatttaatcaccttcttccaagcttcgtgagcagcgcatgctaatacttcatcatcagtcaaattaaacttgccttcattacgacgagcaatcatttcattgaattcagtatcagttctaagcatcatgttaagaactgtaaaatccattgtcgctcgaagatattctttaagctgcatagggtcgatgccactttcgtatgcgtcaagaatcatatctgcaatgatgttatcaaagtttttgtcttttatgaggttattagcatactcgacaaaaaacttagtattagcaccagtaatagttttagtaatcattttaattttctctcaaatttatgcttacaagtccggcatttcattttcagaatatcggttgtccaatcgacaagctgtacttgaatactaccacatttttcgcaaggcacaacttgtttagctgcagcttctcgacggtctaccatttcaagacaggcatcccagtcaattttaaattcaggtacaggcggatactcaaactcaatttcaaggtcgttatcatcaacgaccatgtcttcttttaattgatttttcacagtaagctccgggcatactcgagagattcataacgctctttgtattcgttaagcgatttaaccaaatctgccatcatcaattcatgtttagccaattcagcttctttagtatcaatgaaccgcttaacagattccatttcaattgcaatagaattcttagcaatttcaatatgatttactgctgtcatctgtaaaggcttaacttgagctaggtacatatgagctacatcggtatcaatgacatgttttgtcattggaggaaaaatcttaaatgggtccaaatgcacttcaagagtagatgaactttcaagaagcattttgcattggacttcttttactatatccatatgatttaatgcattacgaacctgagccaaaagagcacgtgatggataatttccactagtccaatggctattaatatgaatacgtactgttacgttgtcaagttcttctgcgcgaatactgtgaatccctcttggatttttcggattagtagatacttggtatttcacacgatcagtatctttaagcaaagaaattgagcgattaagaatacggcgcagattgctattgaactcagtacagaaaatccgcgaagcagaatgaccaaattcttcatcagttttaaatgatttagacgcaaaattataacgataagatggaattttagtgtctccaacaatgaattgcttcagttgttcagcagcagacattgcacctaaccaacgagagcgacgaatattttctacaaagaaactaactacattggattcgctagtcgccatattatctagagttcgtttggcaaccttacccgcaattgctacatcataagcccttggatttaaatcatgtaaagctgataacaccttaacatgtttctcacgcttcgtgagagttttatctttcaacttattaaattcagcttctacaaacatctttaattcattcttattcattatcttttcctctattttggactgggctcaaagagtatctcaaaatctccctgaacccattatacaacaactattcatcaagcataataactttgcttggacgcttatagaaagcatgagttttatcatctttcgctaattcaaatgtagcagtaaactgtactttgcctctgtattcaaacggaatactttttggaagggagccgtaaaccgtagctccattctcaagcacaaccatcatcttacattgtacgccgtaatagtcttcataaacttttactgacgttactgtaccagagacggtcactcgtccttccggtgcatcccctttattcttattcagctcattgaatatattatcaaagacctcttttgaatgttcctggatagcctctaagatgctcttatgagctctaacttctgccataacaacatctgtgccatcttgcaatttccactctttatatggaatgcgtacttcaagaggataaccatactcccgaagttctttgtactcttcttgagttaagcggattttccaccaaccgtggtcaccggtatactcaggcttatccagtgaatccaattctgtaacatacggcaagtaactgcctgcgtgataagcttcaacttcacctaattcattttcccaaagataaccatcaaagggagcatgaggacgatcatctttgccccaagtaggagctaccactttatcaaagtattcacgaccgaagcgggtcttcgcccatccagcattcaactcctcggcgcgtttttcaactttcgctcggtgtgcttggcgggctacacgattttcttcaacaagtgcagagataatctcggttaaagttttcattttattctccagtttggttgacgagaccatcttatcaacagcctcgccgaaagtaaactactttgtgaaaaattttctccaaagcagaactgcgtctctacgagatacttctactgctcctagagcaactgcttgcttgcgacgaacatcacacaaatcatagtgtggaactcgcttatcctggaaccaagaacgtttcattccgatggcttctgccatagcatgcaactcatcaagattgtcgctaaacatgtggcagttctttacttgatgacctctcattttccaaccatgattcatcaagacatctacgtatactgtcatttatgattctctatgtaagtttcaatgatgaactgtgctaaacacagaagattatcttctgaaggagaatctactaaattctcaaccatttcagaaatagttccaaaagcttcttcagtattgaacatttcttgaagttcgttccaagtaggtgctttcatttcaatctcctcattagttaacggaagctatcttatcatggcttttctaagatgtaaacaacaaaagggcccgaaggcccttaaaaagatcggaaatcactgttaaaccatggcgactggtgttgtcgccgtttaagcaatttcagttggtgtttcctattgtcttctataatcatcttagaggcttttagctcttcagccaatgagacctgtttacggtccatcaagatgaggttctgggtcttctgggcaaatgtctgaatatctttaaggcattccacagattcctccattcctcgcttatacttggttcgggcagcatttaactgcccttcgtaatacgcatgtatagacactatagtattaaacatgggttaccctttagcataattgacgatttgttcacgatcagcgggccaatttaaatcagaacgtttcttgtttgaccaagcaatattttcttcagcccaatgaagtttagccgatacgctcttttgtacgtctctgatggcttcttcaagataaatgcctaaatctctcgggttagttccttgagttttaaatgcattgagcaaaatatttcttacgacttctttaaattgattttcaacttccgggtgaataaattcacgataaccgttgcacggatatccaaaagcatctaccatacgagtagtactaaattctttgttcataatccgagcgcctcgcgttcatcaggatttaatttagccaaagcggattctttaattttttccaaccgtttacgcttagcttcaggtgtttcttcctgaacactaatagcagcgcttttaggaaaagtccacgattcaccattttcatcggtgaatgtaattagttccgttggcttacgattaactgtaccatctgagccccaccaagactgccccttaactgcttcttcggcaacgcaatatgaaccataataaccaaacaactcactacgacgatcgtctggtgaaacatacgctgcataggcttcactttccgtcattacccagtttttcattttagcacctcataacgaataagttcaatacgatttttaagctcttggtatgatttacgccaaggcttataataggcatttaaatcttggtgttgtttatgcatttcgtctaaatgctttactgcatcctgcacatttgcaaggaaagtatcaaatactttattagcgtattctttcctgagctcaatgaatggaggagcacgaaatacgtttaccattacacgtaattcatgataagaagaatggacttcagctaatacatttttcttatcgccaaaattaaacttataaagtttttcacagattgcttcacaagctttctctgctttacccttaggtttacctgcaaagatgtgtcccggtggatatactttaatatcgtttaaccaacattcaatatctttaatagctgctaaactcattgtacccacgctccgttttcatcaatgtaattaatccactcgttaatagtccaggaagaggtattacctttaggagtatcaacgatatacattccgcctttaaacaaaacacgttttacatcattagaaattaaagtagccattatattttcctcagttagggaggagaaatcctcccgtttaaattatttcagcattgttacttcagcaatttcacgccagtttttacggtcagtcgcgacgaaatcaccgatataaagagcagtacggagagatacgttacgcagacgatttacgttatctttcataaattccaaaacttcaataacttcagaatttcttaacccacggttctgtaacatagaagtggtcattattacatcttgaacacgaaccataatctcttcattagtgtgaacaccaaggtcaagataaaccgaacgtgataccagagcttgaagatgcggagcaagtttagaaccacgctctaattcacggtcaatatcaacgttagtgataaagaccacagtaccttcaaactcaaactcattaggaattcctttatcttccaagaaagaagatgcagtgctccagcatactttacgtttctcccctgaatccaaagcagctttcagaaggttaagaatgtccatatcagagaatacatccacatcatcaatgagcagaactgaatttgcttcacgtgattcccaaagacggcagtataaaccaattcctgagattttaccgttcactgatttgtaatcaatagcgttagtatcatgagcatgttgtaatgctttatccaaagagtaagtcttaccgatacctgctgctccggagataatcagagaacgaatattcccatgaattaaaccgttagtcattaatcccatgacgttaaagcgtttcttgatacgctctttcatttcatcaacggattcaacaacttcaatcttagcagctactccgtcaattacgatatcatctttgaatacccaaacaccgcgctttttaccattcagttcaacaaagactttaccatcaccctgacgagagtcttcagcacttaagctatccgggaaccactcaccgagtaactcataagtacctgaaatctctttgccgaagtaaatccctttcttgatggtgatagttgacattttattctccgttactctgttttgttttgatggagctatagtatcattctacagctccaaagtaaactactttttaattatttttctaaaatttcattgatgtagtaaggacggacctttgaaccaagatagaagtcatctacaaaatcaatcaagttgtcagtttcaccacggatgatagcaagcttagagaacacttctcccaccatcattggttcaaattctacaccgtgagcttcagcagctttaaaggctttatcaatgttgtttacgacgatttctaaagttttcattttattctccattgtatctgtttgggtggtacaggtctatagtatcactagctcgcgagcttgtatactactttatgcattcttttgaaacaaaaagaggagcccgaaggctcctcagttatgcgtgcttgttgatagcgttttctgcgatacgctttggaagtttacctgcccagcggaagaacatgataatcgctccggcaataaacgcagggaaccaaaagatgagataaaaccaatactctcctgctttctcgatggttccatttttgattagatgcttacagacagaccaacccacgataaagtaaattattgcaacaacgattggcactactacgctccaaagtaaaatcatatttcagcccagtaaagtgagaaccggagctcttctccggcccatgacataaattggtggatttgttttcgagttggtcgagcagagaatttagcattttctctacgaccagtctctctgcaaactgcttccaaataccaccgtctacctttatgaggtcttccataattcaagaagaccttcattgtatcatttgtagtaagaattgtggttttcaagataaaccttctcgacgaaatcgtcccagaacttcatgtctactttcttaggcattccattcttttcggcttgatgagctagaatttctacttcatctactacagactcgagaagctcctgtacttctttgaacggtaactcacctgctttgaccatcttgaccattttagcatgggtcagagggaattgaaggtcaccagtcatatagatttcctgaagctgcagacctgcacgaagagcatgactcagtgctttccaatctacaccttcgttagcttctgccttacgagcacgttcaccatattcagcatcaagcttctcaagggagtacttcatctctttgatagtgatagtcgtctggaatttacgacccagaacgttataaaacttctgctcgcctgatttgtggtcaacgaaggtggtccattcgaggaattcaccgagaggaagtttctctgcgatatcctgtactttccaacgctcattgatacccttctgctgaggacgatcgtcatatttccattcaggaacatctctgataacatccaggactttatgcaggtcagctaaacgagaacccttaacaccatacttacctgcttgcttacggacatatccaagataagccttcatgtcagtagtataaaaacgagctcggttgtcttgaatgaatttccatacttcaggaaggtcagatgcaactaccaattccggtggagtatgcagcatatccaacgcgacagtttcaccgtcagcagcgagcttgaagaaatactttaagctgaacagctcatggtcgacgtcgtctttcgtatttttggttgcgctgttattagtattacgattagtatgattcatcgcttgacacaacagaacatcacgcggatgaggtacaaagatttctttaaaatccacatctgactcgggagttgaagtaccatacagatgtgaaccaaaataagattttacgattgttttcataagtaaatatgattccctttagcgaatttaatcaaatcatttgaagatttagcacaggcttcaacatgttctttatcagtactcttcttagaattgcgatgaacattcccgattttctgcatagtatggtagtatactacgtcatggaaatgatattcttgaccgtctggatgcggttcgcggcgggcggttttaataacatgtgtatcatacataggaactaatgcccaatcattcccggtattaatgattgctacttggatatccattttgttccatttaaaggcattaacatatccaagaacacgatgaactcggtcaaacattgcgaatttgatttcagaagagcttgccattttcatctgcttaagcaagctcatagagagtttctttttggttgttacgatttcaatttccataacccaccctcataatatatgtctaaatcaatgttatctttgccgctgtacttgccagtcaaaggaataaatttaaccgtaatcttttcgccgtcatcaaaagtaaattcagcaataggatatgtagaaattataccacgttcggttttagcacgaaagacggcccgaaggccgttcacgatataaacttgatcattcttcactagttttaccttctacataatcaatcattgggcagactttccgcttacgggcttttaaatactggacaaataccgatggttcggcttctgcaggaagacccgcttttactcgagcaagttttttggtatactgtttcttattgcgatagcgtttaaatttttctaaaccaaaaataaatccaaacgctatagctgcaaataaaagcacaaatgctgctataaccactgcgccaactggtactgctacaacatttagccaaaaggcggataaactaacacctatccaagcgagaattcctgtctctgccacaatcggccaaccgaacatccatgcaatagaaccaatgaatatagcaattgctgaagagaacagaatatgaagtactgtggtccaaaagtatccacatagagtttttggcattttccatatattgccagatttaaaccataggttcattttgaaatgccaagaatttttattgatattcattataagttatcctgtttcatagttggaatcattgcggtaagatatttgaccagttcaatagcgtcgcttttatcaatagctacacaatctccgtcacgttcaatttcgatgatagtattatgttcatacgtgtgaaataccgtaagatacaaatcaataatatgcgggctttcatcttcaattactgcatcgcctttacgggattttccgtcccatactaatttactcgccatcttttgcctctatcaagaattgaattaatgaatcaatttgtttagtgtcaagatgaattatatcattgccttgttttagcacgatacgactcaactttttagtgaaatacgaattcacaacctttacatgcacatcgctgtacggattatctaaattggtactatcaagaatactttccataattacctcaattgtgaatcttttgaaccgcggcgattataggcagaagtcattactgtatcccactttccttgacattctacacaccgttgacagcctttaaccaacagacgacgagctactgggatttcctcatcacaatcaacacaaaactcttcggattcccgctgttcttggagttgtttctgaagacgggcccattcaatcccgtctgctattgtagcttcacgagttgcaaatccgtcatctgatgggccccatccattcatttcaaactctccagaatcatttgcaccaaattatatgtaaacatcggatactggtattgtaccacaatgtagatgataagtaaaacgtttctcattcttcgccatcatcaaagtcgtagtaatcataatcacaactgtcaagataagaatccataaattcttgttgacggcggaaatcttcagaaggggtcagtctgtctgcatatgcttgatcatctggatcgctgaacttatcttcttgcaattctttaatgaactgttcagcttcttcacgtgtccaaaacccacgattaagattatgaacagaacgcttttcacctggcttgaatacacccatatcatgggcagaccgttcagttgaataactttcagtttggccagcatagttttcatattcacaaatcacttggaagaaaggagatttacgtgaatatacaccacgaagaccaagttctacatcatatgtgcctgaagcaacaatgtaacgcgttatttcgccggttttagtttctgtgcgattaacaccacacacgtgataaaagatttttcctggttgaagctcggtagttaacttaatcataatgtttttctcgtttggttgttgatatgtctatagtatcatgtaatgaagggaagtaaacaactttttgaaaagaaaatgcctcccgaaggaggcggagggtattactgcaatgataacaaatacttagtcttgtagcatagacctgtaatgtcatccagaacactttggagggcggcaggaactgacttgtagataccatcggccttagctagaatgaggtctagcatttcaatggtgtcctttggcagctctttctgcgatggtaaagccggtgtataactcttacctgagaatcctaaccactgctcaccaaaagcatctatcaaatctggaatctcgttaaagaaaacttcatacgctttatgtctggcatacgatttggtatcaaaatgcgctgaatgaaaatacgcctgagacgccataagtaaaccgatgaattcatcttgtggagtaagtttaccgtcctttacaaaatcattgaatttcattatcgagttgtatcctcatgcggttagcatattcttcacctgctgaacgtcctaaagaatcgcaatctttagaacaagactcactcttccatttactttgtataaaagaatagaactgttcagactcttgcttactaggctccttaaatttagcataaacttgtagagctccctcaacatacgagttataatccgaaatgtcgttgtgtgatgcagctgggagtgaaatcccgcagcccaacaccagggctaagcaaatgtgattaaaggccatacggcctcctattatttttgtccagtattacgtttgtgctgaagtacagccttaacttctttgaggtatttgtccagcttacgtttacgggtataatctgcttttgaactgtgctgacgaatttcttcctgaaggtgcgaaataccatgcccaatctcacgacgaagttcgtccagttgttctacagtaagattacgaagttgcttttcacttaaatgctgcatatacacctcatcagttagtaatagtatttatataagtatgtgttacttaatcccaaagccattcgcagatgccttgctcaatagttctagcacctgcttcgtcccagttatattcttcgtcatacttcaatgcgcgtttaatttcggctttatgaaatagacgtgggatcggcatagcataacgggtccaacgtaaagttttccagaatccatcgcgctttgatttagcaattaatttcttggcctctagcggtctttcccgattttcagaaatacgcagttcaacatatttctgttgggtttctttatctttctgagttttaacgtattcgttatagcttttaatataagcaaattcgttattattctgatcgttccatttggaagattttactacatgccagcctttgcggcgaattgttctagacattattacctcgttaagttaaattacctcaacgatagtaaaatcctgatttgaaaaatttaatattcatgaatagatgaccttgcatttacattttggacattcaggttctttggttttaagacgcttggtagcagtctttggagcagtgttgttaatcatatacatgaagacaacgatagcacatcacatattttttcatattaaaccaataacgaaagcaatattacgtatagtaagaatccaactacgaatcctagtactataccaccgactataacaaataagctactcatgtttaatataacacccatttgtattagcaataaagtctttaccttgagctaatactttgcattcggaatcaagacgattttgaagttcttctcgtctatcgctttgaatagatgctgctacacccatccaaatgaatagcatacttaaaactagcatcaggatagtgttatacgttcttggcttcattataaacacctaccagttcgcaccagtgtttacgacaaagagaaacgtatttgtcttcaccaccaagttctactacttcaccatcggtaatagcatttccgttttcgtcaatacgagctaccattgtagccttacgtccacagtggcaaacgcccttgagctcaacaagtttatcggctacagaaagaagagctttagaaccttcgaataactcgccgcgaaaatcagtgcgaagcccatatgccattactggaacatcatacaagtcaacgattttacatagctgaagaacatgttcagcagtcaagaattgtgcttcatctacaaatacacaatgaatatcacgttgtgtttgtgcccacttgaaaaactcaaggatatcaatagattcgtctactgtattagcttcatgacgaagaccaatacgtgatgttacctcggtggcagaatctcgagtatcaatagcaggtttaagaatgagagttcccattcctcgttctttgtagttatgcgccgcggtaagaagattagctgatttgcctgcattcatgctcgcgtagttgaaataaagctgtgccattaaagggtctccataaaatcagaaatagcattcttagaacgaatgagttcatcgtattcttcgggtagaccatttccgtaaatggcactaatagctactacttgctcggcacctgcataatcgtcaatcaactgccacagtttatttttttgctctttagtaatcatctatttacctctaacaagatggatttagcttttagcctcttcatattctaccactgtaatgtcaatatcaggggttgctaaattaataagtttctcaattagttcccaatcaccgccagcaataccagcaccaatctttggaatgtatagaggacgattataaacaatacgaccagaatttagttcatggaatgcattaaaaattgcgccgtaatcaacatttggacctggagcatactgagtatacaaattatagcaatatgcagtgccattcttgtgaatggctcgagtatgagttccaagcttggctaaattattgtcataataacggtcttcatcgatgtcaatatcgagaattggaggatatgctttagcaagctgtcctgctacaccggcacccattgtagtaaagcaattacacccatgagcgatatcgcattcatgcttcatgaataactctacaatattgcccttaatatatccagtaatcatttattcacctatggaattttataagttgcgtattcattaagattattgtatactcttaaaaatatagcattgttacaattaaggatagggtttagcactccttgttctttaggatgcattactccatcaacagaaacaccgtcactctgcattccacatccgcgagcattatattcgacgtgtggaactattacctggtcatctttatctagataattataaaatgacattagcaattttctactgctaggaacaaatgctatttcaatattgttcttgaatggaccgttgctttctattttagtcccctgtgctgcaagtatagtttcaggatagcctgggagcttttcccaggcattaactgaaaatgcgcagcataataaaatagctgcttttttcattttgatgatagtcctgacatataacgagccattaattggtcacgatacattaaacatatattttcgttaggagcattgacacacaaatctttcatgctcttagccttacgatttattagtgttgtccactgggccgggctacgtgaatcttttactccatcgctgaatgctgaatctaattcaagcgctaatatatcaacgcattcagagttcgtattgcaaaatgttttagcgatacgaagtgaatctgtcattgaattttcagcattagcagagaatgccaatactaatccaagaagcgcggcgtactttaccattattccacctttatatgtagcattttatgtttctttaagaaatgagctttctctaggacatctgacgcataagagtttcctcttttgacattccatcctgcattataactagcaagagcttttcgcatattgccgttatgtatatttaaccaatatgaaagctcaatatatgcccactccgcagaattacgtctggatttaagcatttttcttatttcagaatcactaaggtttttaccttccagtttagctctggccttaacggtgggtaagtaattttgaaaaaccccataagaatgatggcctttacctgcctttaaattggctcctgccgaagactctttccatgatatagcagccattatatatcctaagccattattatcatatcggttttgtggaggtttttcctttccggatttttgatattgttcaccaaaattatatgcgtaatgcaagttgtcaagttggacattactgaaagttggctcagacccaaaggccgttgaacacaaggccattagaccgacaagcgcttttttcatgtttacctcaattaatgtgtataacttttgtgctgattttacctttcaaacgtttatcattaacgaatgccatacgacactttatactaggtccttttcccggtcttggaatatccatagtaaaccctagccacagatttccatccgtaatttctaaccgcatgggtttatactcgatattttcatcaatgtcttttgggtcaattggaagccaaggcattgctaaaaattcattaatttctttaaggtgattaggaattttggaaagaacagagaatacatactcttcatcaatttcacgttggatagcacggtccaacaaatgatcagagtacttagtgaagaaaggctctttaccctcggctttcgcccgggcacgaacagataaattcaaagagcgaaatgcttcctcaaacttacgacgcagtttagttctgcgaatgaatacttctgggttagttgacatagttcattctcctttgtttatagggccatagtatcatggcccgcaaggaaagtaaactactttttaatatttttcttctggttgaaacactgaacgacacgcccacattgaggcttccttcaggtgctgaatagcattgcgaatttgagtaatacgctcatgtgctaaatcaaattctttgtcgctcattgtgctaacatctaaattcatgtatttttcaacatgctcttcttctaatgctttaaaaattaatccaagacgaatttccgcgtctttgatagcatttactttaccaatcttttcatcggtatgtggcttatatcctttgatatcttcaattgccattatagtgcctctgtgaaagtacgagcgataacgtcgcgctgctgttccggagtcagggagttgaagcgtaccgcatagccggaaacacgaatggtcagctgcggatatttttccggatgctcaaccgcgtccagcagagtttcacgacgcagcacgttcacgttcaggtgctgaccgccttcaatttttaccgctggctggtattcaatttctacttcacgtgccttgtagccataaaaagtttcagcatccgtaatagtatcttctttaagaacttttgaaacgattactcgtgcgtcatcaccatcttcgatgtaaatggtgcctttaagttcaccttcaagaatttgatatgctttcatatttcctcttaattagattctttattccaaccacgcatgtatgcggtaattacactcattttattccattcgtctgaatgaaactttgcagctgcttctagataagttattttatcttcatgataagtaacttcttcatcagtttctttatcgtattccacaatttcaataggctcgttaactccatatccgcgagtgcctatatacgttgtagcttcttcccactgtttggttgtttcattccaagttccattctgatgggcttcatagaaatgctgctcgccagaattactgaaccaagcacagaagctttcaactaaatgtggaggacaccttataacaatttcagccattgcattgttttctcttgaatgcgttggtcatatgtgattaaacttgaactaatcacgcctttgagcttaccggatataaactcaattctaaaattaggatagcgattcatccacttcgtgttgggagcattagaaatgaattctgcgcctttgaatgggccagacagaaacttgtagcgcttgtactcaagcaggttgccagccgtaaccattgttattaattgcttcatatcggcaaatcctgtattttccatcactgtaatcatatcaacaatttctgtctgtgtcatcattgcattcctatcacgaaaaataaaggtaaggtatcattaggcatagaccatctgatagcttcctggtacatatcatagaacttcatcatatcgggaactttcattggttcttcaatgataattaatgctcttccaaactttcttcctctgaacttataagaggaatcattggatagaaattccctgattgtcatcggaacaattgatttagctatctcgttagccggtaatttattaattaaatgcgatgaattatattctcgtagaataccttccatcagttcagatgattgtgtgtatcgagtagataagattataaccgaaccatcttcaagcaaccaatcggtagcgaattggcataaggctgcggtctttccggtttgtcttccaccatctagacgaagggtaccgtactctcgcataaggcaagacggttcataaaaactgtagttgggattatttaatcgtctgtctgcagcgtctttgaaagcatgcatcagggtcaaataaattggtgttaagtatttcataagctctcttttaatggggccattccttggcgcatggagtgagtccattccgataccttatgtaactggcattgccacacttgggctcgaccttattacaggtaggcgggaatccctcatagaatcatgaggtccaggttattccaatgttgtttaaatgtaaatatgaatatactatcacaattctaggagaaagtaaactgttatttacctttaattactttagctgcttcgatagccgcttgctgaaggtcatccatagacataccgaatttagaagcaaagttatcaattttcttttcgacagcattcaaaggcttggcctgtttaccttcattagcgccaggaagagcgagaatacgctctttgtcaatataaaggcttacaagtttcttacggtctttatctgacaaatcatgaaatgaatgggcctttttatttatagcggcttctaatttacctgcactcactcgcgcttcagtgataaattctttataagttttcatttttaaatccagaaaggtaaaagttttaaattaaatggggccattccttggcacatgtttaatccatcgacacactatgtaaaccccttaccgcacttgcgctcgaccttattacaggtaggaaaagctacttcactcagaggactcgacgttcatgaggagaggtcgtgttcggctttattaggaaattgcttacttaattgatttagcgtaacgaatagcgccgcgatcgtttacgaatgcaattttaccattacgcatgtacatggtaaccgtacgctggtaaccgttagaagttttaccagactgataacctactaatgcaaagttatcttcaccaggtttgttctgcttagacttaatacgcatatgtccatgggccattaaagagcgtgcatcgccagatgctactgctttgcgagaagattcatcttcaaccgaagagacaaaatcatcgaatgaatcaaacttagcatggctcttattatataacttgccgtctactacgtagttatatccaacaacgtccatttcaatttctgtgccatcttctagtgtggcggtcatcttctggccttttttaaatttcagaagattacttccaacagattcagtcattacgccaactgttgctaaacgggattcatttaaaaattcttgataggttttcatttattttccttgataagcagaccaagttccggtccgcattgtttcaattacacgacgagcacgattaggtgtctgacgataccaacgtgaatttgcaagttccttggcagcagcatcccattttttagtgagtaataacttcattgaagctgggaacccggctacaccagacacacccatttggaataccatgttaatcagagcagctctacgaacatcatctaatacattatataccgggtttaatgtagcattagcaacaatacctttaattgccttctcaacatctttggcaaaaattacttctgcctcagcctgagtaatttgaccaccagtagaacgacctaccagtttgtccagattagaaatagccaaagattttgacgggtctttagtcagtaagtgaccaataccgatagtccaatacccttcgctatctttataaattttgctgtcgtatccttcatcaatacgcagcatgccaaaaatatccataaggacctcctattaattataggagtatttatttggccctgcacttggctatgaataactcaaggctgcacttctcgtatggtgtccatttatctttccaccacacataatctcttctatcgtcctctggaatttcattaaatccgggatacagcttttctgctatgtaatatgttgattttgtatactcgccgtcaccgaagacgtatcgtgatttcaatagtatacgcgacattttatctctaggatgaaatatgctaacccattttccatcgtgaataaatcgtagctcatgcttataaatgtgtggaatgcctaattcaacggcttcttccataataacctcactgagctgtgctatacatttgtgtcatgattttatacaaacttggtcccatcacatatttccactggcttggtttaattaaagcaaatgcatcgatttcaggaaaattaattccattttcatctttatggtaagctgtacaacggcaatttctgaacatttctgggctcacagggagcatatatccaaacagatggatatccttgttgcttgcataatcatgtcgtccaaggtcatataagaggtcttggtcaaactcggtaaatccagtctcttccttgcattcgcgaatagcagcctcttttggtgtttcaccaggctcaacatgtccttttggaatatcccatctagagcctctgccctggatatatgtatttgtcatacgacccatgaaaagccgtttgtcatcggtaaagaataaaattcctgcactgagctctttcattggcattcgttccagctttcttcaagaatatcttccatggcagtatagaccatagactctaatacaccatcacagttatatgaaccctctaccgagaaatcacagataggtccattaataccaagcagttcttctttaagtgaaatctcgataccgctcagtgattcattatcgctgtaacacagaaggcgagtatcaccattttcaaattttacatgcactgcaacagccattatttcatctccttaatccaggataaagtttcattgcgagagtcatctttagatttttctttctttactttgggcttatcaaatacaccccgctgtcgttgggaaacgaattgcaaccaacgagcaagcattgcaaaccaagttccaacacctgacatccaacctagatagtacaatgtatcaccaaatactggtgaaaagaagtagaatccccagaatatcccaacaccaacaaatgttgagaaggaaaacaggataagcagaaataggaagaaatacaagaaatcatcgtctttaatcattccacgataacaagttttaatcattttctgcagctcctaatccaggtgttgaaatcttctttttctttccacttcttgtatttcatacggtaagctaaaaatgtgcagcaattaatcaacgcgataattagcatccacatgaggctgaatacgaaaacacctaaaaataaaagcataatcataaactctgagacgttcaatccaaagaatgtccctccaacaattacaaaagcacaatataaaatccatgtcacgattccaaaagctggcgccagcccatcttggttccaaaacccgtcaggtttacattcattcattttcttctcacctctttaataaactcaaacgactttttgcggttccattcaagagttaaattcttgcactgttctttccattcagcctttcgttcacagttatgcttaacatactttacccaacgaaatagctcaattaatcctagaccaagtaaacctattaatccccatgtaagtaatagtacattcactaatgatgtactgctaatttcagccaaattcattacgtcgattatgataagcgttatcatagttccagcagcacagaccatccccggaattagaacataatcagtttggtcaaatttatagacataattataaacgggaggttcacttggcagatataaattactcatttctgcaccctctcgcggcagtatttgataaattcatcaatgattaattgtttgcctaccatgttgttagagtcaaacatacccatgacttttggtggtaattcattaacgcagtaatttaaataattgctataatcatcctgagatgtcacgtatttaaccagattaataccgagacgataactagttttattatagataatctcgataactactgtatatgttgtggagctagaagtaaaatattcatcggcattagtacgggctgattttaaatttgatggagaatcgttgaaagaataaattccgtaccgaagtgcaaaaatatccacaagcttaactccgtcggaaatagacgaaatactggaaattaagtttttcagcttgtagtagtctttaagaacgatagcccgcggcaaaactgtggtgttatacccgttatagcgagttttccaattttcaggccgagtatcaggatgagcaaatttttcgagaacatcagtgatttctgttgggaatcctgctgcaattaattctttaatttgaggtgttgccattggaatatctccagcgcattcatataacattttattatccaagttaggggcccgaaggccccggtaaaattacttcagactttccagatattcctggacatcagcagtggtggtttcaataccaggctgagtaccgctgaaggtttcaactttcatcatgatgtcttgtacatctactttagcgagttccgcgatttcaatcacgtcatcagcagaggtaatacccagagcagaagcattacgggtctcacggatgtattcgagtttcactgccaaatcaagacgctggtcatcaagcttaactacagtttcttcaatttgggcccgcatttctttatattcggcagctttatcacgtaaagccttagcagtacgacgatacagaagacccagtttagcatgggtttctacattcataccttctgccatcaagcgacgaatttcacgctctttggaagcacctgcctggtctttttcgtcagcaagtttcagcagacgcttttcttcatttaccgatttaacatgcgtggtacgcagtttagtgatttcatcaataatacgatttgctgcagtggtgtactggtcttcaacagaagtgttctgtgcaacaaaggtaccgaatttagaacggatgaattcaacaagttttttcagaatagacattttatttcctttcaatagttatggtggttttattcgtacggattaatccaatcataaacatatggtttaatgattagaccctgttcatttttgctgcgctcgaatatctcgatataatcagtaacgtatgattctaatccgagaataagtacagactctttgccttcttctactgttgctttaattaaacgctcgatggctattttagcttcaagacgaatatcagcaagagtttttggaacttcatttgtatgcattaatgagttcctccattttgtccaaaactgcgatatcaacaagacgattaacctccgggtcatcggcaaattcattgtaagttgaaatcaccaggttctcgatagttttcagtgcagccattcgttcttcaccggatggaaaatttggagtttcaccaaacagcctagcaaaagatttaaaataagtttgcgctactaatttcaacttatcttgatacataccaatttcctcagtaggtggggagttcattataactccccaaaattattagcagttaattaccgcttcaattcgtttaaccaaagcaggaacagttttagcaaacttgatagccatttgaaccgtagcagcttcttcatggtaaactcgaacatagtactcttcaacagcaggccaatctttgcgaacgtgtttaatcaaatctttcagttcacgggtttctgctacgctgaacactgcattctcatgttcgcctttaatccaaaccgcgcgataacgatcaggagtaccgtattgattataaccacgttcaatttggataaagttgaatttagacattttattctccgttactctgttttgttttgatggagctatagtaaccgagttaactggcgttgtaaacaactttgtgcacaaattttcaaataattttagggaatctggaaggactttctggagagtagaatggatttatacagcttgggatatagaaatgccctagatgatttctagggcaataggatttcattatacggtataggataacccagtttggcgacttagttcaacaagatgatgacgcagctgagacagcagaacttttacttcgccaatgtgttgtgtctcatgggcagatggcttagatccttgtgacgcgcgatatttgtatagattatcgagataaacctcaattgatttgtagagggctccattgtcacgtactagcggaatcatctggtcgattgcgctgaacagttcgccagaaccaataatgctaccatattttccacgaacttttagacctggaacatctttcggagcttctttaacaactggcttaacaggttctgctttaggtgcttgtggcgcaggagttgcttttgtggttggcgcagatttttgcccagtcagagatttgaatgcattctgtactttatagtagtcaccaggattgttagtgctgatgccataaagcttttctacggacgcagcaaatttcataaaatctccacgctcaccttttggtaccatgtccatagctgactgccatttaccctttgtcatccgtacggatgcttcgtttaaaaattctttaaaattcattataaattcctaagtattagtgttgatttactatatactatttatactaaaaagccccgtccgaagacagggctctgagaatcgacagcatcacctactggcagatgacctgcgaaattcatttctttggactcggaggcatcagtctcatccaaagaagtatagcgtcaggaggttatgcttgcgacagggaacaaccggctagcggtaatggacgaaccattctcttctatctgacgactcaacgagggcatacgcaagtttcccttcgaattacattacatcgtattcttcaactagatactgataataggaatcgtttgcttcaagttcttccgcatatgatgttgcttcggatttagtgtgaaaaatcttaagaggcaaagaatattcttcatagccatattcacagttccagttattttttactacagcatatactttcatattttcctcattaatttttggtatgggtaggaatcgaacctacaagccattcagcaccagggcctcacgctctacctatttgagctatcacataccagaatttggtgccgattgcaggagtcgaacccgcggcatcttcattacaagtgaagcgctctaccaactgagctaaatcggcgtggtatccccacctggactcgaaccagggactagggtttagaagacccttgttatatcctcttaactatagggacatttggtgcgtcgaacgagactcgaactcgtacgggtttaatcccgggagattttaagtctcctttgtctaccaattccaacatcgacgcaaatatttgttcaggcaggactcgaacctgcacgactgattccgtcggcgatttaccaccatcgccagcatatgatgcaatatgcgagctcaaaaggtgtccgtcaccatgtctaccgatttcaacactgaacaagataattatattactgattatttatagcatttctcaaacgataaagttgattacagaattcgcgttcagtcaaaatcgtttcagaaattttatttttacccatactgtgagtgagcgtagcattccgggtagcagccaaagcttttctgaatccttcatttttactaagtgcatcatatgctcctgttagtaaattctgatatgcttctgaagctcgatgaataggaacacctttccaataaagcgtttgtgttggccaccaacgtttcttcttacctttaaacttagcggactttccgactagtgtacatacatgtgcttgcatttcaggcgaagaaaatttgagggactgcaagaatccctccattgatgcgcattctacgccatcatagataaatttatgaggagcgaaattactcaaagcacatgatggatatgaactacctgaaccgatatccattacttttccttcacgtatttcaaccaatcaacttttaatgggctttctttctgcttatacgtaattccaacatggaatgcaatcggtgcgtcaggaatacgaatttcttcttcaatgttgaagatttctactttctcaaatactcgcatgaaatcatagtcatattcaattggattacccagccaagcctgaatagcatacataacttcatttgagcaagaataatggttatctaaataagcatcaaactcttcatctgtgcaatcatatgcaggaacatcaacaccaaagaatttcttggaaaattcaggagttacatacttctgttcagtatgaagcttttcaagaattgcttcatggttgtaatcattatttccaaggcattcaccacgccgaccattagaagagaaccattcaagaacatgaattacttgattaatctcttccttttctaagccataaaccatttgggtagaataccggtcagcatcattttcccaagtggtaattgccattgctaagcctttaggaataacttgtccaaatttaatatgcatttcaatttccttagttgataatttggtgaccctggcaaagactcgaacatgcaaccaatcccttatgaggggaacgctctaccaattgagctacagggcctttatagaaatcttatgacttttataaaagccctccgaagagggcgccttgtcgggcttatccacctgctaggcagaattactcacacataaaatcagctacttcccagaagtcatttttaactgctactttaaccaccggataaatttcagatgttttaatagaaacaattacatcacctgcgacagtttctaccagaccaacgattttctcgctgcgagcaacaaatttactcaccggatgaaatttaccggtagcagcgaacatagcttcttggtcaacaatcagtgcgatacgtttcattctttttccttgtttgttttgatgtagtaataataacaggttattcttgtagcattaaatctcgaaaatcgttccgttttcccacattgttgtgaacataggagaaaccttaacgaatgatttgcttcgcattgcaacgtagtcgttatctactttagccaatcctgaagcaatatcagtaatgcggccacacttcatagaaccgcgaccacctttattgtatgtgcgttctccgtagaaaacgatatcaccaacttgtacttctcggcctttagaatctttcatcatattttgcctgctgaattcgtttaaaatcgttaacaagttcttttgggtccaacgcattgttaaatggaagaacttgacgtagtttacttactttacaaccagagtgataagcaataacctcttgaatatcacgctcactgaagtattcatatttaatcagtgaatcatatcggcatttaatccatacccacatacctttgcgttcatcaaatgcatatgcaaagtcagcgttaatcattaaatcccgtttagcaaaagatgaaagccctaatgctaaattaaccggtccatccaaagacagcttcaccgtaatagcatttactttatttgcaacaccaataaaaatattcattctatttccttcgcttgttttggccttcttgtcgtgcacgagaacgtcctgctttatgcagtgattcgtaatatgctcggcgtctatcaatgttttctgtacgatatgctttcccgaaatgggatgttttgaagccgtaatatttcataatataattctcaatggcaagtgattggacggtatgcccggcctcgaaccgagtcacatggactttgcagaatccgtgtgtttaatatatcacccatactcgatagcatatctgaacgagactgcaatcccgctactcagcttacaccatcttgtattgtgtcataccgataatttggtctccatagaatgactcgaacattcgacctctccatcccaaatggagcgctctaccagactgagctatacggagtaattttgatttaaaattcttcttgcttgagtgtgacttacaccaatatgtttagcatatttagataattcgcctcgtttagaaaaatcatataatttagaaatttccattctgtaagctctttcatctgtactaactctagctaagtttaattcggatatctttttcttgaattcagccgaatggtgttttcctgcaaatccgcttggcttaccagccatattatctttccatgtaggtaaatccaaggatttcactgattttgaaatctttttcttatgctcatctgataaaggtttattagcacaagattttccaacttttgacatattagttcttcgttgttcggacaagatttcattattacatatgtggtcccatccgccttcaccaccaagctttaagttatatgtatcaggccttttaataaattcttcatttactaggtgtctttccgcatcatacatatctttagcattatcaaaagtttcgagaatttctttttcaaaattttctttgccgtactttttaatagcacgctttaaattcttaccagaacccatgtatccatcttccaacttagaagtagaatgaactccaatataaaacttttgatttattttatttgtaattttataaagatagtaatgcatatcagttcctattaaaagaaccgagcgtctctcgacgagtcacaatttggagcatccaaagggaatcgaacccttatcaagtgagtggaagtcacctataatagccgttatacgatggatgcaaatttggcaggccctgaaggaatcgaaccctcatcactgggtttggagcccagcataatagccgttatactaagaacctgttatttggtgggagtaactggactcgaaccagtcaccgctcgattatcggtcgagagctctaccaaatgagctatactcccatggaaagctaatcatctaattgttgatgtaccactgctatgggcagcgtttaactttcataaatttggcggagagtaaaggagttgaaccctcaccgtttccgatggcccggatttcaagtccggtttgctaccactagcgctactctccaatatttggtgaaggaagtgccatatagacacaattcgcttagcgacaacccagcatgactgtgggtcgtgtatttttccaccattccttcattgttggggtgaccggcggaatttgaatccgcgactacgagaatcacaatctcgagttctaccaactgaactacggccacatcaatattcactccatccatcatgaggacttcatacgaaattaagagaagaatgatcagttcaacccctgtagacgcgttgaatgaatattaatttggctggactatctggattcgaaccagagataccggagtcaaaggccggtgacttaaccgcttgtctatagtccaattatttggaggcggaggcaggactcgaacctgcgcgtgtcgggatatgagcccaacattctaccaactgaagttactccgcatttatccgggttcttgaagtactaacaagtagcttgatgtagaacacgctaaagatataatcttacgaatatagagcttattccgtgggaacaaacagcttcgtcctcggcattatctcacaggactcaaactcatcttcaagaactgccacgttcttatttggcggacctaacggaattcgaatccgtgactctcgcgtgacaggcgagtattttaaccgctgaaactataggtccataattcgctttcagagatactctggcacgatgccgaagcaaaggggaacaggactctcatcaccttggtaccagatgaatcttgtttagcactctgttctaagatgtatccctgaaagcgaactttcaacgccgtaagaaattataacatgaacaagcattaagcaggatgaaatcatactccttaatacaaacgccatgccagggatttctgtgccgacgattttatcagaacgtcttctgacttcttcatttggcgggccgtgcaggtatcgaacctgcctagtcatttctgacacggattaacagtccgtcgcttaccctctcagccaacgacccgaatttggtgggacaccgaagactcgaacttcggacacccggattaaaagtccggtgctctaaccaactgagctagtatccctaaatttggtggggagtaatggagtcgaaccactcgagccttttgagcaacagatttacagtctgtcccgctacccctacggtctaactccccaatgggtaattttatttatactgctctaaaattaatcagagcagttgatagattaataataacaaagaaaacctaaagcatattacacaatcggtgagctctttgatttaaccaggaatacccgatgtggtgaatccatatgagagagcaatacccggtgctcaggaattggacttgtatggaaaggaaccacacgataacctttaggagtaaatcctagcaaaataccaacgcttgctgcagaaagtgacccaccacagtagtatgataccaaatcaccaggctggatttcattgtcaagagaatcggttttgacatgcttaggcgtaactaaatcactaggaattggaacgccttgtgcatcatagtattcatgggcaagaagcttataattctcttgatagaaagtattaaacgcagctctgatattcatcacaatttcctcacaattaatctttgtatgcttcagttgaacctttagcaacggtctcaaatcgggaattcagtatctcaaaatagtcttgatacgttccctggagggcttcatagcattcttctaccgtagaatagacacctctgatttggtcagagccaggagcaggataataattagaccaagttaaaagtgcatacattacttacgtttccagctataatgagccaaaataagaagcactgcaatagcaagtagtgatgaatgcagtgctgccagtagtgcacctagtcctacgcccaaagtaacataatcatacttagttacttcttcacggtgtaaatcatagtttttgatgaaccactgcttaatctttttcatgtgctattttatccattatgaaagaaatgatacccattagaaatgcaacacttaacactgatactgtttcaggaagagacataaaggctgcaccgataatgccaaaacctaacgctcccatgcagatagttgatgcaacatttctaattaattcacaacgtttcattttattctcctcaagttgatagggttatagtatcactactacaacccgttgtaaacaactttattcagcgccagcggcttttaaaagctttttaagattagcagaacctcgggcagaaaaagttaccttaccatctttttcaccgatgctgccggtcaatttagaaagtttatcgctaggaacttttttaaaatcggctaatgtcccgtcaacggtttttgtaacaatcggcagttcatcatcctgtcttttagcttctgtaataaattcttggtacgttttcatgttgcttccgtttggttagtttgttttgatggagctatagtatcaccactaggaccggttgtaaacaactttgtgaaataaattcctatttcaaatcttctgaccagtccagttttagtggctcttggtactctctatcaagcactacaggtacttgaacttcaccctcgaagtgagctggacctacattgtagctgagagtaatgtgcggtgagtaatctgggaaatcatgagttgctcccaaagctcttgcatattggtgacggaattttaagtattctgaatctagcttaagaactagcgtacgtccgtcttgtgtgtcccatacttcaagtttacctgatgtagcaacttcaaaacttcctgaagcacaaacgtatggaacatgaactcttgaatagcatatcgtcgtatgaattttatgacgaggaactggattagggaccttcaactcacgctgaaggtcctcaatagcatcaagagttttctcagagaatttagcagctacatatagaccagtgctaaaatcactgaagttcattaggcatcagcttcttcagtggtttcttctgcgaactgtgcttcgatttttgcaacgaggtcatcaagtttaacctgaccgtcttcgctgatttcaacgccggatacagcaatcagcttctgcagtacttcttcatactgtgcacgcagagcagaaaggccttggatagtttcagacaggtcaaatacacgaactttcagagtatcgacttgggcttgcagttgttcagtagtcatttttgaattcctaatatagtgttgatttttgaataaagttcttctagagaaccgtcgttagttattacgatatcgccttcgcgaatcggaagtccacgctctgtgacgtgagtatcttttttagaaccttcttgctcaggacgaactacatgaataactgtagcacccatcgccctggctacatcaagttcatggtcttggcgggtatctgggacaatgaaataatcataatcaccaaaagtatcagccataaccaaagtgaatcgttttacccaatacatgcgatcgagcttatcacagacaatgtcagtcccaagggtctgcatgagacgacgaattgaccatggctcaacaggtttatttattacaactttacggatgacttccatcgtatcaccgtcaagtattttacgtttgttatcataaaccacaccaggtaaaggcaaatcatgatgaacatattcaatcgcgttcgccatgatacgaatcacgtctttagtagacagatttaaatcttgttcacgatcgtaatcaataccttcaatcatcgaccgagtaatgcgaggaaactgacgtgatgtatcgcgataccactcagtaagcattgcatcagccaacgcatctttaattggacctgctaactgatgctttgttgcgttatagttatccataatgtagtcagcagttgtatctttgccactacgttttttaccaatcaaaaataaaagcttcaaattattacctcatagaaggatgcattcccataactttctgttgatactgggattcgcgagtatcattgacagaaggtctaccagtaattattataccatctttttcaacttcgatgtatttgtactgcaaagttgctacacataccattgctgggtcggattcttcggttaaagaatactcaatttcagataaatcactcacccaacctccgatgtagcggacagttaatactatatcatgtttatcgttatcaagaacatgcattaaaactgcgccaggaaatccttcaccgccgttattccatccagacttgtctcggtcaatgtagttttgacagcttaacatccatttgtacatttgtacccatgaatcaagattttcatctactaaaaatctaacaggaacagcgtcaaactcaaaagtagacccaggcaatttagcacgatgcatgccttgaggcgagcctacagtatcagtagcaggaatatgaattccaggaactacagctgtttgaagattagctttaaacgcttgggtgaggcccccatcagggacctctaatataaagttagttgtgttagtttgattaaacagtccagtagacattatgatttccatacagaagtagcagagtagcgtttgcctttcgacatgaactgctgcagtggtaacatgactacattcgcccaatcagccggttttatctcaattaaagcaccctttatattaccaggaatatatgctttaatcattttgtcagcgccagcaaatcctttaacttggctccagtttatctttaatctggtcttattagatatcactggcgtattagcatactgtttaagaagttcttctaaaaactgctgacgagcctttggcggaatgtagtgaaggtttaacccatacatcaatgtggttgtaccttgctttccaagaccaagataaactatcaaaggaaatttatcccagaatggaagagtgtctttgtgcttagcgtcatacatgtaagcatatagctttccaggttgaggcttggttacagaatgaccacgtatatttttctttatagtttctgcaaaccatttagcagatttattgtttactgctgcgccttcattacgaattttatctttgatagagcttcgaaatgaatttaccatcacaagagcacgctcctgtttggtcattttgttagcaggttttttctcaatttctgctactttaattgccgttttaattcttgatgcatgacgagccattgctttactgaacgtagcaggatttattcctttgctttcagcgaatgatttagacgtcatgccttttttacgagcagcagagtattcaactcctaatgctacccattgattttcactacgggatttagctttaggcgattctgcagcttcagtgataaattcaaatatagccatcagcctttccatcctaattttttaagtgaatcttcggtaattaacctaaattctatacccattttactggcagtagcttgagctgctttccacttatcaacgtttacagaccatgtgtaaatttcatcaatgtaccgtttcttcgctgatgtcgtcaactttgtgggtttgaccggaggtctagtttctttcttcggcttaacttcaaaaaagaactgttgaccattagaaaacttagcccagaaatccatgaaataacggcgtttctttccatcagcattgctgaagtatggaattaccacgcattctgagttccaactaactacatctgggtggttatctaaccaccgcatcatgaaattgctcccaagtagatcggtatgtgatcttacgagggtcccccttatatttgcttaagttttttggtaaaaattttccgctatacgccattaggcttctccttacatttgtcaaagtgccaacacttcattccacgaggttttcctgatttgccacagtgaggacatgttactacaggttgagattctgaaacagccctaagctttgctcgagtttcttccgatctcttctttccggtgttagctaaatttaatttattttggtgctctttagttctatttttagctgcagtagacatgttttgtttcattgtatcgctttttgaaacacctgtcatagaaatactgcgcttttcatttgattctaatgtctgagactttccagtaagagctgcagacagtttagctgaccattcctttgacctttgacttcgcttctttcctgttaatatcacagaattagcaatagaaactcttttgcgaatccattcatatgatttgttatttcttcctgctaatttagaagacatgatatgaactgcgtatgataacttgtgattatctggataaatcttagctaaaagctgatgcgcaacataatgttcagctgcagtcaaatctacgaggttatcttcatcatcagtaccacccatacatcttggtacaatatgatgtcgttctttatatccttccaagctgcgagatttgcctctctcaataagctgatcataaattttacgataattcatattattctcctcagtagttgatagggtaataataccataaaccactcgtcatgtatactacaactttataaatactgttattaatatttataagaggataaactatgctcttctcattttttagtccgatagattattctgcaaagaccgtaaaaggtgctaaggcaaaagctatcccaaccgctgacatatttcgtaattatcgcaaatattttgacactgtggcagaaaactatcttttacaaacatattacataagtggagctcctagaccagaagaattagcatatattctttatggaaatagtcagctgtactggattcttttaatgtgtaataatgtatatgacccgtttagagattggattaaaacccaggatgcatgctatcaatttgcacaacaaaaatatgcagatgtaggtggagaccaaatactctatcacgtggatgcaaacggcaatcgttattataacctcgagcaatatcctgaaaattcaggcatttggtatgataaaggggactttaatcaccagtaccctcaatatactggggctttagctggtgttgacatttatgaagactctattatagaaaatgaaaaactgcgccaaataaacattatcaatcctagtgatattgaggcatttctttctgatattatacgagaaatggaaaaagcacctgacagcgaatacgaatcaggccggtacaaatcccagactacaatcggagaagttttatgattgaaatgaatgattcattaaaatggtttaccggtgttgttgaagacagacaagacccgttgaaacaaggaagagtgcgagtacgtgtttatgggcttcatccatttgaaaaggtgcaaggagctataaccggtcttcctaccgaagaccttccttggatgtcagtgattcagcctactaactcagctggaatttccggagttggctcgtctataactggaatggtggaaggaacatcggtatttggcttatggcttgatgaattcaaaacagcaggattagtaataggaacatattctgcgcacagaaaaactaagccaaactacacggaaggtttttctgaccccacaggtcaatatcctagacaggttgggtcagataccaacccactagttcaaggcgatgaaactgggtatagtgctataccaaacatcatccaagatagaaacttggatattggcattaatcctgacgatgctgacctaagcgatattcctgaagacccaaatcctgcaattacaataacagatatgcttaatagggatgaaggtcttagattgaaagtctattgggatacagaaggatatcctactgtaggtattggacaccttatcatggcacaaaaagtacgtgatatgtctgtcattaataaaactttatctaatcaggttggtcgtactgttacaggaaatcccggtatcattacaatggacgaagcagttgcactatttaagaaagatcgtgataaaatgctttctgatattaaaacgaattcacgggtaggacctgtatatgctaaagtcaacaaatcaaggcaaatggctttagaaaatatgagttttcaaatgggcgtaggtggattagcaaaatttggtaaaatgcttgatgccatgctcattggtgattggaaaaccgcttatacagaagcaagaaactctgtttggtttaatcagacaaaaggtcgtgcttctcgtgtttccatgattattctaacgggtaatatggaatcatatggagttcctgctccaaagccagaaggaaaaaacctgtctgcggcttatgtagaaccgaagtctggtggtaatcctgaagacccatggaccccagaggattcaagaattctttttaaagagcccgaatcttcatataatggtcaatatccatatgtacatacgatggaaacagaatcaggccatatccaagaatttgatgatacgcctggctatgaacgctatcgtattgttcatccaaccggttcatatgaagaggttgctcctgatggacgtcgtaccagaaaaactgtagccgatttatatgacatgactcagggcgatggaaatattttaatctctggggataagaaggttaacgttggagggaacgagacctattataacatgtataatcgtcgacagcaaattgatggcgataacacgctttatgtacgtggaaatgaaactaaaacgattgaaggtgatggtactatttttgtcaagggtaacattaagatagtcgttgaaggaaatgctgatatccaagtcaatggtgatgccactactaaagtagatggcaaccacgacgtgaccgtcggtggtaatttaacttggcaggtagcaggtactgtgaattggaatgttggtggggcttggactgaaacaatggcttctatgagctcaatcgcccaaggccaatacactgttgatggttcacgaattgatgtaggttaatcatggctgatatacttcctattaataccacgttacgcgaagtaatagaaggtgaatacgttgagcagtactttactgctcaattatctaccaacgaaacattaaaatcaataaatattatcgactatcaaccagtatctgatatctctgtgtctgaaacctattataaaggtaattataactcagtttttacttttggaaacgatgtgcttaaataccgtgaaggtgatgagctaaagtccgcttcagcgtgggaggatttacctaatcccaaaactgctgatttgtatctatggaaagcccccagaacactagagaagacatttacctatacagttgagataatatatacagtgacagaagaatcgtctggaggttcatccggaggttctagcgctccaatcataacagaacataaaaagcaaaagatttactctcaaaccgttaaaggcaactggagtagatggggcgaccaacttcgtgcttacgtatatgcggggaattaaatggctggtctttcatatgataaatgcataactgccgggcatagtgcgtatcctccgacagaagtaaatgctacacaaagtaaagtattcactggtggaatagcggtattagttgatggcgactcaattaccccacacaccaagacggttgaccctcatgatacgcatggaggagttgttcaacctcgcacatccaaggtatttgtaacaggcaaaaaagctgttcaaatggccgatccaatttcttgtggcgacactgtcgcgcaatcaagctcaaaggtattcatacactaatggctattaaagaacctttaaattatcagttaacgcgtactgcaaacgctatcccagacgcatttactggagcaacattcgatgaaattaaaaatcagcttattaactggcttagcggtcaaaaagagtttcaggactttgattttgctggttcgcgtttaaacgtgctattagacttattagcatataacacgctttacatacagcaatttagtaatactgctttatacgaaagctttatcggaacagctaacttgagaagttccgttgttcaagcagctcagcaaaacgggtatttgccaagttccaaatcagcggctactgcgtctattatgcttgaggtaactcatccaaatccagagccagcaataaaaatacctcgtggaaccaagtttttagcatatgcacgagattcatcagtagacccatacaactttgttgttactgaaaatgttattgcgctaagagatacttcagcaccagaaggggttaatagatatcttcctattgtcaatttggcgcagggacgtattattcgtactcagttgtcatatgacccgaagaaacctattgttattcgcgatcagtcaattgaccgcaagcaggttaagctgtgggtggatggcgctgaatggactaactggacagaccggtcaatggttcatgcttcgtctatttcaacgatttattatatgcgtgaaactgtcgatggaaataccgaattcttctttggtgaaggcgtggcagaagcctctgtagcaggaggagttcttgaaagtaatttcattggtggattaaaacctactaagggtgcgcaagtcgttattgaatatattcgtactgatggtgaagctgcgaatggtgcgactgatttcagctatgctgataccctgcaatatatcgtagtaaacaaaatcattgaaaactggtcagattctcctgattatgttggtgctgatggtggtggggaacctgaagacatcgagcgtattcgtgagctcgcccagattaagcgcgaatctcaaatgcgttgcgtgtctaaaactgactatgaatcattcgttagttcacgctttggttctatcgtacaagcagtgcaatgctttactgatcaggacaaacccggatatgcatttatcgcaattaaaccaaaatctgggttgcagttaactgcggttcaacgagaagacattcaggattatctaaaacctttctgtcttgctccgattactccttcggtaatgagtccagactacttgttcatccgtcacaatattaaagcttcttatgcattgaataagttgcaagaatcagagcagtggttacagtcaaaaattatagactcgattaatagatattatgttgatgaagttgaaatgttcaacaaaaatttcagtaaatctaagttgttgacttacattgatgacactgaccactcaatcatcggttcttctgtggatattcagatggttcgtgaaattgtcaactatttcactcttcctagcgcaggtattaaatactataatactattactccgcggacgttacgttctggtgatttggtctttactgttaccccaactgctgaaccgtattcagttaatatcgttggaactgacccagataaaaatggcaaaggaaatatggttattggaccatttaaaccaggtgacattaaagagaatactcatatccagccatatactgaaaacgattttgatagaactaccgtcggcgaaagaactcgttggtacaaaatcggtgaagtagattattatggtgataatatttactggagccttggagctattggagccgatcctcttcagtttgaagaccagagtattgagctttattctactcctacccaggatatcgtcttcgcccgcgatggaacacttatcgtatttgagaatgaccttcgtcctcaatacacaactattaaattggagcctattacagcttaatgaagtataatgaaatttatgatagtttaattaaaagaggcctcgaaagaggccttaataaaaagaagcttgattatcatacagaaaaacatcacattattcctaagtgtatgggaggagttaataataattctaactatgtattgctaactcccagagaacattttgtagctcatcaattgttagtaaaaatatataaagatactaagtatttctataagttagttagagctctcaacgcgatgtcaatgtttaatgataaatattctagacccaacgctaaagaatatgaatgggtacgaactttatgttataacgcgaataaattgactaatgtgggaagaaagcataaacctgaaactctacgtctgttctcggagcaacgtagaggtgctaataacccaatgtatggaagaaagggtgaattgtctccatcatttggtaaaaagaggagtaaagaatctaatgataagatatggttaaatcgaagcagaaatattagtcagaaagcaaaatataatatttcaaaggggaaacgaacatctcctatatggaaagaacctatgtataatgaattgtttaatttatacataagtaatccggtaggaggatgcgcgtttagaactaaagccgtgtctttaggatatcctaatacttcataccacagactagtacaagaatttaaggaaattactcaatgacaattgcaccgttcgtcaccagcttacgaattcataagctatctgcgaatcaggtcaatattcgttgggatgacgttggtgcaaacttctactattttgtagaactggccgaaactcgaaacagagcgggggaagttatccccgctgataacttgagttggtcttcactgggttataccgcggataatgattggttcgaacaaaatcgtattgaaccgcttacttattataaaatgcgtgttcaaactacgtcagcagggtttgagccgtctgaatgggttgaaacagaagagttccaaacttttgaagaaaacgcatacacatttgagcatatgcaagaattcagtttagtgaaagaattcattaaacagaagttttctttaaacaacatgtcgtatgttaacttcaacacatctgccatgatggcatctttgatgactgagtcttttcagtttagtcctgaatattctcatttatcagctattgaaaacttcgttgtaggtgaatctggatatcatgaaattcagggacctattgaagcagtgtgtgttgataaaaatagaactatgctgggagaaatagacggaattttgtatctgtttgaaagattccaacatatggttaaagtatcaaacgataaaggacagaactggcaatacgttcagttatttaatgaccgtgtaggaaatcctgtttcacgagtagtaatttatcaatcaagtaccacatcatatgttttaggctatgataaaatcttttacggaagaaaatcatctgacgtacgctggtcatcaaatgaggttaaatttagcgataacgaagtcacgttcgctaaattgggagaccagttaaaactgggatttgaagtagagttatttggtacatatgcatcactacctgctgatgttaccaaatatgcagaagcctttacatgcaatgatgaccacttatatgtagttgcaaaggatacagtacgcagagttaaattaaaagatgctccaatagacactgaccctttaagccctacatttggtgaaaaagtgtttgaaaaggaagtatctcatataacaggcaatcctaaatctgtatgctttaaaatggattccgttggaggcaaaatctttgcccttattaccggggaagttaaaaccttaggattagacccaacagacccaaggaacgttgtggattctgcaactaaaggcgtctatgtttaccaggaaggcacaaatacttggaagcgtgtatttggtaataccgatgaagaaaaacgtcgtatagagcatttatggacttctatgtcaactgacggaaaggaaatattcttttcatcagctaattttaagacaacagagtacgctcaggatattgagcttgagacgaaatatccagaactaatttctactgcagttaaaaatgttaatccaattcagtatcactctgataagcattatcacatgatgagtttcagagcagatgaattttcaggatgggaaacatttgttcctggacctatgaggttttatgctgaaccttggtttgtctggatggctcgtgaaggcaacagatgctggataagtacagctgaccatgcagttgtcatttataatgatattctttatcaaaaaagagtagatgcagcggcgcagggaactaccgagcgtattctatcggaagtgtgggataaaggtgacgcaacgttttattgccctccagtttcatttaatggatttttgcagtatgcttctggcatcatgtttcacgaaccagacggaaaactgataggctattacgcatttgactaccgtgttcgtgaccaggtaacgcttaactggaaaccaactgatgtaatgtttaaggcgtttctgcagaaccaaacacgggaagaagactggacacctgaacatactccaggcttacgtgacccagatttgcgtccgtatcttactaaaatgatgccggatagttacttgctacaagatagtaattttgagcacttttgtaagtactatctccaattcctttcagatggaaatggaacacattacaacagtctcgttaatcttgttaagaacaaatatcctcgcgaagaaaatgcatgggaatatctgtggtcagaagtttataaacgcaacatttatctgagtaaagacgctcgtgacgctgtcgtccgtttctttgaagcacgcaagaatgatttctatgctactaaaggaattgaagactcatataagttcctgtttaaacttctttataacgaagacgtcgaaatcgatattgagtcaaagaacactaccgaatatgacattattgttgaaagtacaaatatttctgacgatttagttggtcgtacgatttatactgcttccggtcgtagtaatgtgacttatatcgagagagaataccgggatggtcgtctgttatggcgtattactattcataacttatcaggacggttcattgaaggccaggaaattaaatcagagcgtacggactttgagggtattatagttcaaggtgtccgtggaaaggatatgctgagtaataacattgattatataaaccgcagccgttcttactatgttatgaaaattaagtctcagcttcctacttctcgtttccgcgacgatgtattaaggtttgttcatccggtaggtttcggtttcattggtataacattgctgacaatgtttatcaatagtggcttaaatatgaagcatgttgagactatcataaataaactcaagaactataaatgggatgcaggactgccatcagtttatcctgatagagttgctattatcgcctcagatgatacaatagaaagggatccaataactaatgagcctagatattcttctcgtgctcaagctggcgaacctttcccattacctgctaactataatcaagaaaataataatagtgttatcgctggacaaaacccaggacaaagacgtaaacctctgagtcctacatttgaccaatcagcagtaacgtttgccaattatcgtgatttagttaaccaacgtcttaaagacgatgcaggtaatcctcgcgatcctgaaaatccgacacaggtaaaaattgatgagtaattcaacaagagcaagttcaacgcgtagcacgatttatcgtgctatcattacatctaagtttagaactgaaaagatgtacacattttataaatcgattggtccgggaacggaccaaaacacactgtatgtttcatttggcaaaagcactccgtggtcagataacgaatctgaacccggatttgcacctccatatcccgctgataatggagatggggtagttgatgtttggacaaatatgatgggcgcggtcaaaattgaatcatcaatgcttgattgcgttgttccaagaagagactggggtgatactagatatcctaacccgcgtacatttttgattggtgatattgttgttgctaactctgcgccatataacagaactgacgctggatttggatggatggtatatagatgtattgatgttccaaaagacggaatgtgttcaattggaaatcttacaagcaaagatgaatgtattaagcttggaggtaaatggacaccatcagctatttcaggttcagctcctcgtggtcgtggtgatgcaaatggtactgtcgatttaggtgatggatatctttgggaatatctatatgaaatcccagctgatgtatcaatcaacagatgcacaaatgaatatattgtagttccttggccagaagagattcaagaatctccggctcgttggggatttcaaaacaacttaacatggcagcaaaatgactttaatttaatttatcgcatgaagtgcaatacgattagatttaaagcatatcttgacgcaatttatttcccagaatttagtcttccaggaaatactgggtttagacagctgtcaattataactaatccgcttgaagttaagccaatgccaaattcacctaatgttaaggctgaaaaaggctggtatagtgcttctggtcttgaaagacagtcaggtgaaatgatttacatggaaaatcggcaacctattatacgttcaatggaccaaacagaagagttaaatttaattttcgagttttaattatggggagcctttggctccccatttttatataaataagactatactttgatatgaggttaacctatgtatacagataagggtaaaaaaataattgacgtcggtgagattggtaatgcttctaccggcgacattctgtatgatggcggtgtgaaaattaatgataacttcgacgccatttacaacgccttcgccgaccaacgattatttgcagctggcggcggagcattgaaccaaaaaattcatgcaacaagctattaccaaaagataaaatttggagatgctaactctgcagggacagttccaatggggtcatgcatagatgctgattgttcagaaggcgcagttcaaatacgtctttcaaaaggtaaagcgggagaagctgtattcgttgtaaatagtaatggctcagcatcaaaagctagatccataaaaataacaacaaacggcgaaggcgtagcagatgcatttaaagacggatcgcgagagttgattatcaacacgccaagatgcagaattgagctatggtgtgttgaggtaaaagctaacggtgctgctgtttgggattattcaatttcaagtatgtttggcagcacatattcgccattagaagctacatataatttaacaagttctcctattaatatccgcattggatataatgatgattactccaccgttaaattgttattaagcttcagtgcaaatccgggtggtcaaaccatcaaaaggcaatcatctgaagtcatgcttatgattgacccgactattacttcatcagcgccaaacggaagagtatttgacactgaatatgcagtgttaagaagtggtgaatcatctgaaaatgaaaagatgtattctatttcatactctattaacgcgcagaaagatttaatatgcacagcttcaacatcttatggaaacgcacgtttggcagttaaagttattgctacacagaccgtaggggtatctcaataatgaaacaaaatttgatagtaggccaatcagtagatgatgggtctggtgattacctccgtaaaggtggtcttaaaattaataacaactttgatgatttatattcagagttaggtgatggttcagttccattcgcagcaggtgcatggaaaacttttaaagctagccctactggaactactttaaatgctaagtttggtcaggcctttgctattaatacccaggcagcaagagttaacgttcagcttccaaagggtacagccaacgactataacaaagttattaaacttcgtgatgtttggtcaacctggcgattaagcccaatcacagttattcctgctcaaggcgatacattaaaaggttcagcttctcctaaaattttcaatactaacttccaagatttggaattagtttattgcgcccctggccgctgggaatatattgaaaataaaacggtagataagctaactaacggtaacttaagtactgtagcgaaaaaatcaattattgctactgcgggtcagactgactttcttaacatttttgatggcgtagaatataacgaagactcgcttaatgtatatcgtcgtggtaatattttatattacggtgaaaccagtgttatggataaagccaatgctgattacggttctcctggaacagtagcaggtcaattggtagaattaaacggtaaagacattcgtttaaaagttccatgcgttgaaggggaagtaataacatttgaaaccttcctagatggaattggtgtttatcggtcttcatacaacaagttggctatccagatacgagattcagcccagactacatcccagacgattcctgggtcaatgatagtagataaccttgctactctccgcagaatcactctggatgacatgggtgtacttccaggcgtaggggtaaatcctaactcgcttgaaatttcattgaacggaaaggaattactcgaagctggaactgctggtcttcctttattttattgtgaaggcgcagaaggtggatacgcagaagactgtataaacaatggtggtcaatgggtaaattctaaccaagattatagactggaatttgactcaactggtactaacgtcgaagctattatttttggtgaggcgtttgaagataaagaccttcttaccgtccgttggttcaataataacatcggtactactatggatatcaatgatatcatggcagaaaccgaccaagtgtatatgaatgctgagcaattagtaactctaaaaaatcgcattgaatacacaaattatgatgaacctaatcagaaaaatatgcgtccggttgctgacgatattatgattaaagtcaataatattgcagcattttttgacgtaatttatccgattggcacgatttatgaaaacgctcacaaccacgcaaaccctgctgactatatgggatttggggtgtggaagctttattcacaaggccgtgttactgctggttggaataatgattcatctgatccttatttttcgcgtaacaacaataacttaaacgaaaatggtcagccatcattaacagcaggtggaacggttggagatttgacatttacgttaggaaaagaacacattcctgaactaatgtcaagagataaagttctaatttcagaccctgaacatggaagcgtagttatcggtggatgtcaattagacccagacgcgcagggaccaggttattctaaataccgtgaagacactgttgcggtaaacaacggtgtagttccaaatgacatcactaaaattcagccaacaatcaccgtttatcgttggattagggtaggttaaaatgacgattgaaactaaaactcgtgaaggagctaaagttaattcaagattagctgctttttcagaatatcgcgttgacccgcaaaatattgcggtaggaaatacggctcctatagggagcctaacctttgaacaaatggatttaggggtttggtatccaaatactgaagctgctattaatgatttgatgtcattgcagtcagcagaaattggaactattatttgcaatgacactggaatatctccacagcccgcacagcaaattacgcgtgctactttttcaggtgtcgttgcgttagagccaaaagaagacggctctgtcggtgacccagtaataattcatattcttggcttaccaattagaattgcaaacggtgatgactttgcagcagtagcaacacgttggtatgataaagtaaaagaattagaagctgttggaaaggttgttcaacaggttactcaatcgccggcaacaccccagtatgttgatattattcatttagattatcagaaccataattttgaaacatataaaaagtatggtttaactgttgaatttactattacttcaccagctaaagcaggttatgggcaatgggatgctatcggcaacgaatctaaaacattcggcgcgaacacatttactttccactattttagaaggatgggataatggcccagaataactataatcactacagtgatttggccaaatatacgatatttgacccaacaaatacacaatggcctgttgctataaaagacgtccaatcagcgttagagctgattggtagctgggcaagaactgataccggattacctgtagcatctcctacagtagccggtgtaattcgcacagcaacacaggctgaagttgatgctggaactattggtaatgctgcggtaactcctgctacattaaaatccacagttacccgtcctgaagcaactacagcagttcttggcttaacacgatatgctactaatactgaagccgcagcattaaccgcaggaaatagaactattaccgcggcggctctcggtcatgtgtttaaaaccgtaaaagcccaagaaaacgtagatggaactgttaggttaactactgcggctcaagcgcaagcaggaactgacgaaactaccgcagtaactcctaagcgtgttgtagaaatgattggaaagttcagcgttagtcctcctagttatacctctgcgacagaaagcaacttgggattagttcgtgtcgcaacccaagcccaggtagcagcaggcgctgttcacgatggatacgcagtaactccaaaaaccttcatggaatcaaaagcgtctgacagtgtatttggtatagtaaaatttgctaaagactcagatgtggcttcagctacttctaacaatttggctgttactccaaaaagtcttcaagcgctaaaatccaccaaggataaatatggattaaccagattatcaggttctccaactactgatgcttcattggcagcggctgcaacagatgcagtctttaaaacccgtagaataaacggaaaaactcttgacaatgacataacgattactaacaatgatattaattgttatacaagacaagaatctgacgggcgttacatgccagctggaaccagagtaggtaatgttacttgggttgaaggtcaatcttggattagtcgaggtgcaacgtttacatgtaatgcaccatgggaagcttctagtagattagctctaaatgttaatgtaaaatttgagcgtaacaacgacggatatgacaatcgtattttcagatttgttgtaatagttaacggttcccaatggggcggtgaacttactcttaacatcgaaaatactaaaggcggacgaaatggtcattcatggagatttgaagcttacgcatctagcaactttttcttcaataacattcctccaaatgccactgttcaaataagaccaacagaagacagtcgtattatattttatgactgcatgcttacattctgtacaaatagaccgtaaggaacaatatgaccaaactagtagattcgcttccgttcgtagacggaattccagacgattttcaacagagaattaactggataaaaaatacagagcctcttaatggggcttcaacccgctatggaaatgatggagaactgaatagagcttctgttcaaatccagaaaaacgttgttcaggtacataacgatttgaacaacgttggaactgctgtagaaaatattcaagtagatgtagaccaaatcaaaaaatcgttagaaattacaggttcttctgacgccattgagcaggtttatatcaataaaaagaatattgaaaagcatgatggacaaattcttaaattagaagaagacaccgaaaaacttcgaactgaccttgattttctcgaagaggatgtaggtgtttatgattctagtaaagatgactattacagaacagttcgtgataatatagtttgggttaaacgtgaaattggtgcgtatcctgggcaagatattaacggacagccgaagcaagactctccgggttctggtatgaaataccgaatcatcaataatgcgtcagctatagtaaaacatgacgagcgtattcaggcgctagaggatgcatacaatgattcagacgtaggttctctgactattgaagtaaacgacctgcgtaaagaagttggtcctaaatccggagctacgtcagcttcaatttatgcaaggcttgtgaataacgctgatgctatttccgcagctaataatgaaatctttgctattaaccaagccattgattttaccaatccagtaaaaattggagctcgtactactagattagaaaacgattatcgtatagttgacgcaacacttaactctgcacaaaccgggttagttcctcgtgtcaataatattgatgctcgtttagggtcttctgataagcctgatactattgaaggaaaaattagttctctttcaactgaccaagggtacatttctgatgttgtaggacgtgatacttcatcagggcttcagggtcaagtagcatggataaaccaacaggttggtattgttcctagcgagcagccgattcctcctgggtcaattttagcgagaatgaccaatgttgaaggtatgcaaaactctcaacagtctgctattcaggacattcaagtagaacttggcaataacaatgaagggttaaagggttctgtatttacattacagactcaaatgaatggtgacttttcgtcagaaaacccagttcaacgtgatggtgtatacgctactgtagtagaattgcaagataaattcgtgactgcagttactgacgtagaacaagctggagcatacctccgtaaacagggcgaatggtttaaaaaaccttcatcaataggtgaattcagtaaagaagatttcactgttgatttaagttctgatgcattggtaaatcctaactcattggtcgctgctccattcaatgctggcattcgtattgtcgatgacattgttgttgatgacgatggcgtattttgcgtagaaactgatacggttatcgaagcttctgattcagataaaggcgtgaaaattgttattctcgttaataacattgaggtgttttcctacggacttggtgttaaagcagtaacgggcgagcagttgattaaaaccaagaaactcattgagttttcatctggtgatgcaatcaaaatcgtgtatagagctgcttcagaagaatcgcaggttcttgttaaaattaaatctttggatattactattcatccagctgtataacaaaaggggaccttcgggtccctttttcgtataaataggaatataaagaggagttcatatgtcatacaacacgtacaacccaaaaacgcttaaagacgctatacttcgacgtctaggagcgccggtaattaatgtagaagtaactgaagaccaaatttatgattgtattcaacgagcattagagttgtatggtgaataccactttaacggattgaataaaggttatcaggttttttatattggaaaagacgaagctgacaacgcaagatttttaaacggcgtgtttgatttgcgcggtcgtaatgtatttgctgtcacccaaattgttagaacaaatgtaggttcattaacttcaatggatggtaatgcgacatatccatggtttactgactttctaatgggaatggcaggaattaatggcggaatggggtcaagctgtaataaaagctatgggccaaacgctttcggtgctgaccttggctattttacacaattgatgacttactggtcaatgatgcaagatttacttgctcctctcccagattattggtataactctgataatgaaatgcttaaagtaatgggcaacttcatgaagggtgacatcattgtctgtgaatgctggaccaaatcatttatgaatacagatgtgatggtaggcaatacagcaggatatggattcgccggagcccaaactgctgaccactggggtttaggagatagataccagaatcctgaccttcgcaataacggccaatatgctggtgaaggcaatacaaatagagaaggtgcatataataatcgttgggtaaaagattatgctacagcattaactaaaaagctgtggggtgaaattctttttaaacatcagggtctgcaattggcaggtggagttacagttgatggtcaaacacttaaggtagaggcccaagaagaaatcgagaggctccgagaggaacttgatttacttgacccgggttgtcctattctgttggggtaaaagatgtctacatttgattctaggctcttcgctaaactcgaagattatcgaggatataataaaactaatgagactgaaattctcaatccttatgtgaatttttacaatcataaaaatagccaaacgttagcagatgctttatcggctgaggctattcaaatgagaggaattgagttttatttccttcctcgtgaatataacaatcctgatttgctttttggagaagacccatcaagtaaattcaccaaagcttggaaatttgctgcttatttagattcatttgaaggatattctggcgataacacattctttagtaaatttggtatgatggttaatgatgaagtcaatctgactattaatcctaatttattcaagcatcaaactaataattctgaaccaaaagccggtgatctaatttattttcctatggataactcattattcgaaattaactgggttcagccatacgatccattttatcagttaggtcaaaatgttcaacgcaagattactgcacaaaaatacatttattctggtgagcagcttcagccagaattgcaacgtaatgaaggcattaatattcctgaattttctgagcttgatttagaaccaatcaaaaatatagatgctcttgctgatatttctgatgtgcaatacgcagaaagtgacgcaatcaataaagaagccgctgaatatgttcatccgtattatgttaataacggaagaggacttgaatctcctcctaaagcagattcatttgatgacggatttttcgaataaataaaataaagatgggacctttgggtcccttaggagaaatcatgtttggacattggtataattcgtccttacgccgatacattgtattgcttggagatttattttctcatgtacaaattgctcgttggcgtgaagacactggactaaaatatattaaagtacctatcacttatgcttcaaaggaaaagttcctttctcagcttggaaaatggactgctattcagtctaccgagaataaagcaaaaatagaaactgttttgccaagaatgaatttgcacttggttgatatgcaatacaacgcgatgtataaaacatcacagctgaatagaacaaaatcatataaaactccttcaaaaattacatctcaatataatcctactcctattaagatgatttttgaattaggaatttatacacgcaatcaagatgatatgtatcaaatcatcgagcaaatcgttccttattttcagcctcacttcaatacgaccataactgagctttacgacaaagacacaagttttaatcgtgatgttagaattgtattacagtcattttctccggatgaagctgttgatggagacaatatcactcgtcgtagattagaatggtcattaatgtttgaagtcaatggttggctgtatccgcctgtagctgaaattgatggcgaaattagaaccatttatttagatttcttcgctaacagcaaagagttaactccagaaggaaactttgaatcagtagatagcgaagttactccacgagatgttcagcatgaagattggaatggttctagtaaacaaacgtattctcatgatattcctattccggtaaatccggaggctcctggaccgagaggtgaaaaatgagtgaattacaattagatatggctaaattattagacatcgaaggaattcctggaatagaaggacaagaaattccggtttatgaaaaactcgaattagttgaggttaaatctaacccaaatgaccgtaagcctgacctcgaagatgactattcggtcgttcgtaagaacatgcactttcaacagcaaatgttaatggacgcagctaaaatatttttggaaactgctaagaatgctgactctcctagacatatggaagtatttgcaactcttatgggtcagatgactacaaccaacaaagaaattcttaagcttcataaagaaatgaaagacattacttctgagcaggttggcaccggaaagggagctaatcctcagcaaggaatgaatattcaaaatgcaacagtctttgtagggtctaccgctgatatgatggatgaattcggtgatgcctatgaagcacaagaagctcgagagaaaatagtaaatggaacagactcaaccgtttaacgttctgagcgatgcccatcctttaaatgacgggaaactgacggttattcgtcacccgtctgaaatggaaacgaaaattgaaaacggagttcgtttctttaaatcgcaatgggatgataagtggtatcctgagaagtttgaagactatcttaagttgcatgggatagttaaaattcgtttgcaaggtgaagacccagctcatttccaaacgtttaaggacaaaaacaataagcgcacccgctatatgggattaccaaaccttaaacgagcaaatattaaaatgcagttgacgcgtgaaatagttgcagaatggaagaaatgccgagatgatattgtgtacttcgcagagacctactgtgcaattactcacattgactatggtaccattaaagtccagcttcgtgattaccagagggacatgctggaaatcatggcagccaaacgtatgacttgttgtaacctcagtcgtcagctcggtaaaactactgtagtagcaatctttcttgcgcacttcgtgtgttttaataaggataaagcagtaggtattcttgcgcataaaggctcaatgtctgcggaagttctcgaccgtactaagcaagcaattgaattacttcctgactttcttcagcctggtattgttgaatggaacaaaggctcaatcgaattagataatggctcatctattggggcatacgcttcgagtcctgatgccgttcgtggtaactcatttgcaatgatttacattgacgaatgtgcgtttattccaaacttcatcgatgcatggcttgctatccaacctgttatttcatcaggtcgtcgttctaaaattattatcacgactacaccaagtggattaaaccacttctatgatatttggactgcagctgttgaaggtaaatccggctttacgccttatactgcaatttggaactcggttaaagaacgtctatataacgacgaagatatgtttgatgatgggtggcaatggtcacttcaaactatcagtgcttcttctcttgaacagtttaaacaagagcactgtgcggaatttcatggcacatccggtactctcatttccggtatgaaacttgccaatatggattggattgaagttactcctgactcgcacgggttttataaatttaaagaagcggaagcagaccacaaatatattgcaactcttgactctgctgaaggacgcggtcaggattaccatgcactaaatattattgacgtgactacatctgaatgggaacaagttggagtattacattctaatacaatttctcacttaatcctcccggatatagttattaaatatctaatggagtacaacgaagctccgatctatatagaacttaactctacaggtgtttctgtagcgaagagtctttatatggatttagaatatgagaatgtcatttgcgattcaatagttgatttaggaatgaaacagacgaaaaggtcaaaagccgtcggatgttctgcactaaaagaccttatcgaaaaggataaactcattattcaccatcgtgctactgttcaagaatttcgtactttctctgagaaaggagtatcctgggcggcagaagatggatatcatgacgatttaattatgtcactcgtaattttcgcatggttaacaacacagcaaaaatttgctgatttcgtggataaagatgaaatgcgtttagcatctgaagtttttaaacgcgaattagaagatatgaacgacgattacgctcctgtagtgttcgttgacgccgtgaatagcgcagaatatgcgcctcaagaacatggtctttcatttgtataaataataaaaagcaaacaacattgaggatatatcatgcctttagtctctcctggaattgagctcaaagaaacgagcgtacagagcacggtagtacttaacgctacaggtcgtgccgcaattgtcgggaagttccaatggggtcctgcatatcaagttactcaaatcactaatgaagttgaactggttgatatgtttggcggccctaataaccaaactgctgattactttatgtcagcaatgaactttctgcaatatggtaatgatctacgcaccgtccgtgtagttaaccgtgaagctgctaaaaacgcatctccgctggttgataatattgaatggactatcactactgctggtagtaactatgaagttggtgataagattacggttaaatatgcagaccaaactgtagatgacaccggttcagttactgaagtagatagtgacggaaaaattaagtcggtgttcattccgacatcgaagattattgcatatgcaaaaagcattaatcagtacccagatttagggtcttcgtggacaactaccattacttcacagagttctggtgtttccgctgtcattactttaggtaaaattatttctgagtctacagttttactgactgagcatgaaactgcccatgaagaaatgacaaaaaccgaattccagactgcgcttgcgcaatataaaatgcctggaattgtagctgcgtatccgggcgagctcggaaaccaactggaaattgaaatcgtatcaaaagctgcatttgataaaggtgaacagctgacgatttatccggctggtggaaaacgcgcttcgactgcaaaagctgtatttggatatggtcctcagaccgatactcagtacgctatcattgttcgtagagatggcgcggtagttgaatcaactgtgttatcaacaagtcgtcaagataaagacatctacggaaataacatctttatggacgattatttctccaaaggttcttcacgttatatatttgctaccgcgcaaggatggcctgaaggattttccggtgttattcgtctgggtggtggggtttcagctaatgaatcagttactgctggcgatttaattcaaggttgggatttatttggtgaccgtgaagcactgcgggtaaaccttctgattgctggtgcttgtgctggtgaaacggatgaaatcgcaagtacagtgcaaaaacatgtgtcgtctattgcagatgaacgtcaagattgtttagcactcatttcaccaccaaggtcaacgattgtaaatattcctctgacccgtgctgttgataatttaattgattggcgtcaaggtgaaggaagctacgactctgcaaacatgaacatcaatactacgtacgcagcaattgatggtaactataaatatcagtatgataaatataacgacgtaaaccgttgggttccgttagctgctgatattgcaggcctgtgtgctcgtacagatgatgttgctcaaccttggatgtcaccggctggttatcgtcgtggtcagattctgaactgcattaaacttgcgattgaacctcgtcaagcacatcgtgaccgtatgtatcaagcaggtattaacccggtaacgggtcaaggtaccggtgatggtttcattctgtttggtgataagactgcaactactgttccaacgccgtttgaccgaattaacgttcgtcgtctgtttaacatgctgaagaacaatatcggtgattcttctaagtggcagctgttcgagttaaacgataactttacccgttcttctttccgtatggaaacaagccaatacttggcgggtattaaagctctgggtggtgtatatgacttccgagttgtatgtgataccacgaacaacacccctgctgttatcgatcgcaacgagtttgtagcgagcttctatatcaaaccggcgcgcagtataaattatattacgcttaacttcgttgctacggcaactggtgcagatttcgatgagttgatcggaccacagtaatatgaaccccaggacattctggggtcatctaacctttagatgataaattatattaccgcacactttaatagcctctatgatgatgtagtcaatcgagaggctatataaatatctataggaaacaacgatggaattaacagacatcacccgtgcgtttgaatctggtgactttgcacgtcctaacctgtttgaggtagaaattccttacctgggtcgtaacttcagtttcaaatgtaaagcagcaccgatgccggcaggtatcgtagaaaaagttccagttgggtacatgaaccgtaagattaacgtcgctggtgaccgtacttatgacgactggactgttaccatctataacgatgataaacacgaagtacgtaaggcaattattgcttggcaggctcaggcccacgctcaaggcaatgatatctctggtatgactccagccgattacaaaaaggttgctacggtacgccagtttagtcgtgatggcaaaactatcacaaatgaacacaccattactggtctgtggccaactaacgttggtgaagtacagatggactgggattcgaataacgaggtagaaacgtttgaaactacctttgccatcgactggtgggaataatgctatggggcttcggccccgtatcgaagttctgtgagttatttgcttaaatatctgacaaaacttcgatataaatatacttatagataatttcggagactccaatggcctttcatattttggacttattcgctccgtgggaaaaacgcgacgaagctgaatataagcaacaaatcaacaatgacctagagtcaatcactgctccaaaatttgatgatggagctcgtgaagttgaatcaaacgaaaacgaaatccagtacaattcattcaaccaaatgatgtttggttccaatgaacctggaatgaaaacaactgctgatttaatcaacacttatcgtagtttaatgaataactacgaagttgacaatgctgttgaagaaatagtttctgacgcagttgtatacgaagacggtcatccagtagtttctcttgatttagattctaccgacttcagtcaagcaattaaagaccgcattcttgaagaatttaatacagttttaacatgccttaatttcgagcgaaaaggagccgaccatttccgccgttggtatgttgactcaagaatattcttccataaaatcgtcaacacaaagaaaatgaaagacggaattcaggaactgagacgtcttgacccgcgcaacttacaattcatccgtgaaatcgttaccgctgatgacgctggtactaaaatcgttaaggggtacaaagagtatttcatttacgatactggcaaagaaagctattatgcagatggcagattatattccgccggaacgaaaattaaaattccacgcgatgctatcgtatatgcacattctggactagttgattgttcaggtcaaaacatcattggttatttacaccgagccgttaaacctgccaaccagttaaagctattagaagatgcgttggtaatttatcgtattactcgtgctcctgaccgtcgtgtgttttacatcgacactggtaatatgccttctcgtaaagcggcagcacacatgcagcatattatgaacacgatgaaaaaccgtgttgtatatgatgcgtcaactggtaagattaaaaaccaacagcataatatgtcaatgacagaagactattggttgcagcgtagagatggtaaagcagttactgaagtagatactcttcctggtatgtccggtatgagtgatatggatgacgtccgttactttagaacagcgttatacatggcattgcgagttcctctttcgcgcatgccggatgcaaataatcaaggcggtgtgcagtttgatgctggtacagcaatcactcgtgacgaacttgattttgccaaatttattcgtagattacagcataaatttgaagagattatgcttgatccacttcgcactaatctaattcttaaaaaagttttgtctaaagatgagtgggaagacgaaataaataatattaagattgtgttccataaagactcatatttcaccgagttgaaagatgctgaagttatggagcgtagaatcaatatgctcacaatggctgagccgtttatcggtaagtatatttctcacaagacagcaatgaaagatttccttcagatgtctgatgaagaaattgaacaagaagccaagcaaattgaattagagtctaaagaggctcgcttccaagaccaagaaaatgaagaggatttctaatggaaaattatatttccgcaattgaatccagagacctcgtagcagccaaaaaagcttttggtgcaattatggctgaacggacatctggtttaattgaagagcgcaaaaaatttatcgcagcgtctgtcatgattgagggtgaagagcccgttgacgatgaagatgaagacgacgaagatgaagataagtctgagaaagacgacgacgaagaggacgagtaatgcttatactgcctgaaaatcatgaattagttatcgacgctgtcgaagcttttcttcctgaagcacaggcacgttttgataagttgtccgcagcgctttctaaagatgatataaataaaattgtagagaacatggttacttctgagcctgatttagcaattgctttaggttcaattaacgaatctctacaattaaatgaatttatcgttaagcacgttgattctaaaggtactattacccgtaccaaagatcgtaaaacacgtgagcgtaacgcgtttcaaacaaccggactttctaaagctaaacgccgtcaaatcgcgcgtaaagcagtaaaatcaaaacgtgctaatccatcggctcaaactcgtggattacgtaaacgtaagaaagcacttaaacgccgtcaggctctggggctaagttaatggaaaacctcaatgaacaacttttaattgagcattggggtcaaccgggcgatgtaattgatggtaaacccatgctggaatctattatcgttgaaggcgaaaatgaatctggcttaaaacctggtctgtatatcgaaggtgtttttatgcaggcagaagtagtaaaccgtaataaacgtctttatccaaaacgcattcttgagactgcggtaagccgttatattaaggaacaggttgctactcgtcaggctctaggagaattaaaccatccacctcgtgcaaatgttgacccgatgcaagccgcaatcattatcgaagatatgtggtggaaaggcaacgatgtttatgggcgtgcaagaatcatcgaaggagaccacggtccaggtgataaattagccgctaacatccgtgctggttggattcctggtgtatcaagccgtgggctcggttctttaaaagactcaggaaaaggatataacatcgtacaagaaggctttcgtctgactgttggtgtagacgcagtttggggtcctagtgctccggatgcatgggtacaaccgaaacaaatttcggaaaatacctcggcacaagttgccaatagtgctgatgatgcttttatggctctcgcagagaagttaaaagcgttataaagtacgaggaggtaaatatatatggctaaagaactaagtggatatggaccaactgctggtgagtctatggggggaacaggggcgaatctgaatcagcaaggtggaaataataatagtaatagtggggttcactggggtggtggctctgggcatggtaataatggtggtcagggaaattcaaattcatctggttctacatcaactgtgatgaaaaccggtgagtcatatctgactccgtggggtgatgttgtcattaataatgatggccttccggtgatgaatggtattgttatgacagaagagaattcaactctggttgataatccatttggaggggtctccagagttcttaattctttaattagtgatatgccatcactttttgcagaaagctcaggaaataacaacaataacactgcttcagttaatactgcaccaacgaatgctcaggtcagtgatatggataagagttcgaaggtggtgggtaatgtaattaatgaaaaacaaaagcagaagaataaaattgctacacagattagtgaaaaacagaagaaaatcgaggagatgaaaaaagtattcaagcatcattcttatcatggtatcactgatcttgagagggatgttgatgagttgcaaaaaaaatcaaatcagcttgatgcagatattagcaaacttaattcttataaaaatacattgcaaagtaaaattggtgatgtgaataaacagaaggaagctgaagaaaaggctcgtgaaaatgcagaggtcgctgaacatgaaactcttaatgaagagaaacaggcggtggcggaagcagagaagcgtttagctgaggcgaaagctgaactggcgaaggctgaaagtgatgtacagagtaagcaagctactgtttccagagttgcaggagagcttgaaaacgctcagaagagtgttgacgtgaaggtcaccggatttccgggatggcgtgacgttcagaaaaaactacagcgtcagcttgaagctaagcaggctgagtactccgcagttgaaaatgaacttaagaatgctgttagtttcagggatggtaaggccgctgaggttaaagaggcagagcagaaattaaaagaagctcaggatgctcttgaaaagagccagataaaagatgctgttgatactatggttggattttatcaatatataaccgaacaatatggagaaaaatacgcaaaaattgctcaggatttagcggaaaagtctaaaggaaagaaaattcaaggtgttgatgaagctctggcagcatttgaaaagtataagaatgtactggataagaaattcagtaaggttgatcgggatgctatttttaatgcgttagagtctgttaattatgatgagttatctaagaatttaacgaagatatcaaagtcgcttaaaatcaccagtcgagtatcttttctatatgatgttggttctgattttaaaaatgcaatagaaactggtaactggcgacctttgtttgtcacgctggagaaaagtgcggtcgatgtaggtgtggcaaaaattgtggcattaatgtttagttttattgttggtgtgcctcttggtttctgggggattgcaattgtcacaggtattgtttcttcttacataggggatgatgagttgagcaaacttaatgagttgttagggatttaaataattatgtaacttaacacaggacatcaaaaatgcttaaagaacttttaatgaccgaagctaaaactatcgatgcttccgtcgctcttgacagtattttcgaatcagttcagctttctccggaagctaaagctaacttcagcactgtattcgaagcaacagtcaaaaaacacgcagtagctctggcagaatctcacattgaaaagattgctgagaaagcagaagaaaaagtagaagaagaaaaagaaaaagctaaagaagaagctcgcgaagagctgaaagaagctgcttctaaatactttgaccatatcgctgccgaatggatggcggaaaatcagctggcggttgatcgtggtattaaggctgaactgtttgaatccatgtttagcggtatgaaagaactgtttgttgagcacaatgttgtaattcctgaagaatcagtagacgtagtcgctgaaatggaagaagaacttgctgagcaaaaagcagaaactgctcgtttatttgaagaagtttctaaacgtgatgcttatatcaattacgcccaacgcgagtatgctattcaagaagcaacccgtgaattgactgatactcaaaaagagaaagtagtttctctgacagagggtatggattattctgactcgttttcaactaagctgaaagctattgttgaaatggtgcagggttctgtagagcagtctgtaacggaatctgccgatataaatactatcgacaaagaagcagacggtttaaacttcacaactgaagcagtcgaagaaactcctgcgactaaaaccccatccgttatggatgcttatgtagcccaagcggctcgtctttcttaatttaaaaggttatacaacacatgaaaaagaataaacttatcgaaaaatggcagccgctgcttgagaacgaagctctgccggaaattgttggcgctagcaaaaaagctctgatcgctaagatttttgaaaaccaggaagctgatattaatcaggctccggaataccgcgatgaaaaaatcgctgaagcatttggttctttcctgtctgaagcagaaattggcggtgaccacggttatgatgcacagaacatcgcagctggtcagacctctggtgctgtaacccagattggaccggcagttatgggtatggttcgtcgtgctatccctaacctgattgctttcgatatctgtggtgtacagccgatgtctaacccaaccggtcaggtattcgctctccgcgctgtttacggcaaagacccgctggctgctggtgctaaagaagctttccatccgatgtacgctccggatgcaatgttctctggtcagggtgcaaccgagaaatttgaagcagttaaagctggtgatgctctgactgttggtgatatcgttgttcacgatttcgcacagaccggtcgtgctcatctgcaggttgttgaagatttcactgtagacgctggtgctaccgatgctgctaaactggacgctgcagttactgctgctctggaagctggtaaagttgtagaaatcgccgaaggtatggctacctctgttgctgaactgcaagaagcctttaacggttcgaaagataacccgtggaatgaaatgggcttccgtatcgataaacaaaccatcgaagcgaaatctcgtcagctgaaagcacagtattcaatcgaactggctcaggacctccgtgctgttcacggtatggacgctgatgctgaactgagttcaatcctggctactgaaattatgctggaaatcaaccgtgaagttgtcgactggattaactactccgctcaggttggtaaatctggtatgacccagactgttggttctaaagccggtgtattcgacttccaagacccgattgatatccgcggtgctcgttgggcaggtgaaagctttaaagctctgctgttccagattgacaaagaatccgctgaaatcgctcgtcagaccggtcgcggtgaaggtaacttcattatcgcttcccgtaacgtagttaacgtactggcagctgttgatactaacgtatctccggcagctcagggtctgggtcgtggttataacaccgacaccactaaagcagtatttgctggtgttctgggtggtcgctaccgtgtatacatcgaccagtatgctcgtcaggattacttcaccatcggttataaaggtgctaacgaaatggatgctggtatctactatgctccgtatgttgcactgaccccgctgcgtggttccgatccgaagaacttccaaccggtcatggggttcaaaacccgttacggtatcggtattaacccgttcgccgattctgctgctcaacagccgaaaggtcgtattacctctggtatgccttctatcgtcaactctgttggtaagaatgcttacttccgtcgtgtatgggttaaaggtatctaataccaataagggagccttcgggctccctttagttgttttaatggatataaataaacttataaatccacagaggaaagcgcaatggctaaaatcaacgaacttctgcgcgagtcaactacaacgagtagcaacttaattggtcgccctaatctcgttgcattaacgcgcgcaactactaaattaatctataccgatcttgttgctacacagcgtactaaacagcctgtagcagcgctatatggtatcaaatatcttaaccctaatggtgatttgacatttgcaacaggtgcaacctatgcaggtcaaatcggagccacagaacgtgagtcaattgaagaactcactatggcaaataaagactcattcaataaagacgatatgttcaaatatcagaatgtggtctttaaagtacttaaagatagcccgtttactgatacaacagaaaccgatgaatttggacttgtatctgaagctgtagcagctaataatattcgtatgctgtcagatgctgcagtcactgaaaaatttgaaggacctgattcagacccaatcaccgaagccagttttaaaattgataaatggcagacccaggttaaatcacgtaagcttaaaacagatttaacggtagaattagctcaagatttagaagctaatgggttcgatgctccagaacttattgatgatttacttgctactgaaatggcagaagacattaataaagacatcctgcaatcattgattacggtttcttctcggtttaaagtagctggtgtatccgataaaggtgtattagatttaactaagcaggattctgctccggaacaaggtcgtactctgtatcgtttcatttgtgaaatgaattcagcagttcaacgtaatacttcttattctggtacttatgcagtagcatctactcgttgtgctgcggtgcttgcagcttccggttggttaacacagaagaatgatggaagtattccggaaaacgcatacggtatgctgaataacggtttacctctttattgtgatactaacagtccggttgattacgttattgttggtgttaaggcagaatttggtgggaaagaaactgtaggttctttattttatgcgccatataccgaaggcttggatttagacgaccctgagcatgttggtgcatttaaggttattgttgacccagctagcttgcagccttctgttgctttactggtacgatatgcgctgtcagttaacccatatactataggattggacgaggacgaagctcgtgtgattaatgctgcggatatggataagatggcaggaagaagtaagatgtctgtactgctcggtgttaagttacctaagcttattgcggactaatttgcggggagcttcggctccccttttttgctataaactaaatatgtcaaacctcggggagtattcctcctcgagggatttaaacacgttcttatcatagagattgacgcattctattccatgtctacgggctatatcaacagctactctcgtccctccagatacactcccgcatcttttttcaggcgcccaatataataccttatctacaggctcagtgcattctaggcccaatacctgcatagaattccgtgcaaatagtgtctgtactatcttcgagcattcatcccagtacgacgtaacttctctcgccttaatgatgcttttgattttggcttcgtttgataattcagaccatacaacaacacctgtatcaggaacatggccacaaaagccagaataaggaataatcctacaagaatttgacctatcgtatttcgccaaccacgcttcatctgaacccggagctccacctgaatatgaaaaatgcccctcttccgagaggcgttgaccgattatagtcattagactcagaactctgcgtggcgcttctcttgaaccaatcagcgccagcctcattattctaaaacctcatgccatttgctacgaatagtgttttgaattaaagtagtcagttctttcttaacagcagaaggattatcagcgaatagcatgtcatgaccttcacgagctgcttcgttgatgatatctttcatagtcagtcccataactcgaccaaaatctttggcagttacagtaccaatatgagacagaacgttacttacacggttccaggttacatactcggaaaagatttccagaacacgcttatcagtatcagtgagttcaaccttagctttaataggcttatcagatttagctttctcgctgaacttagaattcttacacttaatagctacacgggtaccgttattaaagaatttaggattaaccggtttaagaacatagccttcagctacaccggtttcagaagaagcctgtggaccgaacacatgtttatttgcatgttcaaggtcagtcgtgtcaacaagttcattatagtaattgacaatagatttaaagtcatttacatactgagatagctcagcgaatgaaccacgaccaagcagtggagctaatttaagaccaagaccagtagcaaacgattctactacataatcgtcccaataaactttttcgttaccggaatccgacaggatatcaaacacgtagaaatctttatcaccataatctacgcccttctgaataccaccgccagcaaattcaccgaagatttgaacagatactaaatccatggtgttcagcatgttctgcatcttaacgaaagaatccttgtacttcttcatgataatctcatgaccaaagaagctttcaccttctaaaataggaccagtacgcttagccggaacgatttcggtaggggtaataatcacactgaagttagtgccatgaattttctcacgagccacccactcaacggtatgcatatcaaaaccagcaccacgaatcttctcgatgaacttaccgttgtaatgattctcaagactagaatattttgcaaacattataatttccttagaatgtgattttcataaagtcagtatcaccgttacgctgggaactggtataatttgtaacaaatccttcatcatgcaaataattaagaacacttgtaatgtgtttcttaactagactactcggatacataattaactcacgcttacccgctaaagcggttttctcaatctgagttaatacttcttcttttgctgccgataattcttctgtagcaacattaatagcagtattagccattctatcggcaaggttcataatttttctctcaataaataaaataaaaccaggagtccatctatcttggacaagggtaatggtatcagaggatttcccctgagcccattataccacatcgatttttaaagcaattaataaccgctcggtacgaagcgatacatgatatatccgcttttagttagcatgatttcaaattgacttttgcttccaacctcaagtactaatggaatatctttatccattagcatccaatcaatttttccataccgttcattaatcaaatccgttattttacgtgcaccacttttatagtagtaagaactctgaacagccatcattttactaacaaatttagatgcaaacaaccagacatttaccccattagcagctggcgtaaatttcttagaaagcatttcttcaaatcgttctactacaattgggtctactttagacattataaagtcctcatgtgtttaacaagtttcttatgacgagattttataccaacgtttgttaagcgtttccgatatacgactttttctttttgcttaaaccgttcgtgtgctttctcaactgagacccacaatttagcagcttccgctggagtgatatctaatgctctcgcaatttcttgaaaatctttaccgctttcatgcattaagtgagcttgtagtgctttcataataacctcatctatgtgacgaggacataataaaccaatccgtgaatagcaaaaaagggagcccgaaggctcccgaatattaaggatagataatacccgcttccagcgcagtacgatgaacaatgtatccatttctagattcttgtacatcgacttctggataatcatctagcattttagccagagtataccgatgcaggtaatagtcgctgtcagggtcgtcgagtttccaatctttgccctcaacagtcattcgctggatttcatccattacccaccatccgcaccagatataggctgttccacggaacggtagaggatgaatatacggaagttctccgtctggctcaggggctactcttttggtaatagttacatcgccagttttagtgactgtaatcggggtgtaatcttctgcggaaacctcaacagaaacctcaatcacttgagaccctatatcagacgtgtcaatcactaaagtgctagtagaaccttctacaggagaaccgtctttggtccaagaataaaccccagttgcaccttctggagcaccgataacgttggctttaaaagatgcttcagacccttgttctgccgtaatagactcaggagtcaaagtaacagaaacaccactcattgtctttttagtaaaagcaacagcaatacctttagttgcagttccattattataatctggagcagaaaccgttacttcacaattcaatgtgtagctggtttccgttgactcggttaaggtaattgttttacccgtttggccagaaataacagaagagccacgtttccaaacataagcaatgcttgctcctgacggggcgccagtaacatcagctgtgactacttgggattgaccaatttctttagaaacagaagttgggctcaaagttaaagtaatggccggcatagttttgttcttaactgtcagagtagtttctgcttcagctgtttcgggatcgccttcagccggagtaacagtagcaactactttaacggtcttactacctgcaggtcctgcagcaacataattcatagctgcggtaacagaagattgttttacaccatttacggtccatacaaacgtttctgtgccttcagctgcggctccagaagttgttgcagtaaaattggttgttgctccaatgactgccgaagcagccaaaggagcaatagatacgctataagccataggtgttccttattttaaagttacaaatgaagaattacgtgtttcacgaatcataacagacccgtttcttttgatgtaatagattaaactaaacagtgtctggtgtgctgatgggtgttcaaacgacgttggccgagatttccaatctggggtatctttaatccattggtaaatccaccatggaagagtaatatatcctgggttcttacctagcaattgcatgtttggactaaagtttttaggaagctcaatggtttcatcagttttaacaattttaactactttgtccattgctttgaagaattcttcagggtccgtagtactaattggaatgtttgtaagttttccttcatcatcgatatggataacgctgtctccaataggagcttcagcataaaatcctttatcattgatagaaggagtttttacttcaaatccagggtcatttactttgggtgtttctttataaaaatctgggtcaatatcatgaattttaacacttgcacttactggagcatcaaacagtagttttgcttcatcagacgcttcatcattgaaaagtgcttttccttcaatttcatcatctgcttggattaaatcagcaattgatagaccatcgttgtcttctggcataggctcatcggccaatttagccagttctttttctaagtcagcaaccatattgtcaaatgagcgggtcttcttcagtttaataccgaaggttttggcatattcgtcgagcttgtctttagcttcttttttatcgagtgcctgaatttctttaatatagtctttatctagcattgggtgtgcctcatgtaatgtataaatatgattgtatttataaactgaggatagtacagtgcacgacatccaagtcaaatttaaagattttagtcatgttcatattgagtgtgatgactcaattttctatgaactcagagactattttagcttcgaagccgatggatacagattcaacccgaaatatcgttatggacattgggatggaagaattcgtctgctagattataatcgtctcttaccgtttggtcttgttggccaaattagaaaattcgctgaccaattcggatataaagtttatttcgatccaactatattcgagcaagaaactctttcacgggaggattttgacaattggttatcgactaaagaaatttattcaggattaactaagattgagccacactggtatcagaaagatgctgtatatgaaggtctagttaatcgacgtagaattcttaatcttccaacgtctgccggtaagtctcttattcaggcattacttgctcgttattatgtagaaaattacgaaggcaaaattcttatcatcgttcctaccacagcgttagttgaccagatgattgatgatttttgtgattatcgtttatttcctcgcaatgctatgttgggtattcgaggtggtactgctcgtgattcgaatgcattagtttatgtatctacctggcagaccgctgttaagcagcctaaagaatggttttctcaattcggcatgatgatgaatgatgaatgtcatcttgcaacgggtaagtcaatttcaacaatcattgcgggtctcaccaattgcatgtttaagtacggactgtctggttctcttaaagacggcaaagctaatatcatgcaatatgttggcatgtttggtgaaatcttccgtccggtatcaacttctaagttaatggaagacggacaagtaactgagcttaaaattaatacaatcttcttaagatatccagatgcagccgcaaatgctttaaaaggaaaaacgtatcaagaagaaattaaattcatcaccaatgttaagaaaagaaaccgttgggttgctaatttagctgctaagctagcatcgcgtgatgaaaacgcttttgtgatgtttaaacatgtagctcacggtaaagagctattcgagatgattaaagctactggtcatgagcaagtttattacgtatcaggtgaagttaatactgaaacacgtaatgctttaaaggctatggcagaaaacggaaagggaattattatcgtcgcaagttacggtgtattctctacaggtatttctgtaaaaaacctgcatcatgtaattttagctcatcccgttaaatcgaagattatcgttctccaaacaattggtcgtgttcttcgtaaacacaaagataaatctttagctactgtctgggatatcatcgacgacctcggtgtaaagccgaaatccgccaatgctaaaaagaaatacacgcatttgaattattgcttaaaacatgcattagagcgtattcaacgatatgctgatgaaaaatttaactacgtaatgaaaacggtaaatctatgattaaatttgaagatatttacgaagccacaattcgtgaggctactatcgataacttcatgagtaaaattaatgcttgccaaaccttagatggtctgaaagaactcgagaagtattacgataagcgctctaaagaaactactcttgctgattctgatgacatcattgtgcgggatgctttggcggggcgtagacaggctcttgaagctgattctgaagatgacgaagacgaagacttctgatataaaaaagccccaaccgaaaggaaggggcaaagccaattggctacatcaacactagactaaattaaaagttgcgtttcttgtaattgctcttctgtgtcttcagtgacaggcaattcaatcgcataattatagcaagctccgggatgaaccgggcctttgtctgtgtggacaaccaatgcttcatcgattggtcctttacagacgacacataccgtattcgacatgattgtctccttagtttacaagtttatttattacgcgccagcttcaaactgacgaaggtcaataatgtgcttaatgctaaaacctcgtgacttgatagcatccattgcatcgctacagaactccaaaagaattccccaatattgcaatttagtatctacacccaagatttctttatcagcgcttaaaacagttttcatttctgatttttcatatacatccatgcatacttcaccaccaacctcgccacggccagtgtaataatccaaccgtgctttaagattttgctttttgagggcatctaatcttaacatctcttttcgacaggtcgagtgcttacgcacccatttaccatacagaacggggttattagccgcttcatactgtagtttagtctggtcgataatcaaatcattatccaattcatcctgtaattcttctaatctcattctatctccactctactgtttctttggaaggactagtcccattatactctactgctagagttagcattactacgcatctgtatgcgtatacgttctagcgtatcggggtcgtctactatagaaaactgcacggtgacaattatagcattatcgtcatataacggaagcacatcaactgatagacgattaatcctaggctcataattacgcacagcagagactatattacgctttatcgtatcaccagttaatggagtcatgttttcaaataattcgtttgtgatatcacaaccaaacgctgggtcaaatggccgagacccctttcttgtggttattattccaagaaggctgtttttaactgatcgagctcctactgtttttgacacgtcagtgtcccaagcaagtcgcatttctgggtcaaggtcagaatagagtttatcgatattgctcatgacataatcttaaagaattctttaagccccttaattacatgaatgtgagaaattccgcattcacaagtaatgggaactgccaattgaacctgtggcttcaatagcatatttttaatgttaactacatcttcggttgtaatagcagaatataaatcatcgatttctgcatcgtttaaatcattaaagtaaatctgctcatttccaaccacgatataatctatgcattttgatatcatcattggaatgtcggaatcgtcaaaaagattaggatacttgaactttatcttgaatccctttaagtcataccagaggtcttctggaggatcgatttgcgcatgtgtataatttaatggcacaggaattttacgcccacaggtgcaattccaggtcacctcatgattaacctcgcctatactatgcgcccaaagtataactataagtaattccgattcttgtttgtttaacccagtagcattagtacattctctgagcaatgctttaacacattcatcgattgtaccgtttttcttcgctgcaattaaattagcgtattcttctagtgtaaaagctcggcactggatattcttgccatttattcttgtttcaaatttatatgtgatgttcatatccactcctcttattcaattatttataaatagtataaagaggattaccttatggccaacatagttagatgcgaattaccagatggtgtccaacgttttaagccatttaccgtagaagattatagagaccttttattggttagaaacgacatgaacaccaagtctgaagaagaccaaaaacagcttatagcagaattaatggatgattattttcatgaccatcctgtcgagtatcgtccttatatatttcttaaagtatttttgtcaagtattggtaaaactaaaataccagtcagaatgaagtgcccaaaatgcggaaaatataagcagtatctttttaatcttaatcagcctccgttgacaaatccgaaagtagaggttgcaggattaacgcttaagttcaaaaaacctatagaaataattgatgatacaggtaaaatgattttagacaacattatatctgtgaaggattcatctggggaataccagtggaatgaattaagcgatagtaataaattgacagttatcgatgctatagatgttgaaaccttggaaaagattttatcgcagatgaagccgtttaactttgagctaaagacgtcatgctgtgataccacgacagtattaaaatatgataacattgttgatatctttaagctattgctacatcctgacgagattttcacattttaccaaattaaccatagattggtttctcaaggtaaatatgacttgaattctataatgaaaatgctgcctatcgaacgtggcataaccttatcgcttattgaaaaggaccttaaatcatgacagcacaaagattaggatatcctaatataagcataaaattatattctggatatgatgcgtggctagctaatagattcgttgaattagcagctacatttattacattaacaatgagagattcattacgcgggactaatgaaggtctgcttcagttttatgattcgaaaaatatgcacacgcgtatgaacggtgatgaactggttcaaatatctgttgcaaacagtaacacatcaagaacacaaactcgaatttacggaattaaacactttacagttggtgttgatgataaaggcgatagcattatcacccttcagcttggaacgctgcatgacataatgaatctcaagttcagtagagcgttttttagttctgcatatgaaactataaaagaaatgataggcgcgatgtatgttgaccaaccattgattgctcctcctatcaacggaattaacgcttacgtcccacgagttccatggactagtactctcaaagattacttacgatacgttagaaacgtaggcatttctactgataacgaccaatttatttttgcctgggaagatatcactgggattaacatgatggattatgaatcaatgatatcccaggacccaaatgtattcatgttcggggctcctcaaacaataggtcagtttgcagcaggattaaaatatccattagcatgggattttgaatggcttgttaagtcaaatagatataatagaaatcccatgaaaaacgcaacattttatgcacactcatttgttgacaaagatgttacccgaattattaatggagaaggccaaaacagcgtattcattaatagatcaggcggatattctgacatgatttttaggaatggctatgaagaagcactacgcatttctacgatggctcaatatgacgggtatgctcaaactaagtgttacggtaattttgaactaactccaggaatgaaaatcaactttgttgatttaaaggaccagttcagaactgacttttatatagatgaagttatccatgaaatatcaaataacacatctataactaacttatatatgttcacaaacggctctgcccttgaacctgtagatttgattaaggtgaaaaatgaacttaaacgtgattcttcctattaagaaaatagtaataaatgaaaagacgatatcaattccaaaactggggttaaagcaccataatctgatgaaagatgttaagggtccagatgaaaacatgaatcttcttttggattcaatttgtccaggattaacagcagccgaatctgatattgttgtattacatttattagcatttaacaacagaataaaagaaactgctgttaaagatgattttacctacgatttgaataaggtttacatttgccagcgattaactcaaaggttagatggtaaagaattcaaattcagagctcctcctcgttattccaaactaggttcagtagattcaattttgagcgaatttcttgaatcagtagatggaaaaccaatggatataaactttatgaagcttccagcttttgtgacaaagtgggctgatgacttagtaaacactatagccattgatggacctgaaggaccaatcaaaggcatgcttaacgtaatggaaatatttgaatgactaagaaatcagaaatgaattcaatgcgtagaagagttattgctgactcggctccacagaaaaaggctgagtctcaagctgatgctcagattaatacgctagaagatattggtcgtcgcttagacgaccaacaagcatctactgatttgatttcggatgtaatagaaactaaatcaaacgaaattatcaaatcggtagaagatgtttcagctggtgttgaattaactgctgaagcttcagaacgcacaacagatgctgtctctaaactaaatgataccgcatcgttaattaatgataagctcacgaaacttgccgacttgttatctaaaaagcatgatgttcagcaagatgtccaaaagactggtactggaacatcattagaaacgataacagaacaagtcccggatgctcctactcagcagccgctagaggaattactcgaaagacttattcctcctcaggatggcagacgtcctgacgcggatttctttcctagcacagaagagcaagaggaaaaagctgagcctaaaaaggaaactgaggacaagaataaaaagtttcttgacctaaaatttggagaattaattaaaagcgttaaatctggttttggaaaaactatttcattaacagataaaattagcagtatgctgtttagttatactgttagcgctttggcccaaatggcgaaaactgccgccatggttttgggtgtgataatgcttatagatttaattaaagttcattttaattattggactaaattattcgaaaagaactttgttgaatttaacaagcaagccaaagaatggggtccgctattaacagcaataagcgagatgtcgaatgaaatagtaaaatcattcgtcaagggagattggggcggattagctaaagccataggttctggcttggttgatgtaattgacaagctcggagaaactattatgctcggaatgagtaagcttcttgctggaatgttacgcgcattaggatttaacgattcggcagataacattgaaggcgctgctttagacagatttcaaactgttactggagcagaactcgatgaagaagatgctaaaatgagagcaaaatatgttgaccgtcaagaaagagaatatgacgaacaacctgaatggaaaagaaagctttctgctaagttccaaaaattcaccggtcagattgatgacgatgaatataacaaactgctgagcggagagaaaaagcagtcagcgtatgcagacttgccagaagaagaacgcctcaaaatcatcacagctcgtaataatgctgaagcagaaatgaagagaacaaaagcatatgttgaaaaaactgatgcatctgattccactcgattagactctgctaaggatgcagtacaaagcacaaccaccagatataaagaattggagaaattatctccagaagttgcaaaagatttaaaggttgaattagaccaattgcaaaagcttcttgattctaaaatatcagaacctgctccaactgccgaagctatacctgcagcagaacaacctgaggttaaacagtctgcttctattaaagccgccgcggatagtcgtgaagctgctcgtacacgtgaatctaatacacagtcgcaacctattcaggttaataccgctgtaaataagaatagcacatacgtttatagaacgcctccacagacttcgacagctgctcctggaatgcaaggcgctatgaaaacctcttaaggaaaaataatgatttttgaagaactggccgatggccttgaaaacatcaaaaaatcaggaactcgaatttcccaaggtaaatctaaactgacgaatgcgccaaccactaaggtggcgcagttcccagctgaacgttcagctgggaatgattccgcccaagatatgagagtacatgacttatatcgcaatgggttattattcacagcatatgattttaaaggaagaacaactcctgatttgcgttcatttagacgagatgtaatgttatcgtctgtattcgattcaccaatgtcagcattggctaattcatcaagctctaccactagtactgcaccagtagctaatattctattaccgcggtctaagtcagacgttgattcagttagccataaatttaatgatgttggggattctcttgttacgcgtggcggcggtactgctaccggtgtattaagcaacgtggcttctactgcggtgtttgggtcgatagagtctttaacgcagggattaatggccgataatggtgaacaaatttataacaccgctcgtagtatgtatgccggacctgacaatagaacgaaagtgtttacttgggatttaactcctaggtctgcagatgaccttatacaaattattcgcatctatgaaatttttaactactattcttacggtgtgacgggaaattcatcatacgcaaaagaagttaaagctgctattgatgaatggtataaaggaactcttaaatccgcagctccagatggggctaaagtagaaaacacagtgtttgagcaaataacatcgtttttaagcaatgttattgtagtttctaacccaacgatttggactgttcgtaattttggatattctacatcaatggatggtagagaggatatatttgggccatgccaaattcagagtatccgctttgataaaacgccgaacggacatttcaatggtttagcaattgctcctaaccttccaagcacgtttacgcttgaaattactatgcgtgaaatacttactcttaatagaggtaacgtttatatcggaggtattgaataatgtttactctcgaagaatttaagagtcaagctgctgatatcgatttccagagaactaatatgttctctgttgtattcgctactgtaccctctagtaaaacccaggctcttctaaacgactttggtggagagctgtataataatatgggtttagatggaaattggcttggattgacaccaggtgaattcaatcagggtataacaactatagtgacacaaggaactcggcaagttgttcgtaaatcaggtgtgaatacatttatgattggcgcaatgactcaacgtgtggtgcagtcattattaggagaatttacggtaggtacttatctgctcgatttctttaatatggcatttccaacagcaggattgatggtttattctgctaaaataccagagaacagattatcatatgaaatggataagttccataacgctcctaatataaaaatcacaggaagagatatggaaccgctggttctttcatttaggatggacccagaagcaagcaactaccgggcaatgcaagattgggtaaatgctgttgaagacccagtgactggtctgcgaggattgccacaagacgtagaatgtgatatccaagttaaccttcatgctagaaatggattacctcatactgtatgcttgttctcaggggctatgcctgtagcgtgtggagctcccgaatttacatatgatggagaaaacacgatagcagtgtttgatgtcacgtttgcatatcgtagcatgcaaacaggttcggttggaaaacaagctgctatggattggttggaagataaggctattcagaaaattgagacgattaatccaaatcagggcttgagtgcgtctgcttcaagattgtctcgtttaggcggggctggtggtggaatttctaatatcactactacaacaagtagaataatttaggggccgtaaggcccctttgttttatgcaatgcagccaataaaccctggctcagtgcgaagaagttccatttcgtctgtggtccaaactactttaacaggaatgataccttctgctttaccgtttagaaccgcttcgacaaacgatggttcagttggcttacggaagatatcttgaataagaaccgtcggagtaccttcgttaaacccttcaagcatgataagaacttcttcattgaacttctctgcatctttaacatcagcagaccattcaataccgttaaagcgaaatacgtgtttcatatcaatttcctcattggtttgtgtaagtctatagtatcacgtccttgtgataagtaaacaactttatgcaagtttttctgggataccatccaggttgatagcaccagccagtagctccatggtacgcgtgtagctaaccttatctgtagaacggtctggcgaaaagtaaatctcatttaaaaagcctttgaacttgctttcttcaagaggttccactttgccctgttccatcaagatgtcaccatcatagagatgaacggattcatcgatttgctctggaggaactaccgtcatttctaccatgaatgtcttgttattcgctacaccaactccatttctaaaaggagttccccataccttgttaactttcattgccaacccgcgaggaagaataacttcagcctcatcgctaaagcttgacaagacacccgggataactaccttaactttatcggccccatgaataacgaatccaaacttaaactcatcaccataggcaacttcctcgcctctatcaactctttccaagttgtctgttccaataacggaagatactgcatcaatagttgtttctttgttttctaaatcagaactaggtgcgtctggcattaatgaatcaccagcatttgaataagcaccaaagataattggacttaacgaagtagaaacatagttctggaaataaaacattttagactcaatgttatctttaaagtcttcatattttcctcgctgaccgcgatacaaaagagtgcctggttcaagacgcaaacctttttcaaaggcagaatcgagcggacgaattttcttgtcaataatcggatcgcctaagctttccataccaataagatagttattaacaaatgaataaccagaaccgcagtaatggtgtattgcatctctttcttcttcgcttaaacgagattgcatttcacggttatattcaattgctttggatatagaatcgccaacaattgacacataagcggatatcatataattgacaagattttggtattgacgtaaagctccgaaatcgtcagctggaggcatatcaaatccacgagtagctacttcaacgattttacgcattgtttccatagatgcaggatttttagcttgagcaataacgtcagcaacgtctgaaattcgttgttcagcgattttcattttgtctgaacccgaaggaatgaaaaccttccagtcgtcatgcattctagacatttggcctacaaataatctctcaactgcatcgccaaaattacttccatatccgccacgaacacgatagtgcttgatatcatcaacataaaaaggaattgatttttctaatccggctttgatatctttttggaggtctaccgtatcgccttctgcgtttagtactggagtgttagtagttaattcgtaccagcgttcacgtttattttctggccaatcttcatcaacatatgaaacaaatttgccgtactgtgctcggattaaatcttttcgagacactttcattttactcattacagcgagttcagatttcttgtcttctttttcgccaatggaattagccaatgcttcggctttggtaacgttttcgccggtttctttagacacataaacttcgcctactttggaatctactttggtgtaaagttcttctgaaatttcaggaattccttcaatctcttcaagtttcttacctttacgaaccataatagaataagcatacttacctttgtagtaagccatatctttcattagattgaaacgaccgccggtgcgagtagtaatcaaccgagcaagaatgcgttgaatagctttatcctgtccttgcattttcttcggattaaagcggaacattaccgcatcagctttaatttgcttaactactttgttgacggtctcaaaaatggtattgatagcaccaatcgggtcttggcctaaaccacctttaagcgcgccgatgttgcctttttccgacacagagaaaacatagacctggatgaatttatcacccatcttgatgttcttaactgcatcaccttgacctgacccttgtactaaccgaatcattaaattgttattacccggcaccttaatcaaaaagacctgtggtaccttaagttttggcttaacgttctcgacgggatagattttactattctcttcatcgaaaacttcatttaaaagttccatgacatatcctcgtttgtttattctatttatacgaaaaaaggcccgaaggccttaattaattattgttactgtacgccaaacttgtagtccatttacagactcatactcttcaatgttttctttgaagtttcttaatgtgttaatgttattaaactcaagaacttctgtgtgaacagaaataccaccacgtccgtcaagagatttagcaatcacttcgtataaaactttcattttattcctgttgcctcagtaaagttaacaccaaacgcggcttcgaatgtattagccacttctttatcatatctacgctgtttaatgataggtaagaataatcctactgtaccatcatcacgaccttcagcagttacccatccattgcattcaagttcccagatagttcccggaagagaatctctgagcttccataaatgagtacggtcaagttcatgtaattcttcgggcttatctttaagacctgacccagcgttaacacgaatacgaccacattctgatacgaacattaagccgcccattttaccaggttgttttctatgctcgtacgaaccgacacatttcaaatctacggtgataacctctttaaatttaacgaggttcttagaacgcttatcttcccaataagcaccgatattcttaaggataataccttcgagaccttggtctacgtatgtcttatagatagcccgagcttcatggatgttatgtacgacacggttttcaattagaataaccttgtcatagcctttgctcatcatttccaatgcacggaagcgtacatcataagcaaatccaggaactttaccttcggaatatactacatcaagcggaacataatcccaaacttggaatctcataccttccgcttcttcagcagagattgttcctttgattgctttattagccaatccgtttgattctgtacgagccgtctgttggaattccttagccttacttagctcaggaagctcaggctctttaaacatatcaaacaggtcgttttcttcttctttcacttcgacatgatataccaactcgccgtcaatcatcacaccattaggatggcgttctcgggcttctttggtcatctcgataagttgacgcttaagtttatctagacccaggtattcattaccggaacgagtaagaagagttacatcatctaaatcatctccgcggatttcagcgaagcaccgggctccatcggctttaagctgagcgaatgcaggaaatttaatatatgatagcgctttctcagaataagctgatgctaacatctgtggcatctcaggaattaatttcttccataccttgttagcaatagaacctgaagcgccgcaacgcatatccttaagaaggacacggaccagtacactagcatcaccctcgttcatcttagagagcaaatctactagcccctggattgccatattaccagtaagtactcgtgctgccagaatgtcttggaggtaatctagaccatcagaaaacgtctttgaaggaacatttggatatttaacgggagtatattctggaactttcttaataaagaatttaaatcgcccggaatacgccagcagataagctcgttttaaatcaacgttatctttattgtcaataagaatttgggttttagctttagaacccttagcatcttcaattgctttgatgatatcaaaaatcattattcacctaattcttctgaaagttcgcttacgctacgatgataagttaatccatcgatataaacaaacccgttattgatgcattcattccaaatcgggcacgcctttgcttcacgccaaattggattccaacgataaaactgattaacatgaccgtaatcacatgataaccaacgtttacccaccttagtatgaactacaaacattattcctccttgggtatggtcattataccatacccagattgttagcaattaatttggtggttatcacatgtaatacgaccgttattccaccagtcgtttccaggaggaacatgcggaccaggactaaacggaatgataggttgtttccaccaatctcctggaacttgtcgtggaggccaattaaaaggatgttgctctttacgaatttggtctttgatagcttcttcccacaatccagaaagagacttctgcggtttcttaacggatttcagagattccaggcaagttacaatttgatgccaatcttcaaccataattccaggagcagtcactgaaccttctcgctcaccacgaggcatataaaacacacgagtttcagtgtcttcaaatactttgctggccgcagcaatatgtttaggcaaatcatctacatagcagacgatgcgatcgccgtattttactttagccttttccagtaaagcatctttagattcatcataatcgcagaccatgatttctgtaaatgcatcagggaacaaagcatttagattgaaacgacgattaaggttagcatctactgagttaccaagagccgtgatagcgacaaaatcgtatttttctttgagcttattaactgtagctaaagcatcagcatacggagcaagataacgaataaaatcgctgttgttgtacttcagaagcagcttaacagccagttcttcttcacaatcaaacagctcagcgggtttaatgaatttttcagtagtcatcatatcaaggatatgctctaccggaagattatatttttgggcaaaataaggcagaccactttgccacttaacgatgattccatcaacatcggttgcgattactggctttgacattcggggaaattcctcaatgcttgtttaaatttggcaacgctatttgcggcaccggtgaaattgaaccagattaaccctggagcgtccgcgggttctatatcaattatttctatattataatactcagcagtctttagcatttccctggtgatacgtcgggcaaccatatgaccgaagtgaggattaatagacatcgtcgttagcagcccttaattgagtaattggataaagctcggattctgcatggattgaacgattgccatcaacccaattaacttcataccacggttcaactgagtaggctttaatggctggagccgtatcacatacaactccaggaattccatttgctaatcttactgtactgaagatatgatatttcatgcatcaagtctcactgcccattcaggcaattcaaagaaatccggagcatcaatttcatactcaacggtgtgttgtttaacgttagctgacatgatatcaaccattgggtggtttttcaaactgcaagaaaaaataccagctttaggtttaggcacggatacaatcatgttgatttcctcaaaatttagttatgaatttttctttcggcattttagcatttgagccatcactgtcagaatacccaattggcatagttgcattaatgaattcaattttagcatttataacattaatgctcagagaatctacaccgtcaatcatacgaaattcaggagggcaatacttatcaatgtatgctttcacaccatttttattagcaggtgtaccatcgcgggtatcgctgataatggtttcaacttttttctttcgtgaatcatagaaagctgatacaatcatttcaatttcctcttaaaacgggcgaatattaacgtgaaccacagggacagcaaaaggttgcatgattacaacttttgtgtctttagttgcattcaggcgttgtacttttgcaagattaacagcttcttcctttgtcaatccacctttgtaggtatcatttcctttatttgaggtccaaacaccccaatcattgcttccatcgtcggtcttcggttcaagttctttgtagatggtttcttcaaaataatgctgaaattcttgattagtaataatacaccacatgtgagaaaagcgaacttcatctacactaacgcgtttgcattctccatctggcttaatgatttcaaattcaactaatccggtattttccgcatatttaaaggttctggtaattttaattggattattaccgatttgctcaaaaacacccttgataagagcgcctggagacaagcttggagtctttttaagcttatagaatttacctttttccattatcatttcctcaatagtggggccgaagccccgagttagttaaaacttgatttcgtttgaaacgatatcccagattgcttcacgttgttcttcggttgttttacgaccgaggatgtggcgcagataaattttaacaagcagctgacgatttgtgttccaagacggatgtgaagataaatcacgtttacgaacttcatcatgaaatccaactttgatttcagaaccgttgaactgaatatccagagtaggaccattttcaaagctaaagaatacgtagttatcttcccagtacatatcgatttgagctactgtgccgttgttgtgttcccacagcaaagtagtagaaacgtcccaagcattgttctgtacgtatttgcggttgaagttagtgaagttcatttttattctccgtagtttgtttatctgtttgggtggtacaggtctatagtaacccagaccacccaagaagtaaacaacttttattcaaaaacttcagacatttttcacctctacagtttttacagtttttacttctgcaaatccgatgcttttaaacagttcatacttggtagtttctggaacgatatcggttagctcaaggatgatttcttttgcttcttccagagtaaagatgcttcttccgtccttaacgaccggtgctggtttaatagcagctgatacttcaaaaaccacgtagcggtcagtagtactttgattttcaaacgctcctatttgcacaacccgtccttcttctaactcgtgagaagaaaataagcatgacagagaccggtcatattcatctcctatggtttttgccgaaatgattttaccagtttcggttttaatcttaacaacccggcccagcgaatcaagttctaatggcgtccagccttgaactccaacaacggtggcaatgagatagttaattgtgttcttagcgtctttccatctacggtaagtttctggggaaatgcaatatactcggtttttgctgtaattcattttgatatcctcaaagatggggccgaagccccagtcaagattactgtttagtccaattatccatgtttaatttaccaacctttttcatttgttcaattaaagcatcggcacgattacgaccattttcataccaggttacatcttctgagtaaccgtcttcttcatctgtgtaggtttcagaacgaatacgaccaacaactggagtgttcagaacatatacagaacccgtgaaccagtttgttaaagtgatatgccagcagaaatcatctgatggaccgtccggtgtcatgcatggaacgatatcaccttgaactttagacaaaatccacattttctcatggacagtttgagctttgtaaccgtcatggtctttagtcttgatagttgcgttcaggttgatggtattcattttattctccgttgtccgtttgggtggtacaggtctatagtaaccttgttgaacttagaagtaaacaacttttttcattctgcggaaaataaaaaagggactcccgaaggagtccctgaacttatgctttcggcttaccaaaacgagaagcatcatcgcgaagaaccgcacgagcccgacgcatgattttctcaaccgtctgattgatacgcttgttcgacccacgcttgtagccagcgcgtttagaggtaccaacaacttcttttactgcagtttttgctttagcttgtttagccattttatcatcttccattttggagaaatacatgggagcacgttcttccgaggttcaacttctttcgacagttctttcggttgtagctcccgcaagccctcaagggggtacgtttaaactcttatctgttgcacaccgttagcttaaaggttccgggtccgatttatcggggataagatatacaccgatggatgtataggccttgaggcgtactcccgattggccatcgcctcggggtagcatgcacttgccgtttattttctagctgcactttggtagcaaatcaccgttggtttcgggtgttttacgtggggataaccaacaacgtccacatcatacgttacccatgcgtacacatggtgggcgtacaaattacttcagcgttaccacaaagtggcgaacagctttgcgagcagcagaaccaagatgcttagcatacttcagttcgtccatcgcttctaaagtatcacgaaattcagcttgtgctgggttcaggtgtttaaaccctttcagaacttccagtgcttctgcatagatatcgattgaagcaccgtagttttcgtgaccggaattccatgcattacgttggagttccagagctttagtaagttgtttgttcattgaatcgttcctcaaatgaggttaaaatttggtggacggtaaccgaggtttagctcgggcatccaccgcgtagaattgctcgggtaactaattgtccgacgcccaattcatattattatttatatacgcatgcaagggacttataatgacaagtcacaaacttctgccgaatttctttgggtttcttcacacctgctgctactaacggatgaggtacgtttctgatattaccaacaggcagtggagtcaaatcaccgacttcaacaaatcctttcggtacatcatcaccgatagaatagatttcacacatatccggcagttgtccttgttcttcttttccaagaataataccggaaggagaaacaatttcatcaccttgctgagcaggttcagatacgagaattacatactcgcctagagctttaattggaagttccatgtgttacctttattgtttgaccatgtagttatattaacatggtcagtttaaagcaaattacttaccgatcatctgcagcagatgctcaactttcataccatttaccgagataagtttatcaaaggtaaatgagcgccaaccttctttctcagtatcatataccggaagtgaagtagtgctttctgctcgggcagatttaatagtgctttctaccaaatcagatggaataatatctttatcacgagtacagcgcagagtacgaatagtgccatcagctttttcaaacacaatctgggattcgcccatgctcagcacagccttcagagtttcacgaatatggatgttttgttcagtagtcagtttcattttgatgtctctttaatagttttgataattacagatttgcgcttggataattcttttaataatcgaactgcttgatcttcaaatttaaatgttgctaatggtttccatttaaaccaataccggcgttctactgagtatgatataacaacatcaccacttaggttaagtttattaatttcaacaattctaagtttcattattcaattccacagaattctttaatgttataccaattcaacttatccaaattacgttttggaacattgaacacctcgattccagcagaacgaagaatatcgtcccaaccgggttcgttcttgtcgtatgtttcgcagtatactaattttttaataccagactgagcgatggcttttgcacaatctggacatggagacagtgtgacatacattgttgctccatcaatactactgccgttccgggcagcaaaaagaatagcattaagctcagcatggatttcattgactttagaccatgcagagtgggctgctcgatgttctttgagcaatccgacttttttgacttggaatccgtcttgacgcaatcctgtagatttgtaaggaatttcaccaatccaaccttgttctgctgcatggtcacaacagttcacaccaccagaaggtgaaccgttatagccagtagaaataattcgtccgttcttttcaattactgcgccgactttccacgagcagcattttgactcttgagatacgagatacgcaatttgtagtaccgtcgacgctttcatttaaatcaccagataagttgtgttatttgttttaaccaattttaactcgtcagtaggagaagcaaaactctctactcgagaagtacgaatgcctgtaccatctggaaacggatgattccctcgttcaagaacatcggaaaagacataaccataaagaggttggccttccttaacattaacgttactgtacaaaatagcatcatattcttcgcgtggaattgaccaaacaccttggtcagaaccaataacagcactgatcagccgaatgccatttgggctgatttctgctttaatgccacgagcatgttcaattaaaagagcttctaccgcttcacgtaaagtcattagatatgtcctaaaatgttagtcatttcaacttggcctgttccggttaaagccaattgagtgtgttgattgctctttccattattaactgtaatgatataagcatcaacatagttaaaggatgactctcgtcggagagtcactttacttccaggaacccggtttgctacttcctgtgcgaagattttaaccttcgaaataaattcatcatgcgaaaatttagcgtcagacaacataagtctcaacctgttgggtttcaaaattagcaataattccaacgataaaccagtcgtgttcaccttcgccgcaagaaattttaatttcagacgaaccgcctgaccggtcaatagaaaatttaataacttcgccgtttggaataagtgcattcattgcagataaaaactctgcatgcattttggctacttcagatggagtaaactcatctgttaaatgattagcaacaacttgcgtaaatgatacttttactacttcggaatactttggaaacattatactttcctctaaaaatcaccgtgggctacttgccagcattcaacaccgatacgacgccacatttcaactacctgcgccctgtcatctactgcaagtttgacattataacgatcagcaattcggtcccagaagatttcttcttttaccacatcgtctttgcgtgaatcgccttgcttacgttggaagtgttcgcctgtttcgccaacatggtccaacaaccatttcttcgtaatgcgttgataaacagtagggtcttctttagtaccagactctctgccggaaacagtaagaattttatatcctttgttacgaagcattttaagaaattcaattaccatttcctttggatggtctttaccacatttggccaagtcataaggagaacgatgattgttatctgctaacgtgccatcaaggtcaaagataactgcttttggcaatgattcatctggaatgtacaaatcatacggatgcatcttagagtagaagctacggagcacttcaataggaactgcattcgcgccacgatagaggttacgcttaactagttcagtccaaggaacgtcaaagcgtttaatttcccacttgacaccatcaatttcatatgccaactcttgccacttcttgatagtcgttggattaaggttagtatcagcaatgatgacacctttagtggtttccatctcgagtagagtcttcgccatagaaaactggcatacagatacagacttctcacgaagcttagaatatttgtaatcattacgtttatcaaggccaaagatgccttcacgcaaatcatcacgagacaaaacataccaaccgggattagctgctacgtattcgttagcccaggttgttttaccagagcctggagccccttgtgtcaaaaccaattttttcattatacatccttaagagtgtcaataaaatcatgaagagccttagacttttcaccccaatttgcacgatatttttctttaattgctcgcaatggcttattcattgacagtatatcatttttgtcataattttcagctgcgcgtccaaacacgatgcacgccaattcattttcagcaattaaccctttaagtgtttcatactgttctcggttcattataataccatcacttaacgcaacgaggttctttaaggtcagaacgataataacatatcattccgttagcatctttagtataacgtaaaatgtcattcatccagatgcgatactcttgagactcttcaaacggcataccaacccaggctttaccgtcaattacttttacttcccaatgtccttcccatttttgaattgggtctggccactcaggatgcaaaaccgggacatccggtgcactagaagaacatccaacaagtaggctgataatacccatggctaatagacttcgtttcatctggtagcctcctggatatcttctgcaaacttattgaagcttgcattaatctgtttttcaactaacccaggtttagctgcaactacgtttccacgcttagcatctttattcattttagcgttggaagtatcacgagctgctcggttttcctgatagcctttataggttgtctgcagattttttatagaaacaccgatattttctatttcttttgcttgtcgatcagattcatcttggacgactttgaggtcagctttaagattttctacccgccacgaaagatatttcaatccaccgacggataatgctaacacaccaatcatcaaccaagttgtgtttattttgagcatagtttaaggataacctctacgatatcatcacgggataatcccgaaatgaggatgtgacgatcagaactttccgaaggagaacacttgaagcaagcttctacatattctgccatctcagaataattcagctcgcgatgcataatgccaagacgatgtttgccataaatcgggtcaacgattacatagcatttgcatccgttggcatgaacgtttggttgagtgatgtttttaaacacctctgcaccatacttcgcgagatgattatctaggaaatcaatcatttcatctacggcttcaggcaaggcttcggcacgctgctcgttcacacgattagtgtactctttttgcttcttacgagcagcttccttgcgtgccatatgcgttcgtaggtcagtgacgaatcccactttcttggtgccattccacacaaaatcccgtcagaatgagtaccatatttgttaacaaccatatctaaagtaattgcttgcatatccatttcattatcctcatcagttggtgtaagtctatagtatcacaccttgatgaggatgtaaacaactattcttcagaaatttcaatttctttttcgtactcttttggaacatatccagcccagtacttcaagaacactttttcgaggtctttaagcagtttatcaacatctacagttccttcgtacatgttcatgataacaccaaaaagatgacgctgattaaccgtggctttctgcgcagcaatagcgtagtctttacgagcacgacctctgtattcatcatagaatgactgacatagctcaagtgactttccgaggtaatctagataagcttgctcaaacgcagaaattttcttaattgcgtattcatctccagcaaaaagagaacgcaaatcatcggaatttgcagatacgacagacgcaaacagtctttcatttgacgttattgagtctttagtgtgatgaagagccgagtaccattcggttttaaccttaaatctctgcccagtgtttagaactgcaatgtatccttctacgccttcaagtgcacgaacaccttcaacccaagtgtcggggtcagaaattccataagcattaattaaataaggacgaattttagcattagcgtacaaatcgtcatatttaacatactcgccggttgcgttatcacggacgtttaacacaaacagctgtggctcctggtatgcaagaacaacacgattatcaggtgaaacaaattccatgtttacagtatatccatctagtgctagttcaagaacaacttgatgaagcgaagagtattcttcactattaagcagggcagaagaccttctcgcctggtcactgtagagagatgtttttgacttaaggtatagatacccatcatcaacataagatgatactagagagccatcagccttatccataatgtattctacatcgctaatatcaattcccatcgttaatgggttttcattcaaattaaagaatttttccattggacgagaagcaattcgaattggagtatcaccatccatttcaaacatgatgccccggcactcaagagcatctggttttaaccactcgctgtagcttgcatagtgatatgaaaacactctgaacttaccatccataggaccggtaaaatctttataaaagaattttgcaacttctgagctttcacacagattcattaaatttttatatagctctaacatttctttaccttatgtttgcaattatcgtagtgccatctgatagcaatggcctttgaagttattataccacaatgcgggcatggactgtacaaaggctttttctttcctttttggctttctgaccgcttgagtttagtttcttcagattgtgttttaccggttaaagattttgatatcttttcgcgtgtttctttggcatgagtctttccttgagtgggacttactctgcctttcagtgctttagataaattctttctatgttcttccgttcgtttctttccggagaataagttagatgtataattagaatgctttattctagagctttcataaaatctggaatgaactttaaaattctttccagaagaattacacatcatccaaagagcataattcattttagaattattatgtatctttgataatagcaaatgggcaatgaaatgttcacgtccagtcaataaaactaaattagaaacatcgtcatttcctcctaatgattttggaatgatatgatgagcttcagtataatagtttaattttcctttatcattgcctcgtaatttaccctttgctattaggttatcatatactttaacatagttcatttagctttgttagtatgttgtgtgttccatggaggattgaacttcttaatcagaagaggttcttccaagtccatagtggatattgacatctcgccaagttcattattaatcgaaagattaaaacactgacgagcatagaactctacttttttgccagccattagtgcttcaaaaatcttggcagatttagctgaatcagaggtttggtctttccgattaatagcagttctataataatttatacgtttacgaagattttttgtcttaccaatgtaaaccagctcatcatcaactgcgatggcataaactacgttcaacttgtttgctatcagaattggtttgatggtaaaatctggttctaactcaagttgaacatattttataaaagaaaactcgttagcaatatcattcataataaagaggggccgaagcccctttccttataagtactttttaaatccaattagaacatcatcagtgacatcattgtcaatctgagctaccagataagaacttatctcaacttcctgaggagcagattggactgcatcagagttaagatattcacgaatccagggaataggatgtcgagttggtgcgtcagtgattgggcacggcagaccacagctacgcatgcgagatactgttaagtagtcaatgaagtcatgaagaattttaacgttcagacccggaagaccaccattacggaaaagatggatagcccaatctttttcttggcggttaacttccatgaagattttaattgcttcttgttcacactctttagcaatctcaacccattcttcgccatcagtgccagtttgaagttgacgcagaatgtactgtgtgcccttcagatgaagttgttcatcacgagcaatgaacttcatgattttagcattaccttccatgatttccatatttttatggaagttgaaggtacacgcaaaactaacatagaaacgaatagcttctaatgcgttaataacatgtaagcaaagataaagagatttcattaaatcgcgtttagcttctttaatttcgatattatcttgattaaagcagcgatttttggcattttcccatgcgcgagtcttcgctataacatcatcatagtaaacaccaattgactcagcgcgtttcatgattgcttcgtcaagaacgatttcatcaaagattttagctgggtctacataaaggttacgcatgatatgcgtgtacgaacggctgtgaatggtttcactgaacgtccaagtctggttccaagtatctaggcttgggtcagaaataagtgcagataaaactgctgctggagctcgtccttgaattgaatcaagaagagattggtacttcaagttatcagtgaagatattacgctgatgttctgggagtttttcaaactgaccacggtccatcataacgttaacttcttcaggacgccaaaagaaactcaattgcttctcaatgagttcctcgaatactttatgacgctgaatatcatagcgtgcaattcctagaccagaaccaaagaacatcggttcggtcatgatatctacttgcttggtattaaaaactgtactcattctatttcctattctgtggtgttaaccatccgtggtctaattataattcccttttattaaagcttacaggccgcgcagtcagcagagtcttgaatcatatcatcgttaccggaaccgtcacgggtgttatgatagtaaagagtcttaccgccaaagtaccagaaataaagcaagtcgtccatcattaccgacatttcaacttttcctttagggaaattcgccgggtcgtaataagtattagcagagatgctttggtctacaaatttctgcataatcagaacctggttcagataaggcttattaccctgtttcgcgagctgccaggcataatcataaagggaagcattgtgctcaacatttggaacgacttggttgaagcttccttcttttgattctttaactgacactggtccacgtggtggttcaataccgttggtagagtttgatacctggctagacgattcgcatggcataagcgcagataacgttgaatttcggataccgtatcgcttgagatcttctcgcaggagttcccagtcacagacatagtttggagctgcgagttggtcaattctttcgttgtaccagtcaataggcagttcaccacgtccgtatcgtgtttctttgtaaagcgtgcatggacctttttcgctagcaagtttaacagaggctttgatgagtgcatattgaatacgttccatcatttcgtgagtaatatcattagcatctgcgtatgaagcaaagttgcttgctaaccaagctgcatagttagtaatgccaacacctagtgctcgacggtctttagcttttaacgctttgtctacaggatagtcttggtaatccaaaaggttatccaaagcccttaccattacttctgcgatttcgttgacttcttcttggtcttgccagttgaagttgtcgagtacgaatgctgcgagtgtgcatagcgcgatttcgccatcttcttggccaacatccgaagttggtaacgcaatttcgaggcagaggtttgattgcttaaccgtagccacatcacgaataaaaggaccatattcaccaacgttatctaccatgtacgggtaaattcgagcagtaccagcacgttcagtaaggaacaactcaaacagttcacgagctttaatacgtttctttcttacgtctgggttcttttccagctcttcgtataaagtacggaacgcttgtgcatcacggaagtattctgtgtacagcgtgccaagacatacatcgggactgaacaatgtgatgtaatcattcttaatcaaacgttcaatcatcaggttattaatctgaacaccataatctaaatgacgaatacggttttcatctacacctttgttgttcttaagtacgaggaggttttcaacttccaagtgccagattggatagtacagtgtcgccgcgccaccacggactccaccttgggagcaggatttaactgctgtttggaagtgcttccagaaaggaataactccagtatgtttgacttcaccgaatccaatttttgaaccctctgcgcgaatcatgcctgcattaataccaatacctgcacgcttactgatgtatttcgtaattgatgcagcagcttcgttaattgaattaagactatcaccaccttcaataaccacgcatgaactaaactgacgtgtcggagtacgaacaccagacataattggcgttggcaatgaaatctttttagtagaaactgcatcatagaaacgaataacgtttgctaaacgattttcgccatcatcttggtgcaagcacataccgatcaacataaaggcaaactgtggagtttcatacaattcaccagtgtgacggtcttttacgagatacttctcgataagctgcattgttccagcataagtcatagtgaaatcacgctcatgcttaatataagaatcaagcaaagtaatttcttctgctgaccatttacttagaatttctttatcgtacttatttgcgttgacgcatcgggaaatgtggtcaataaatgcaggtggctcaaactgtccataaacacgcttacggatttcaaacatagctgcattagacgccacatattggtaatccggttcatcaatagaaatgctattcgccgctaccttaacgatagtcttttggatatctgcagtgctcatgccatcacgtagatgggatttaataatttcatataactcgtatgggtctactttggttccttcgcacgcccattcgaggactttaatgattttctgcatgtcaaattcttgactaacacctgagctcttaattacttgcataagtcctctaattcaaatgtatctttaaaaagtttattcactacaagagctattatatcaccatggcaagaaagcggtttgcaggtgcatcctaatctcattcctcttaaagtttctaagtgctctcgctttatttctccgttccgaatcttagcaataaaatcgtccttaaatgccgcaatagcatcaggacgattatcgcaatctttaccgacgtaatttccccacattgttccacgttggatatttacatcgaagtcggaatggtatttattaaccacccgacatatcttcatgttatatcaacttcaaaccagcagattaattgtgttttgccaatagaccattcatatgatttaatgacagataaaacgcgttgttcgatcccgtcaaaaactatcttgtcattaacttcaggcaaatcactagagaatgcatcacacatctcgcctaatattgtttgtcctttacgaacaaatcgaatattcatatagccattttccccttaattgttggatgggatttatatccttcaagaacaaagtcagatggtttcatcattcctgtaacccaagctaattgttcttctgttgctaattcatgaaattctttatcttttactggaggccaataattaatttcaagttcacacagctcttttggcctctcactgttcaatatggttcagataaatgtgagtgttaccaccagtgaataccaaatgcccaggtttaagattggtcattttagcaatgatatgaaccaatgctgcatatgacgcaatattgaaggggaggccaaggaatacatctacagaacgttgataccactggaggtccaaatatcctttacgaacgttgaactgataaagcagatggcacggtggtaatgccattttgtccaaatcaaccgggttccaagcggtcacaatctggcgacggtcagttggcaattgcttgatacggtcaatgaccaattttagttggtcaacgcccatgaaatcacgccactgctttccatacacgggtcctaactcaccaccagaataccccatgtcttttgcctggttttcataattgtcgtcccagacagttttaccttctagtaatgaaccatgctgaataagacgcaattcatgaacattagtagacccctgcaagaaccaaagaagctctgcaatacatgctttccatgcaagacgcttagtagttacagcaggaaaccctttttgtaaatcaaaacgtaactgagtaccaaacttcgcaatagtgccggtaccagttcggtcatccgtctcataaccgttttcaaaaatgtctttaattaattcttggtattcacgcattaaatttttcctgaagaggagtaaagaaaagctgatcaccacgcttttcaaatcgcccaataatagacactacatcatctttgaccatcacattgccatgtgacattccgatgaacatcttcttataatcacgttcaatttcaataggtatatttccatttcggttatatactgtagttgaaccgttataagtgctaagaccattataactgaaaactagaagatgaataccatgcttaaatggaaatcttttccacctcttttggactttgtcttctgatagctgagtgatatcatagtttgcgctcatagaccacctctgaaatgttagtcacttcatcaatatgataccagtgattttctttagtaatgaatcctgattctggccaagtaggagctgctacaaattcagcaggtagagtgacatcagaattcactctatgactttttctgatggttgtttggataaccctatctgcatatggatatgccttctggatgattccggcaccacctatgatagaataattaaggtctctattaaaagtgatagtactgttgtaagaagtatgagcggccataatgtcaccacccaagaaaccgataaattctaattcacttacataagcatctgcaaagaagccatttttagcagttgccaacgcacgactcatgtcttggacaacgattgtcttacgaccaggaagaggtttaggaaaactcataaaagtctttgctccgcaaatcaagatagtatctcgagtacgattagcaaagtttttcatgtcctgggaaatatgtttccatggaagaccatcgcctaaaccgaaagcattttcgtttttgccgtctacggtttttgtaggagcaaatgcataaactatttgaatcatttaaacctcagcaaaattcaactcgttcaacattaccatcttcccacttctgttgaagctcttggagacgtttgatagcgctatcgatattggacattgcacagatagttacccattcacggccatcccaccaaatcaaatcatcgtaatcatctactgcgaaattttccattaaccttgcctcattccacacttaaaacaccggccacctaattgccataggctaccgccgcagtacttacaatcccagtcagttaaaatccacatgacttgtacccactagctttaatcatgttctgaagagttttaaacccttctttaatggcttctgaaatttcctcaaatacttcctttttaagaatatacaacgaacccgcttgattgccagaaagagctgaaatcacaacttggtcattaattaaaaattcgccatatgctgaatcaattttacctgaaacctgattgcctcgggaatgagggtcaaatacgagctcaatatgagttactccaggaatttcatcaaattggcagcgaatgttaacacgcggatatcccgttacactaaatttagacatataaaaataatcctaatataatgccgctaataaaagcggcagtaacagaaattagcaaaactactaattcagcctcaatcatttcttggccttagcaagtttaaatgcttttttgaattcttcaacatcttcaacaggaatccaaaagcctgagccatacccatcttcatagcatgggcagttatcacagtaatcattccaatagacagtttcaccacccatagtgaatggagcttccatttggcacagtacttcttcaacacgctctaattcttctgggtttttatcgcaaatgcagaaattccatttaccacgatattcagaaccaagtttgatgctttgacgttgaagtttcatttttattctccagtagattatggagctatactatcacaagcatagctccttgtaaactactttttgaaaacttttttgatcaagtcaatcatttcttctgcattttctggggtaacgatcaagtccaagcgagtaggaccaggttggattgcactaccattttcatataccggttcgaagtatttgaattcataatcagagatttcaaagtatgcgtctccaaatccttcagcgtcagcagttgttccatctttaaattttacttctgtgatgaaactattatcttcgtcgagcattttagtaggaaagaacgaaccaccatgctcttcaatcatcaagcgcatccggcgatttccgctagatgaaaggtcccactcggcagcaagacttgggataatgcgatattctgtgttcagtttcataatttacccgctaaaagtcgttaatgtatcttcacggcattcatcatccatgccaggaaaatattcttgttcaagccataaccatagtgtaggagtatcaccttctaccgtgatttcgtttcctccccatggggcagatttgttactaacttcaatcaaaccgtatttttcaatggtttcaatgaagtgttcataatcatatatttctacagtaacctgtgccattatcatttcctcaaagtggggaccgaagtcccccaaaggtaattattcttgccagtcttccatcatccaatcgatatcgtcccattcgttggcttctaaccaagcacgaaccgcttctttagaaccacggaggtcaatatttggccaaccgccaccagggccttctttaataactaaatcaaaatcaataccatggtcagtgtcataaaaacgtgaaccatcttcaaaaatcaaatcagtacaaaatcctgatttattgatgtaaggttctgccacgatatcaatgtttaatttacccatgatgttttcctctactcgttttgtttcgatgtagatatagtatcactcatcaactggcttgtaaacaactttgtgaaaatatttttgtagggataaagaaaaagggacccgaaggtccctttatattagaggtcgttcaaaatatcattcagatcgtcatcgccaacactgtcaccagcatcgcccattatatcgtctgcggaacgagaagaggtcggtttggattcaaaatcagacaggtctttgtcaaaggaatccaggtcatcaccaattttatcggcttgagctgctgcttttgccgcggcaccaccaagagctgctgtacccataatctgtttaaatttggcttcgttaacttcaaacgatttaaactgagatggagcaacaatttcgctgaggtcagccatattttcggtcaggaatttctgagtttcttcatcattgatgtttgcaatctcggactgaccaaggaatttacattcatcatagttctggaaaccaccgactttcttaactttcatgacgaagtttgcaccttcatacacacaagttacatcaaccggagtttcacccatatcaacatcgacttcaaccatcgcgttgattttgtccataattttctgaccgaaacggaatttgaatactttaccttcgttttctgggttagccgggtctttaataaccaggatgttagaccagaaagaagttttacgtttcagaagcttatattcagctgggttgctgttataagaatcgtttttactcagatgagcacaaaccgggcaagaatcaaaatcgccgtgggtagaagtacaattttcaatgtaccatttaccgccgtgtttgaaaccgtgattgatcagttttacaaacggcagagagttttcatctttaccaggcaggaagcgaattactgcttgaccattaccagcattatcggtcttcagtttccattcgtttttatcttcattagagaaagaagaaccacctttcagaccggccagttgctgttgaagttgagcaggattttttcttttgaacatgatttattttaccttgattttatttagacagttatttgtgtgacgcgctattgcatttacagaaatacttttcccgcacactggacagttttttctgggcattgttttacctttcatgccgcaaggatgaggttgtgtttgatgtcgtttcttagcaccatcactccaagtttttagaacttgtttacctcttgtattatttattctatcaccattttcataatagcgatgcaatccatttgaaattaatttcttatgctcttctgtctttggaacatctgttaagagttctgatattcttttacaatgatgttcagaatttttctttccaaatctaggagcattttcaccagaaccaccaaatttaccggaagcagtagataaattataaaatagttctgatttagcaacatcataatgtttatgataaaattcttcttcgtcaagagcgttatcacatacatgtagtattttaacatcgggtttttgaagcgaaattgcgttcaaaaatctttcttgttcacatgacgaccaatactcaatatttctgttgtcaaaaataacaccattgacaaaggtgcaatcatgttttgacccaatataatagtaaggtggagttttattctttaccctatcagtaaaggtaaaccaatatacgatattcattggataattatatactaatttctttacaagatttgattatgctaataaagagtttcttagcttcagcaccgtcaacgtttaaaagttttttataagcttttaatttagtagagtaattactccaaactaagttatccgttgcagtatcatgtgtatttattatatctaaaaacgagtcaagcatgatgaatgtctcgaaagatataacgtttgactgcagaagtttgaacacataagatgttccgactttctcattatattcaaaaatatcatgaagcttatctacattaactttcttggcaaaatagtaaatgttctttacatcttccgagaacgttgttttaatctgcttcaacttacctatatattcacgataaaacacaagggcatcagcatcactgatatcgccaatccaagcatcttggttagctacgaggttactcatgaatatcagtgttaactcttttaatgtatatttctcagcgagtttctcaaagaaatatttgtctctacgcttttgataagctttatcagagacccgcataacccagttatacttaacaacgtcatatcgaccggcaaagtgttgtttgagcattaaatataaaagataaacgctcttaccgttaacgtatctgttattatttccaggcatgcggagacgaatcataataaaaagtccagactattcgttttgtgtgtttgactaaatgatggacgaagcatattttcttccaatgcttctgacataattttttctatgattgctggaggaatatatctattgaagtttccctcaggaatagaattttcttctaaccactgagttgttgcttcaagataccccattccaagttctgttaccatagactcaatagtaaatccgttagcttgcttatctaacagctgattaatggattcagagggggaggtatccccctcgtctttaagcgaaaatagagtcataagcttctaccacttcatctttttcagtttcaaaacgatcgcgtgtgcctttatggaacagagcaagcagttgattaaacagtttgccttctacgccaagttctttcttggcgcggtctttaatgtctttgttaagttcaagatagctttctgctttcaacttattacctgaggcttctttaatcatatctcgcagagcctgtccatgtaccgcttcatcaaatactacttgctctttttctttcttagccattatattcaccttaaaagttgttaatttctttcattaatttagacagaccggatttaacaaagtagctataaattttgccacgacccggtaattgatagttattataacaatctaaaatgttagcaacaatgtcttcgcggatgtaatcaaaatcgattaacacgcggttttccaagaaacgcttatactgttcttcagtaagcaaatctttaatgttttcgccagcatcaagacactcttcaacaaacgtcattttcgttgaaggagtacgctcaccatcaacatgagtgtaccaaaaatctgaacgaactttaatagaagcgacgttatctttcttgtcacctttaataattttaaccatacaatctaaagcaggagaaccggttttagattttaccagtttcttctgcattggtgaccattgcttaacattaggatacttatgcaattgagtaaagtcaccatccgaagaaacaatcatgactggatggccttcgagactgaactttttggttaataccgcaatgctgtcatcagcttcagctttatcaatatcaatgacataataaggcatatactgcttaaattcatcaattacagtacgaagaccttcaaagtatccatcccagtcccaattggattcttcacgggctttagcacggttctttttatagtaatatgctacgtcccgacgccaatacccattaactgcgttatcaacgcagatgacaattttagtgtatccatctttcttccacttaaaagcattaaattttaaagtagaaagaataagatgacgaaccataggagtggttagtttgtcaccttctttatacgtatgaagaattgtcgccattgcaatttgtgacaagtcaattaaaatgacgccctcttttacctggtcttcttcagcgaataagcaatttaaatcagacatttgaacctcgttcaattagttagtacagccattataaatacttctataatgaagcataaccccataggagactctatgagcgatttactgaaacaacatttccgtgcaacaaacggcttggacgcaggcggaaataaagttataaatgtggcactagctgaccgcaacgttaaaaccgacggcgtctccgtcgagtacgttattcaagaaaacactatccaaaaatatgacccgacacgtgggtatctcactgattttgctgtgacttatggacgtcgtatctggattgcaaataaagatattccaaagcctgctggagattttaaccaggcgaattggacttctttacgtgttgacccgaactggatttataccgtccgtaaaggagagtttgaaattcaatctggtcagttcatcaacgttgactctaacgctgcaggtaatgctacattactgcttccgttagcaccagatgaaggtgataccatcgtagttcgtgatattggcgggcgtcctggctataacggaatcttaattaaagcacaagatactggtgcgtctatcgtatttggtgaatcgcgtctgcgtgaggtaagacttacacgtccgtattcacaaattatgcttacgtttagtaatggtgcatggcgtgcaagtttaaccgattttggcgatactgccaagatggtagttccgaacgggattgttccgacgcaagttcaggcaggtgataacgtagttcgtcgttatacttccaactcagagattttcattactctgccgttgttcgctaattcaaacgatatcatcaattttactgaccttgacggtacatcgccaattaaccatatgactgtgcgtacgtttgacccaactatctcaattgggactcctggacaaacagaggttcaagtacgtacttcaggtaatgggtttttggtatatgactcgattgacaaaatctggcgtatttttgaaaatgatttacgcacccgagtaagaataattacttctgatgttactttaatgcctaatgagcatatttctgtatttggcgcagataacaatactgttaaaacaattaacgttactttgcctacagacgtagctgttggtgatactgtcacaatcgcaatgaattatatgcgtaaaggacagactgtagtaattaaagcttctgatggtgataccatcgctagtaatttgaatttactgcaatttccaaaacgctcagagtatccacctgatgcagcatgggtgcaatcaagctcaattacctttaacggaactacatcgtatgttcctgttcttgggcttgcatatattgaagataaagcatccggaaaaagctattggattgtaactgaatctgaccctaccgtagaacgagttgatgctaaagacaatacaactagagctcgattaggtgttattgctcttgctacgcaggctcaagctaatgcggagtcaaacccagaaaaagaattagcaattactccagaaaccttaaatggacgtcgttctactgaaacccaaactggtatagcaagaattgcaacttccagcgaagttaatcagtcaacaactgcttcttacttggataatgtaatcgttactcctaaaaagcttaacgaaaggtctgctactgaaacccgtagaggtttagcagagattgcgactaatgctaaaatggatgcaggaacagacgattttacaattgttactcctaagaagttgctttatcgtactacatcagattcacggttaggtgttattcaattagtaaaaactggtggtgctcctaacacaactgctgatcgttcttctgctggcaccggtatattcgatcattctgattacaaaaatgcagttactccaaaaactcttcgtgagtataaagctactgtaaatcagtcaggaatagtttggttagcaactgatagcgaagttagaaacggaactccggcttcttcaaatattcctacagtcgttacaccagaagctttgcataaaaaagttgctactgacggagcaattggattaatccaaatagctacacaaactgaagttaatgctggcggcgtgactaataaagcagttacacctaaaacattaaatgaccgtacagcaactaacgatcgtactggtattgctcgcttcgcgacacctggtgcccagggtgaatttgaagctggtacttcaagtacagtaatggtaaaccctaaattactgttcgataaatttgctaatactgatcgtatccaagttaatactagttctggcttaactattactgggaacctctgggaccattataccatcaacatacaggaagcaagtacttctcaaagaggtacaaccactcttgctactgctgctgaggttagaaccggcaccgacgccaagaaaatagttactgctgccacgctacatgctaaaacagcaactgaaggagctatcggtcttgctcagtatgctacacaggcacaagttgatgcaggcacattaagtgatagaattgttcctcctgcttacttgaaacagactattcaggtaacagagtcatggcaagctacagacagcgttagagggaccgtgaggctatctacaggcgatggaacgtggaaaggtaatgataccaatggctcaactcttccggataacgggtatgcctctaagggcgtcgcagtgtctccgtatgaattgaaccttacactgaaacattacttgcctcgtctcggtaaagcctatgacacaggaatgttaggtggtcaaaccccagacaaatatgctcgtcgcgatatcgcgcagactatttctggagcttggtcatttagtcaggacacttcatttagcaataatatttctgttcagaatattatatatgctaatggtggtgaagtgaagatttctccaacagctgatactggaaatgtgcatgttcgttttcaaaatagagacggaactgaacgcggtataatttatgctgagccacagactgcttcagctggaactttaaaaattcgtgtcaaaaacggaactggaactactgctacaagtcaaacttatgtatttggcggtaacggtacgttagaagttcctaatgaagtatcaactaaaactctgaggtcttctggaaatgcaatagttggcggaactgttatggttaaggacgttcagatgcttgctgtcgagggattgaattcaatattcggtgcccaatcacagtccgcatttattcgttcccgtgacgctgatacacaaatttttgcacaggattcaactggatcgtatccaattttaactaccaaaaactatgcaagactagctgatggccgttatgtcaagaaagctggtgatacaatgaccggcaatcttaacataagcggttctgctatcgtcattacaggttctgaatcatggtatgtgccaacgaatgaaaccgtaataagacaaggttcttggactgctgaaattaaagacgctactaagttaaaaggccttcgtggttatatggttccaatcagaacaccgattgacccgggtaacccaagcactttggtagtgaccggatatgaagaaaagactgctgctggcggtgttttaactcaggttggtgtaactacaaacaatacttatcagctttggacaccttatcctccgacaaccgaaactgctgataagcgtttcgcgcatactgtgtggatgaggatttataatccaaaccttaataagtttgatgattggatgcgagtgttcacgtctgctactcctccgactgcagctgatattggtgctccgagctcagtatcaactcaggttaaaacccttgaagtcctggaatggattaagcttggcccagttaaaatctggccagaccgtccaaaccaaactctcaaatttgaatgggtaggtgattaatggctgaaccaattttaatggcagcctttggcgaggatttcgtggaaacacgaatcctctctgaggcaaactctgtgaagtattggctaaaagcttatgctacgcattctaatgctgttcctaataagccagaattgaatattaatggtgcctttgatatgacctcctccttacggagggggattaatgttgttcaagttaatggtgacagttttattaactttaaaacatttgacgttaccactgatgataataacgctaataacaaagcgtttgtagaatatgcaaatggattaacgtcaggattgtatattataatgacacatgaacgatttcaatccagtccgttaatagacagatggtttaaaaacaagtggtctgcttcttggccaggttctgatttttccaaatcatttccaaactctgcctatgttggagtgctcggagcagcaaaaggacgcatattaattgagtcattttacggaaatgatggtgtagttaaagaagattccagagctaaagtagatactgtatatgataacgttggcgatgtaggatatacaggttgcccttatcgttccattgaagacactaatgagtactcggattctactggatatgaatataaacgttatccagtacaaaatgaatctataagcaaaatagctgattatggattatctcctggagattctgtatttttagtatgtgatatgtatgcatctaaaagccttcttgatgcgggttctacaactagagctagcttgcggtggttcaagggtacatctttattatcttcaaacgtatcattagaagttccaaaaaatggagctgatagatggttaagatttgaaagatttactgctgttcctacggacgctgatggatttactattgtggtatcacgatatccaaaaacgtctgtagttggtgattctaaaatcaaaaaccttgtatttgttcaaacctctcacagcgaaaaacttaacagtgttgttcaagagtttggtgtgaatggtataagaatgaataaaggcgttgaaggagaaaccacagtgattatggaacttccaaattcaaaagtcgatccgagcggtgttattccagttcaatcgttcagagaaacatcagactaaggaagccttcgggcttccttttttcgtataaatagaaaatatataagaggataaactatggccgatttaaaagcaggttcaacagttggtggaaatcctatttggcacgcgggtacttttcctcttgtgccggcaggaaactccctaacttatagaggtaaaaaggtttatactgagatagataaacctcaagcaaatgataacgattttgtatctaaagctaatggtggcacaggttctcaagggttccaaaaagaagttgaatttaaagctggcgttaagatttccgcaacgttttctggtggttcaaacttaaatggattgtattctggtaacggagatggagataccagagaaaaatctaacatggatttgcgttcatggtacggtatcggtatttggaactcatgtacaagtgatggggtccaggggcgtacaatctggttcagtgctaggcgtggtactatcggaacagttggtgatattgtttcaggttcccaagttattgctaatgcttctactccaacagccgctcagcatttaactcgtaaagattatgtcgatgggcgaataaatactgttagcaacgtagctaacgcagcagtcaagaaagctggtgatactatgaccggtgtacttagggctaacgctggcgtagttatagtaaataaagcaacatccggtgaatatgctcctagattagatcaggttatttcacgcggggtaacaatagattttggcacatactaagaggtagccatggccgatcaaaacttaaaacaaatacaatttaaaagaactagcacagagaataaagcaccaggtgcagatatcgtagcccgtggcgaaatagtgttgaatacacatgggcgtactctcgctatctacaccaaagatgaagccgataacgttgttcagcttgcaggtaaaggtgttcctttcttagatactgcaggtaatcttaatgttgatggaactactacgttaaaagacaacgttactatttctccgaataaagcgatcaattttgaagcttctgatttaagcggagcattagtacgtcatatcaccggtaagtgtgctaataatgatggctggtacattggagctggcggtgcatctgaccagggatttcttgaaatcggtacgtatgataacggaaatgaacctatctattttgttcaaagaaccggtggaacgactcaagctgaagttcgtcgtttagcattattagatgggtttggcgatacctctatacctggggaccttcgtttaactggtaaaacagtaaaaatttcaaacggcagcactcttactttggaaatgggtgtaggttctaatgacgcttatattaaaaaccaaagaggtactggcgttcttcaattaactaatgacagcaatttaacgttcagaaattcccaggtttattacgccatgaacggaagaggtcctggtaaatccggtactcttctgacgaatgtagaaaacaatcgtcaagcctggcaatacacaatttcagctgcaactgccacaaccccgcgctgggttaaagtagctacattgaaacacccaggaatggcttcttcacaactggatttaatgattacaggtggcattgattctggacacggaagacattatgttgattttatcacgttatcaggacgcaatttaacatcctggagcactagcaatttagataactgggttgaatggcgcaggatgggttctcctaataaaggaaacgttccagaatattacgttgttaaaaacgatgctgctacagattcagaggcttcatttgatttttacgctaaagttcctcgatacggcaatgggctttatgtcacagtgctgaacactgctggatacaacggccaggatagtggtaaagtaattatctatgaaaccaatcaggacactggtgatactggaccgtccggaagtattcttgtttcaatgaaacagatttttgatagtttagcaaaaccagatttcggtgataccacaggtactcttccggttaaccgtggtggtacaggtgctactaacgtaggagacgctcgaaataacctgggtcttagaactgcggctgttcgtgatgtcggtgaatccagtggaaacgtgatggaagttggtgccttcggtattggtggtcacggaaaatcacttgtagatattacttctgacgttgatttaatgactcgccttaaggctcttggcggtacaacgtttagagccaacgtagcgagtggttataccggggctccttattattcacatggcgcaggtttcttttctagaactggcgatacaatgtctgcgcttaatatagattacgcaactggtaatgtcagagtatttgctataaacgatagcggtttagcaagtggaagagtgaatgctaatatgctttacggtacagcaaacaaaccaactaaggctgacgtcggacttggtaatctgacaaacgatacccaggttaagaaagctggcgacaccatgaccggtgatttaactgctcctaacttgcatgcttctggatcaggaaccgcatcgctttatattaatgcgggaagcggaaatgctcatatatggtttagaacaaacaccaatgaacgtggtgtaatttgggcaactccaaatactgctgatttaggacaaattaatattcgtgcaaaaactactggtggtacttctgctggtgattttagcttccgttctgatggcagatttgatgttcctgtagcagttaaagttggtggagcagcaatgctaaccaaagacggaaacatcacctctggttcaatgtttggcggtaatcttaataactatttgaataccattaaaaacgacattgttgccggcgataataagcaagtaagtaagactggcgatactatgaccggtaacttgactattaacgctaacctaaaagtcgaaaatcctaatggaacatttgttgatttgggttcagagaactcagacaaatacagcagattgacccttgcacgtaaagttggtgatggcgcttccgtagcaatgcttaaaattactcctgaaggatacgtgcaatttggttatcaagatgcagttgctactccatctcctagcaagtacatccgagttaaatctgatggtcttgatgtagaaggggacttggtttttaatcagacatatcgtggtgctgaaaatgcagttgatatttctgataagactaatgaccttaacaacatggttattaaaggcagtgatttaggtactcgtctattatacaagtgtacttctaccggtggcgcttctaatatattgaacagacctacatctgatggtaactttgttcttgaagttctgtctttgcgtaaaatttctgatactgactggtcatgtaagcagacctttactacaaagaatggtaatgttgaaggcacatatgttcgatactgccaaaacggcacatggtccgcatggaaagaggttgtcgctggtgttcaaccgattaatttaggtggtactggagcaacttctgtagctgccgctcgtaataacctcggtgttggtgaatggcaatctgtggcatttggtgtattgaatgtcaacggcgttagtaatgcagacccggccatcacatttaaaaatggggctatggttcgtgaagcccaaggtggtagtctcggcgcgttaatcctgtcggcttctactgcatctccagacggcgcgaaatatattgcttttcgacccttcggtgattcgtctggtactgagattagagtaaaagccaacgggtcaagtgagtcactacttgaatggtcttatggcccaggtattcgttcaaattcatctggcgcttttgttatctacgcaaaaacaggtcaggcactccatttaagaccaaacggtgataattctaaccaagccacagttattgaccaaaatggtaaaatgactgtcggtggtgaatttgaggcccagaactcaaaaatcactggtaatttgaatgtatctgaagataatagaatgattgttcttggcaaaaactctgatattggtttagtcaagaaaagtggtatgccaggaaaaatggctatcggtaaatctaactcgtttactattatggtatcaacaaataccaacaaccaaattaatcctgctgatacgtttaatgacatattcaaagtagatgctgatggaaaccagactgtttacggaaatgcccaagtcaacagacagttaactgtttctagttcagctactgttaatggtattattaatgccaacggaggtattattgttcctactaccaagtatgtacaaattgccgatgctcctacgcagaataaccaagcaacaaataaacagtatgttgatgataaggttgcttctgctattagtaatgctggcgacacgtatcttccattagcgggtggtactgtaactggtaacttgattgttactggaagccagttaaaaagtacatcactctgggttaccggtgatgctgccgttaatggtgttttaactgttgacggaaaggctagatttaatcaagagttcagtgtatctacttcagttaacgtccagaacgatggtaatagccatgtgttcttccgtaaagcaaatggtacagaaaaaggacttctttgggctgacgaccctggtaacgttagtataagagcaggcggcgccattgggccggtgtggaatttctggagcagcggttcctgccaattcccaggagctatttctaactataacggaattagtaccactactaattatcctgcaggaaaacctaatggtacatataacaataccgcaggactagtaactagatttagtaatggtgcttatgcttcaatatacttccaagagtatgtaggaaactatcaccaggctattcttaatgttaacggatttggtcgagacgacaacttctttttccgatccggtggcgacttcttctgtactcgtaatggctcttttgataacgttgagattcgttctgaccgtagagccaaatcggatatcaaagttattgaaaatgctttggaaaaagtagaaaaactaaccggtaatacttatgagcttcacaacacatccggtggtactactcgttctgcgggtttaatcgcacaggaagttcaagaagttcttccggaagcagttactcaggatattgaagcagacgggggtttattgcgtctgaattacaactcagtaattgcacttctcgttgaatctgttaaagagctttctgctgaggttaaagagcttaaatctcaactgaaataatgtaaggggcttcggccccttttaggagaaataattatggcagtaacaggaccatgggtaggaagttcggcaaaggccgttactggtgaaacctggatggcccaggctggagcaaaattgagattggggacacccttttggatgtccaacatgattggaagaaacgtctggaatgctagaataactatttctggtaacaacccagctacaggacctaaggttcgtggcgcttggaaagataagaacagtgcttcatggaacgtgttactcgacgctcgtggggctttatcaggaatttgggaaactgggtttaatttggttgcctttggattatcagagccaagcaaaacgtttggttataatgacgcaattgttctagaaggcagtggaaactttaacgttaactggcgagttgatactgaagacggtaatcaattccattttaatagctcccgagattaccgaggaagacgctgttatagctgtacagacaacaatgctttttggaactggctttatgctaatgatggacgaacattccagctgtcgtttactgcatattaagcataagttagagcaataaatagctctgtaaggagagcaatatgtcaagcaaacaatcaataccattttttgatatgtttcttgggttgctcgagctattattcaaagatggagccacgggaagagttctcttttcccgtgtttttgttgtcatacttttagcattgttggcgtttgctggttataagtcagatagtcttattactgcttacgtcgatagtacatatgacaagtatgataaactggttcaaaaggatagggatacccgatttgataatacagcactcgaacaactccagatagtacatatctcaagtggtgcagatttttctgcggtctttacgttcagacctaaaaacttgaactacttcgtagacttaattgcttatgaggggactttacctagcacggtagattctaaaaacctaggaggatatccaatcgacaaaacgtctgctgaatacagtacgcatttatcgggtagatatttttggacggataaggaattcgttttcttaccgacaaaaagaaaaccacctgaaatatcgtacatgtttagctgtccgtatttcaatttagacaatgtttatgctggaactgttgaaatgtactggtacaattccaaacctgcattatctaacgaaagactaacatcgatatgtggtcaggcggttagagctcttggaagagctaagtgattacttattactatgcatagccatcgttcgatagatagactcaaatccctcgttgtattcttcaacgagaattctcttctcttcgtcagttaactcagaaaccattttacgaaagttgctctgatttaactgacgcccctgctcgttcttgattccaatttcattcaagaacgcaataaattcatctcgcttctccatgatatgttcagcattgaacttagtcagaatagaagcaacagtaacgatttcttggacaatttcaaacttagtcattatttttcctacaacataatggattatgtgattatagtatcatcttgataccgcgttgtaaaccagtttatgccaattcccaacgagaattcaaatcttccttggtagtgatatactcagcaccagaggacatccagagcccgtagcgaccatcttttactttagccgttaaataccattcctttccaattggacgaaccctacgattcatccagtgacatacgtcaattgcctcctgaaaagacaagtcaatcagacttccaagcgcgattttattcattaacgcttcgagatatctttgtgattcaacgacagattctaagttatgactcatgctaaaactacctctccacgattgtctaaaacacgttcaatgtattcaactgcatttataatgtcacctctatcctttgccttaatagtaataattccatacgtataaaagtcggctgacaaactgaatggcttagaagtgtcctggttaaacgtagacattactgcttgctctaagtgttttacttctaagtcattagcccaagagctaagaactttaagcctaacttgtaaagtgtattctactttaattgctgaaagcaattcaacacgtttatgatacgccttggcttcatcttctctgcgtaaagtttcagtattcatagataatctccaatatcataagcatcaacacatttctgaaattgttcaagaacttcttcaggttcaacgttagctataatagctacagtaaaggtaccattattccaatcatgtaccatccaatctccatatccaacattctgaaggtcttccattagttcagaatggatatctgctactaatccagaatggtcccctaatttcttgtggagagcttctaggtcatcacaaataatagttaaagtagtacatttggaattattcagaatgcgcattgtctttacctttgtgtttttgcttacgttttgattctttggcagcgcgctttttatctttatgcgcgcctcctttgttaaagtcattcttcgctactgggttgtacatgtgcaattacctcatttaagcagttgcgtgtaatatcaaaacgcttagcaataccacattcttggatatgtgcttttaaatctccggcatgcacataccccaattccaagataaaccgtttaatttgagccttttctgaacgatttaagctattgaagtaatctgccttggcgcttattgctctcacgctctatcttccttacattcaagttccttgatataatagtcaatatctttaatcatttcttctgtcattattttgtacatttcagcaagaaatggtttagcaccgccattaaatggatggctaaacgggcagatgtattccttatccatgagagttttcatgaatttgctatctgccattttaaacccggcttcattggtatatgtaccccaattatcgtccatcatttctaatgagcgctgaagcgatttacgttgaatttttaaaagcgtaatgttattctttaatgtactaatcattagtataaatcctctgagaataattcattggcgggtcccgatttaggacgaactgtattaacttggcctgcatgtgtagcgatgattaatgcttcttcacgcgtgaagtactcaccccattggtcaacaaatccttgattgtctccatggacatgatcagaaaccaatttatcgcgaaacatatctaaaacgttcgccatatcagcagaataatggcgagtgcctggaactacaattgttccaccagatttcaattcaaaacgatttgctgcacaaacgatacggcgttgaagtaatcgtccatcccaccaatcagctactttaaagcaaatttcaggaatactaacttcttctggttcattaattagagaaccgtgacgagaagcatcaacaaatttattcatttgttcggaaaacttgctcatttaaagaatcctttaattttctgccacaaacttttcttttcacgaataccgatttgccgaataacaggttcaccctgcattttctctaaccattccattgagttaacagcttccgccattggaacaaatttagcaagggccttttggtaattatctacatccatgatatgtttaccatctgcattgtagatagcatagcattttgtgaatttcttatcaatgtatccgataaagtgcccacggaaccatacatcccaacaatcagttgggatattagcattcaagttaactttttctacacaacgctgaagttcattcaatactttaaacttgttcattacagttccttaatagagcggatgatggtttcaatgttttcagcagtacgagcgatatctaagtaagtattgcctgttgcagctacacggcaagacattccgaggtcagtgaagtgtttctgatgctcttcagaaatcttgtaaccgaagatacggaaagtacctttgttgttaacttcaagactacgaataccgaatgtacgtttttccagaactgcgatatagttactacggtaaacagtaagttctttcagaggtaagatatcttccatctcaccgagaagtttcatcatcaggtctttgtgctcattcatgtcttcagtaagaggacgagctttacgagtattgcgtttcttcagaagttcaggcttgttctcttctgcatagataactgctgctttagagatgatgtcctgcgcttcaccagtgatgattaaaccgtcaccagatttctcgatgagacctttcttaatcagaacaccgatgtttgagtttacagaacttgcgttcatggtttcttcaaggatttcacgcagttcagaagaagtgatgaaatcctttttagctacctgaaccaggatagcagcagttttctcgttcagagcatcttcggaagctttgatgatgtaagttactttagacattgtgattctccatgatgttttattcaatttgtttggtatgatactataataacatctgctaaccagcttgtaaaccattttattctgctctctgaaaaattttcttcaaagagcagtaaaaatgctatacgttaaagatcaagaacttatcgccattctcaagtttaagcacccagaaatcatcatatacacaaagaacgacttggtactcttcaccgtcttcatagttacttgcttgaattacctgacgcataggatactcgcgattaacttcgaactcatcgagcaccacaatgttacctttgacatagtggctcagtcgagtgccatcagcttgagtagaaatataaagaatgtttttgatatcagattttaatgatgtaatcattttgtttactccgtgttgttttgatatggctataatacaacaaccgtgtaagcatgtaaacaactttatgaaaataatttagggcattctaaggagggattttggatggatatagatttatatggaaggacctggagatgacctccaggttccctagattaattgaggagcaataaaactagacctaatacggcaattacagaacctataactaaataaaattctatcatagttcttccaggtctttcagatactcagcttcaggagttgtcttttcccagtacttaacctcttgtgctaggcgttttgcttcctgagcaagtttcttggcttcatcatcagtgatgtgatagatgttcattgaaacgagtttttcagaatggtctttgaatagttcattctgttcaatttctttagtcaactgcttacgagttttaccttggataacgatgttacctgcaataacctctttaataaattgagcttttgcctgagcaagattaaacgcctgtttagtttcagctattttatgctcgattcgtttagcggtgaatgtcttacggacttctacaaaatgacgaatcagctcaccggaagttttgaacttgtcgttcagcttaccattctcatcgatgaccacaatgtattgactcattttctcaatgagtttaaaatccttcatgattttagcatgacgctgctcagggtcatcgctcaaagcatagtctttacggaatttcaccttaaagccaaacccggtcttagaacagtcatcatcatatgtgatgtatcctgcatcttccaacgggtcaagtactttttcaacgtaagaagctcgttcaaacttgtatggaatttcactgatatagattgagttccgtgaagtttctttatacacgccgtgcagctcaacagaaccgtcttcagtttgaacgatttttccgttaaatttagggaactgaacttcaggttccatcatttcgccacgaagtgctgctttagtgcattctaaaacagattcaaaactatgcggaagaatagaagttgaataacctgttgcaataccgcgaacaccattcagaagaacagttggaattaccggaagataataagcaggtggaacatgctctttatctttatgcaccggagcgatttctgtgtctttgtagattttacggaagttgtcagaaatccggcagaaaatataacgacttgccgcagcagattgaaccaaacgagaaccgaagttaccttgtccatctaatagaggatagttgttattccatgtgtttgccatcagtgcaccagcatcttgggcagacgtttcaccatgatgatatcctaaatcagctacaccaccggcgacagacgcaagtttgtggaatttttctttattaccacgagccaaatcaagggcacgagcaataacaaaacgctgtacaggtttaaacccatcaatcaagttcggaatagcgcggttttctacagtgtaaatcgcatactcttttgcttcattatcaatgatagatttcaaatcgcgatgacgaagatttgacgccttagccaaatcatcaatagaacctgcttgttttaatagagtgtcaaaaatatccattgtacctaccaaattagtgagccgatttgtactataacatcggaaatgaaaagcacaatataaatcattccgtaaatcattccatagtacaaaaccaaaagaatgatggaaataactgcggcagaaactaggagtttcttaatcatttgtaaactcctacaattttacaaatgcgctcaaacataataaatgctgcagtgaacgcaatgcttccaattactttagtggtaggcacaaggccataccacatgaatgttcctgagcaaatcattaaggccatcagaaacacatagcccatcacgaagaaggttctcattagtatttctgcaaagtaaagatgaagttatcattcagaatacgattcagctcagagtaggtctgcgcatcacttgaatgctgacgagtaaacgccaatgcaagctgacctttgccataaccagtggtgagtggtttcattttattagcaggaatccagaacacaccgtaagtcatgcaattcgagcgcagagtacgacccaactgagaacgtccagaacggatatgagaaagaacactttcaaatcctgcctttgaacgctgtttagctacaaagaaacgagcagatgcaccaatataccctgctttgccatcattgaacatcaaaaaataaaatccttcacgctcagtaatttcacgagatggagcacctgttgcccaatcaccgttacgaatagaaccgatcagttctgcgccagcgttatcgagatcagcaaaagtcataatattacgcatgttaatttcctcagttgattaaagtttattctccgataaggggccgaagccccttctactaccaaaaatatactactgccgttacaccaccaacccaaaacacaagaagacctaaagcaagcagacgatacacgatgtgtcgtttcatttttgaccttcccatacggtttctactaaggatttaaggccatcagtttgaataatatcaatcgcattaatggcaaaataaattccgaatccgaacacggtgacaatccccagtgctaccgcaacaataacagacagaacagctgttctcattaagttaaagcgacgatcaaaactattacgaaccattatattttcctcagataaatgcattaatccaaacgttaaccaaatcccatgcgaaaacaccaatgaaagtaacgataaggcagaatactacaaagatgttcttcagaatcgtaagtaactttttcattttgttctccagtttagctaacaagactatagtatcactggagaacaagaaagtaaactattaaatgcacaaattacgaattttttcttccagagctttgactttctctatgtgctcatcacgagcagcggcagctccattaggatacaacccgccatacgttgaatcaccgttatcacaagcaatgatagtataatgccaattcatagattcaagaatcttatactctttcaaaagctcagctttaatagaagcatttccgcgtttggctcgaagtgattttagctctaagtaactcatgttttactcccgttcagtttgtaaggccatagtatcatggccaatcccggaagtaaacaactttttaaaatttatgcatgatgtacccgccagcaccaactcgcgaaggttttacgacttccatgagctgttcgataccgccactgaacatcggtgtgtaccgtatgacattctgggacacttcttctgcaacgaatataattatacagtctgcgactttatgtttaaacatgggccctagatttattccacttccatctgggaatggaccgtctttaccagttgtaacattaatccatggcttatgatttgctcggtcatgaacaaagtgtgttttaacttcaactctaacaccttggtagtagggatgagctagtacgtcccaggcccattcatacggatcgttgttattatggtcaacaacttgatcgtttacgtatccatcaagaaaatccgctaccacatactctgccggtatagcaattctacatcttttaagaacatcaattctgtcttgagatggatcgatatctaaactatatcttgcagtatcaatgatttttacttttgcttcaccccttagcttattcaaatctagggtaaatgtccggagttggttcaatctctgcagggctttgttcatcaatgccataaattcctctgatatgtaattcaccaaaataaacacgatcgtcgtggttacaagtgtctggttccacaacaaaatcatcaccaagttctacaagttcatcacagtgcaaccaagcatagtgaacatcaccttcatgtttaactacatgatgacaaaacaccgtagcagcatgatgagtaccacgaagattaacaactttagaatgagatacgttaaatggattaatcatgtttcacccataataaaagaggagcccgaaggctccttataattagcgaagttctgaaccccaacgatcagttacatcttctaatactacataaccacatgtacgcattttagcgtcgttgtaatcaaccgggatagatactacatcacgcggatgaactttaactgaaacaatacggtcagaaccactaccgaagtgaccgatgtaagatttagagcagacatgcagacctgctgaacaagtacgctgatcgtcttcatctacctggttacgcggcattgtaacagttttaccgggagagttatcaaacgtgtttgaagcacagtccatataagtggaacgaactactttccaaccaatgaagtgaccatcatcagtgatgtcgatatcgtttgcattcaggaaatcaaacagacgataaactgcacgacgagatgggttcagcatcaggttttccaggaaaggcagataacgtttaaagtcttcgccatcttccatggctcgaacgatacgctcagtcagaccagatttcagctcgatatctttatagaataaagtaccatcttcaattcggacgttaccctgaacgaatttcttgatgccttgttccaggttaatgtggtcaatagcaccagcgatatcaccatctacaagtttctgcagtgcagatttaaacccaggatgttggctatcagcgttataagtagtacggccttcagtaattgaaatgaatttggaacttgctgcccatttaaattcacgctcaactggagcttctactttagcaggaacagctgccgcggcagctcgagcttcgcgttctttaaacacacgccgaatggtgtcacgggaaacaccataattctcggcgagctctttcttagtgtacagaccgtttttgaagtttttaacgattgcatctttttggatttcagacagacaggtaacagccatttattcacctttattttcagaattttgagtagaagctccatcaaggagctccatgatttttacgatatcatcgacgagtttgctgtcagtccgccaagtatccaagacacttgcgatgacaggataatcatctttaaactgttcaatctttttatagaagattgtctcagcatcaccagacagtttattataaattttattacataaagctaaatcatcgttttcatctttgattttactggtacggcaaaccttagcgattttgtttagttttgtcaggaacggatttttcattccagacgcagtaaacttactcgacaagaaattcaatttatcgtaatgcgcaatatttccacagatacggtttccagtagcatttgatggcatgtactggtcataatctaccttatcaatacacttgatgtattggtcgataataaatcggtcaaatgaaagcaatccatcagcttttgccgcggctttcatagcacccggacgaattgcatagaatttcttaattccacacgcttctgccagagaccgcatatctgtgatgctcatattccaccaccaaacattatctgggaaagtgtggatttcatcacgattgcgaccgattgcataaccttcaagctcagcaatttcagatgatactaaagtctgacggtcttcttcccagtacccgtctttatcaatccaatgcagagaaacattaggagattttggacgtttctcttttggaccagtatcataatcaggaagagcttttctctgggcttcaagttcagacacacggaatactacaacttcatcagtatccatgattttcttcagctcatcaatgacatgtaattcatcttcattgtctttgattacagtaatgtgtgcccagattggaactaacccagatttacacagagctcgaaccgtagcaatacgcttacccgctttatcgtcaataagaacgaacgctttagttctatcaaccccgcaaatatcagaaatgtttacttggttatgacgatgccaagaactgcttgacactttacgacgagcaggttcatcgcatgaaacataaactgatacttcgttgtctacataatatgaacgaattttatcgagattatacttcgcaactacttgtttaatatcgcggttcccaatggtaataccacggctctgaagaatagaacgttccttagaactcagcttattgaactcacgcaagaattcacggtcagattcatacgcttcaaacgctttaatatctgcggtaattacctcttcttcaagagcattcacacgcttctggatattagcaattgtttcttcgtcaagagaaagctcttcacgagatggagtaatgtctaattcgccaagagggaaatgaacataaaccttgccataacgattaagcagccaatctgccttaacatctacaccgctgatcggatatacgatttttccataaactgcatacagaccataactttcgtaagagctattaacgctgaaccagtcggtcttatctaccgggaaatattcaatttcacggcgaagagaatctacctttggaggtacagcaccaaaggtacgcaaaatatatgcgatttcataatgccaagtatcaatatcttctactttaaccggaacagtgatttcaagaccagtttcttcgtcttctttcatgtcatcaacgaacattggacgaatagtaggttcgccgcggtttttcatgacagtataacctgtagctttaccatcatgataagacactacgttaaatgtactcgtatagcttaatggtgatttagaaccaagaccaagagcaccgatgaaatcattactattattctttgtggattcaaagaacgttttgtacatcgtcatcatgtcattatgattaagacctggaccataatcacgaattacaaatcgtgggtcaagacgagtaggagccttgatataaaatggacgattttcattaccgttcagtttatgagcatcatcacagttagtagaaagttcacgaacaacagcacgaactttatacttatagagtttgtttgacaagatgtcaaaagctttacccgaggccttaatagtaaacgttgaatcatcagcgtcagaagaaccaatgattacttcatcatcacatttaattttcattttattcctatcaattatgtcgtttaatgatttctgctacttcaagtaactcttctgcagtagcggtattagttgtaaaaattttattatggatttctttgaagcgttctttgaattcctcagctgcttggatgtcaaagaaccgctggatgatacgatattcacgatatatagcatcgttgaataattcttctgatgggatgtaactacgtttcataatattttcctcagtgatttagggaaattatatcactataactttaagcaagaatcctagaatcatctccaagcacttcttgattaaagccatataaatccattcttataaagaaaaagggacccggaggtcccttagattaccacaccctactaactcgaccataaacctcatgtttagaaccatcaatgttttccacccagatagtaacccaggttccgggcagaggtttcttttcagcgaacagatatccatagtcgcctgagatcaaagtaatccaataacgttgcatgttaattccttctaagtaagggcaatagtacccttactatttattctttattcactcatccatgtcttacgtggtgcagcatcattacccataattaattcaaacagttctttccagttttcaggaagagtgactacatcataaaccgggtcttgaataacacgttcgtattcatcttcttcaagagagccaagacctttaatataacgaagtttccaacctttgaaatcatctttatggtcttcatattcaccaagagaatagaaccaacgttgttctttacctttggtgagaataataaccggagttttcacaaagcggattcgaccttgttcaaataattctggccaattactaaagaacgccaaaagacttgggaaaattgaaccaacaccatcaacgtctgcatcagtcatgatggcaatatttcgatagttagtattttcagcgggttcaccgatagtcaaaccagtgattgcacaaatgtcaaatacttccttgttcttcatagcatctgcagcagacattccccatgtattcatgaacttaccacgcaaaggatatccgccatgaagttcacggtcacgagttgtaagtagataaccgatcgcagaatcaccttcggttaagaataaagttgtgtcagcatctttaccatatttgttggctttgatgtgcttagctactttagctttctgcgctttcttggcagctttagtttctgcggctttctctgcagcaagtttacgagctaacatcgcctcaataatcggcatatgaatatcttcggatttcataatagcgttagcaagtttcttataatcaatatcaatatggctacgaatttctccccaaggagaagtcagacgctctttagtctgagaatcaaatcgcatgttagacatatcacgaataaacatgatgacagtcagacattctttaattcgcgctttattaacttctagtttgtacttacgctttaatgctggaataagttcattgctcagttcatcaagaactaggtcaacgtgagtaccaccgtttttggtgtgaatgttattaacatatgaaagttgacggaacccgtcatccgaacgaccgatggcaatagcacaagtatcagaatcctgcactacagcattttcgtcatacatgtgggcgtaagctttaaacttgccttgaacccgtttacccatgaatttaaattcaatatcaggataaactactgctaacgtcatcagacgatcgtgaatgattgattggtcaacatcagtcaatcctgtgctttcaaagtgactgaaatctggaatgaatgatactgcagtaccagtcttatctttgatgaattctttatcttttgctgggtgttcttcccaggagatattttctgagccgttagaacaacgaacgatgatttcatttttaccatcgcatgttgcaccagtaaaagatactgaaaagatgttggttaacgcagaaccgacaccgttcataccaccagttttacgctcagaatcatcaccaaagttaccacccgcacgaggacgagtccatgcggctactggtcctggaatagtttctccttcaggtgttactacaggagcctgcggaagaccacgaccgttatctgttacaataattttgttgcctttaatgtcaactgaaatcttattcgcgtgtttgaaattagtacgaatagcttcatcaacagagttatcaatgatttcatcaataagtttgataataccaggaacatactttactgattggaatttaccaaaaagaaaacggtcatgcgcttcaaacgcagaactaccaatgtacattccgctacgcttaatgatatgttctcggtcactcagaattttaatttcgttcttaatcattacatttcctcggttagtgaaggaattatatcaactattaattatagcaagtaattcttctttgatatacatcaatttaccaagaacctcatggcctcctttaaccgctttatactcgggatatcggggccgctgtcgttcaaacatagtccattgagcatcactaacgttagcgtatgcatatcgagttccgtagtactgttcaatccggtactcgttgttttcattaagtgaaatccactcttcacagacttcataatatttctgcatccaaatagtacgaccattcacgtcattaattggccaccaagcaaacctgtattttccaatagcccgctctactatttttaaatgtcgtttagcacgtctttgcgcagttgtcattccaataatcataatattctcctctggccaacaagactataataccaaaacatggtgtccatgtaaacaactaaatgacccgaaggtcatttattcataacgaattgtgctatttttgagaaaaagccctgagcacactgttccgttaacaggttttcctgttggcccaatagccgtaaagcctgtgtgctgaaaatcatcctctgagcaagaaaagaacttatatccggtgattttgatatcagtaaatcccgcgttatctaacacgcgagttgcgttatcagcgtcagtgcatccaatcatcatgaaggcaagcgctgtaattaaaatctttttcattttaatttaaccctataagttatattacctactttaataacccggatttctccgggtttcatggtaatgcgtgctttagttcccatcaataatcaccactctttaatccatcgtagtgaactgccggagcagaaaccacccgcttcatttgaccttcacacttagggttaaagcagttaacagtatagtcacgatgggaaattttacgcataatttctatcttttttccacagacttcacacttgtaatcatacgttggcattaacagcatccttccatttttgtgttttgactatgatttgctcattcagcgcacgagtaaccatcatggagatttcatcatctgatacatgagtatcatttttatgacgatttctgaaatgcagccaaagtgcatccactacacagttaataacatctgcgcactcgccttcaaattcttctttctgccgccatggacgattaatccaatcacacatttctccagtttctgaagaaagttgcagcatgacattcccaatgctacgattaggaataggataagacatttttgatgcttcaaaaataggagctaaatttaacattgatatgcactctgcagtgctgcaatagcagcgattgcttgaccacgattatgaatagaaagattcataaccaaatcggttggaattacattcgtggaagttccaacttcagtaaagtatttgaattcgctatcaaaaattacaaggtcttcaccgccgacttcatcgcattctgtgccattagcccacgtaattcctgatactctattattttggcggtcaactttagtaacagtaaaactcccgccattttcatagagttcatacacaaagtcttcattaacctcatagcgtgaagaaaattcttcttcagcttcatcattgacgaatttgtactgtacgccttctttaaaattcattacacaatctccatgtattctgggccatcaactgtgattacacgagcaaaggtacgaactgggacgatatcaccatggttcgcgaatacatacaaccaagtccagtgctcttctttaccgaaggttttctctttctgaacaacgattaagtccgggttgaacagaacatcttcaaaagcttcagcagtaatttttacggtattttcagttttcatgttattctcctcagtagttgataagataatagtaccacatccttgtggcaaagtaaacaactttttatactaaaccttgacgttgcgattctgtcggctctacatcggctttaggcagaactgcatagttgccttgaaacactacgtttactagggttttaccgtcttcttcccactcatcagtgacaagaacatttttatgcagcgacagattagtggctgaattagtagaactcaccgattgggtaataacattgtccagtgaattcacgtgtacccacttgcgcagatagctttcgttaaacatagaatcaagcaaatcacgcgattcgagagcaactacgaatttttgcagcgaatacactgctttgtcttcattttccagttgaagcaaatatgaagacattttgttagaacggttaaagattccaacaattacgccttctttaccgatatgcttaccaccaatcactttaacgttttcgcctacaatcaaatttttcatcgtgtttctctcagtttgttaatgtagagccattatataacggctctttcataaagtaaatagctatcggtgagaaatttcacatccaacatcgacgccgaacagatacccagcttcccaccctttagccatcatagccttggccaccagaaccatcgttggagagatttccgggaggatttcccggttgaaccactcttcgaagttttcatcgaactcaaactcttccattagccacgccccttaggtaaactcagtggatcggtatcttctggacttggtgcttcgcttaggcctagagcatagcgttgagcatatttaagcattagaatatctttggcacagtcatggatactatcatgcgcgataaatccgtcgagcgtaccctttggaagaggagtagttgtcaatccgcgtgtcagaagcagtgattcaatcgcggtacgaatatcacgctgattccagaacttacacggctcttctttaaatgtatcaatttcttcttcagaaatcccttgagctctctgcacatcgcgaagacaatctacaaaaatcggaaagtcaaaactctgtccacgacaccaaccaaaggaatcccatggatgaattccattatcaatcagatactgctgggcttctttaattccagcaattactgataaatcatctggcgttgaggcaaggttagcacgggcttcagctgactgcttcttccaccattcaagagtagacttaccaaacaatcggtgacctttctgagatttcaagtcaaacttaatacgatgaccacgcttgaccaattcatcgaagctttccagaacttcagggtcagaatcaaaggtgattagagcaaggtcaatcacagaagagcttgacacatttccgaatgtttcaaaatcaataataaagtctttagccattttgagcctctagcataaatttaatttcgcgtaactggcaaccaatatattcgctcagatacacctttgggtcatatcctgtgaaccaagtaatagcattagcattatctgctatatcacgaagctcattcagaactgtatcaattttaatgttaatagcacgcttaacattatccggtgcttcaaacttagattcttgtaagccaacaatcattgtttgaaggtcttctaatttcaattcaaacatattacc

(The sequence listing continues in the following parts.)

The invention claimed is:

1. A modified bacteriophage capable of infecting a host bacterium, wherein the bacteriophage genome comprises a gene that is foreign to the bacteriophage, wherein said gene encodes a bacteriocin selected from the group consisting of Colicin M as set forth in SEQ ID NO: 18, Colicin E7 as set forth in SEQ ID NO: 20, Colicin K as set forth in SEQ ID NO: 19, Colicin 5 as set forth in SEQ ID NO: 17, Colicin E6 as set forth in SEQ ID NO: 16 and Klebicin M as set forth in SEQ ID NO: 21, while maintaining its wild-type bacteriocin functionality.

2. The modified bacteriophage according to claim 1, wherein the host bacterium is selected from the group consisting of: *Acetinobacter, Chronobacter, Bortadella, Burkholderia, Campylobacter, Staphylococcus, Pneumococcus, Enterococcus, Klebsiella, Escherichia, Pseudomonas, Salmonella, Shigella, Vibrio, Neisseria, Brucella, Haemophilus, Mycobacterium, Listeria, Legionella, Yersinia, Chlamydia, Clostridium, Helicobacter, Corynebacterium, Lactobacillus, Fusobacterium,* and *Streptococcus.*

3. The modified bacteriophage according to claim 1, wherein the host bacterium is an *Escherichia coli (E. coli)* species and wherein the bacteriocin targets said *E. coli* species, or wherein the host bacterium is an *E. coli* species and wherein the bacteriocin does not target said *E. coli* species.

4. The modified bacteriophage according to claim 1, wherein the host bacterium is an *Enterococcus* species, and wherein the bacteriocin targets said *Enterococcus* species, or wherein the host bacterium is an *Enterococcus* species, and wherein the bacteriocin does not target said *Enterococcus* species.

5. The modified bacteriophage according to claim 1, wherein the host bacterium is a *Klebsiella* species, and wherein the bacteriocin targets said *Klebsiella* species or wherein the host bacterium is a *Klebsiella* species, and wherein the bacteriocin does not target said *Klebsiella* species.

6. The modified bacteriophage according to claim 1, wherein the bacteriophage is derived from wild-type bacteriophage *Klebsiella* phage K1, *E. coli* phage CM001, *E. coli* phage E2, *Enterococcus* phage Efs3, *Enterococcus* phage Efs7 or from *E. coli* phage phi41S.

7. A composition comprising a carrier and the modified bacteriophage as defined in claim 1.

8. The composition according to claim 7, wherein the composition is a pharmaceutical composition.

9. The modified bacteriophage according to claim 1, wherein the bacteriocin targets species of the host bacterium, or wherein the bacteriocin does not target species of the host bacterium.

10. The modified bacteriophage according to claim 4, wherein the *Enterococcus* species is *Enterococcus faecalis*.

11. The modified bacteriophage according to claim 5, wherein the *Klebsiella* species is *Klebsiella pneumoniae*.

12. The pharmaceutical composition according to claim 8, wherein the pharmaceutical composition is formulated for topical, intravenous, intramuscular, intrathecal, oral, intraperitoneal, vaginal, rectal, lumbar, or meningeal administration.

13. A method of treatment of a bacterial infection in a subject in need thereof comprising administration of the modified bacteriophage according to claim 1 to the subject.

\* \* \* \* \*